United States Patent 9,487,797 (GENOMIC PLANT SEQUENCES AND USES THEREOF) - sequence listing, part 72

SEQ ID NO: 74655 - DNA, 29981 bp, Oryza sativa
ctccccccccaaaaaaaaccacgtcctatacgccgggtcgcgccgctcgtgggggcaggtacgcacgcacgcactgtcccgcaacacgatccaatccacctcgttggcacatgcacgaaccgcaccgcgcgcgcgggtgccgtgagctcaccccggacgccaccagttttgtcccggcccgatcgcgcgcgcgcgcgatcccgcgacagcgatgcgcgtttccttggagccgcacccgcgtgtgtacgtactccactactccagtccagcggcaacgcgcggcgcgcggagaggcctcggttaataccaccaggccaccaccacctctgcgctatcctctcgtttgcggccggcgcgcaacgagccgacgagcacgcacagcggaatctgccacatccgcgcgcgcgacgccggagcgaacaagcaggaatgtcctggcgccggtgatacaggacgacagggatggcgcgtcgtatcatcaccgaatactaagggtgtgtttagttgaggaaatgaaaatttttgggtgtcacatcggacgtttgaccagatgtcgaaaggggttttaagacacgaataaaaaactaatttcataactcacctggaaaccgcgagacgaatcttttgagcctaattaacccgtcattagcacatgtgggttactgtagcacttatagctaatcatggactaattagactcaaaagattcgtctcgcgattttctccataactgtgtaattagtttttttatttatctacatctaatgcttaatatatgtgtccaaagattcgatgtgatgtttttgaaaaaaaaatttaggaactaaacggggctaactgcaggcgccagtgcgctcgacgcttgtaaagcgaagcgagcctcaatgattgagagctctagcggtagccggccgtatcgccttgtcgctgtcgggatcgagcctgctgtgacgcactaggcaaatgctgcattgctgttagctataggatactgactgctttgatcggtaatttggagttttggacatgagcgctgcaccttcatcgatacagacatggatttatcatagctaggtgctggtgaatgattgcctgattagccgactagccgtgtgcagactaagaaccatgttcggataggttaatagtataataatacttgaagaagatattgtcgatacagacaggacgctaattaagcatgctttaaggtagaagatgaaatcagatgcccctttgccgcgcgatgctttgcattgccagatttctccgggatatctggtctgaatgaagtagtgcgaaggtcaaattatggtccagttgctgacgaccatgcatggttctcgtgtcgtgagattgaccttcctaccccggagcatcagaacatggctgagctatcggcaccgatcgagcaaagcagcaaattcagcttgatcgaccggtcgagcagaacagcaaattagctcgatggcacgtccgcacggagttgcggcagggggatagttacatgttcagagatttgactaattgacgaaaacttagctgaaacgcaacacggattaattctacttgatgcgaatgaaacgctgatgagatttattcaaggttggctgcctcctcgcaaaaaaagaaaaaaaagaaaaaaaagaaaagagagagagagagagagagagagagagagagagagagagagagagagagagagagagagagagagagagagagagagagagaggtgtcttcctaatgcagcttgatttgttgaacatggagccatcagccatggagtgattgcaatgctcagccagtcattacaggtagcgaaaagaaccacctggcctattagaaacagagcacaagcacaagcacaaagacacaaaatgctagtgtgaacaaacaaacaaacgcgagtgaaagcggatacattggattcatacatctgatctctagagttggtaaagaaaaatacatgcattagtaggatatatttaaacgtacgtcgcaggattaagactgtcgatcgagatttgcaagccaatacattcgcatgattcagggcagccggtacaggatcgtcttgtccgtattcaattggattcagaaacagaaactgtacagttccatttgtgtctttaacaagtcggctggctttctcgtgatgattcatcagtcaatattgtcatactgtctgtgataattatctttttataacctgacaacactgatattgtcgccacatgcagaaatgccagtgctgtgcggatacgtgcaattgaacttaccatccattccttttccttttctttgaaggaccaatggaacttatctgcaatctttttattcggaaaccgataaacaatctgcaggttgctgaccacagaaaacgtactgaaatgaaatgcattgttgataacaccgacggtttttctatttttcaaggaacattatcaaacattgttgctgctgcccctggccggcaagactatccattttacggtttacggattagtgcacaaaacacgccatgtgataaaacggataaactgttctttgccggccactaaactaatcatcagtgatggtaacacggtacatttctgggacaccgcttggatagaagggcaaaaaccataaacataatgccactagtttatacaataaaaaaaggaggaaaaatctctgcgtgaatgcatgaagaagatctaaatggcaaaacccacctcgcagtggatctgatcaaccaactcgtatccctgtggaacgcaacacagggcatccacctagaacaaacgaggttgaccaaattgtttggaagctaacgaaccatgagaaatatttgactttatcggcataaaagacgcaatgtctgggaattataggcaccaatttcaataccttaatgatctggagagcatggaccctgcaaaaagcaaattctatcaaaatagcgtatggatctcggatcgactcacaaccagaagctggccaaacaaacaacgggcactgccccctctgccaccgaatctagagcctaatagcctcttagatggcatatcaacaactggaccgagccaatgggaaccaagccaaaacgttaagcttgatgggaaatgttggccaacaaaaaggaagtacccaagaaatacccgcgcaccctaatcccgctagtcatttgggagatctggaaagaaagaaaccaacgagttttcaagcacaaagagaccacgacacctagcctattgacaaaaataaaggagaaagcaagaacttgggctttggcatgtgcaaagcagcttcgggagtttctaccaaactgcataagccacacgtaaaacattgtacggaacatttttcccttactcttaggggctatatttttttcacccctatatatattcaatgaaatagcacaatctcgtgctaattctattttaaaaaaaatattagtgcacagaacgaaatggtccatcatgctgggttgttgtttctgtgtttcttttgaaccacaaggaggaattggaatggtaatttgagattttttttttatgaaaaatgaatcgatttaccatcttttcctgcattgccattttgccagatttctttggagatcaatacaattcacatttggattataccctccacatagtatatctcatatgtttgggaattggcttgtgggtgttaataaaaagaccaaggaacttatttttgttggagcttccgctatatgttaggctctctggcttagtagaaatgaaatggtttttgatagaccacctttaaaatcttatttgcgggttcttttcagggcaacatattggctccggaaatgggctcaattacaaaggcatgatgatcatatcaagctaataaaagatgtgtatcgtaaacttaagtcgatgatcatgcagatctttgtcaatttcaggtggaaattcaccaatataatttagtagttgtggggtctttagcttatttggtttttattagtttgcttctacttttggttttgttacttcagctacatacttaccgtgtgagtttgcttttgtgaacattacaataactagcatggtggcccgcgcagattacgcggctagcatcattatattttctctcatataatagcatatatatttttttattatattgttaaaatatattacaatgacaacataattttaaattttgcaataactttacgaaactacaaatgtgtaatattcatactgtattttatatacgtgttagttattaattatttttaatatcaaattttagttatttataaattatatatattcctatatggactctatacttgtcttttaataatttttttaattctgaatttttattatttctaattgtatttctatgtgcactctaaactcatctttcaatattctttaattttaaattttaaatttcagttacttctaaattgtattcctatattgactttaaactcttcttcccatgtttttcttaattttgaattttagttatttgtaaattgtatttttgtacggactctaaacactgcttttcattttactatgtttattctgaattttagttagttttaaattcctatatggactctatactctacttctaatattccttttttttaattctgaatttctatttttttcttaattgtatttctatatggactctgtactctacttctaatattccttatttttaattccgaatttctattatttcctaattgtatttctatatggactctatactctacttctaatattccttatttttaattccaaatttcagttattttctaattgtatttctatatggactctaatctcctcttctaatattccttatttttttaattccaaatttgaactatttctaaattgtatttttgtatggactctagtctcctcttctaatattccttattttttaattccgaatttcagttatttctaaattgtatttctatataaactcatatttcaatattctttaatttttaatttcaaattttagttacttctaaattgtattcctatattgactttaaactcttcttcccatgtttttcttaatttagaattttagttatttggaaattttatttttatacggactctaaactctacttttagttttattatgtttatttagaattttagttagttttaaatttttgtatggactctattctctacttctaacattccttattttttaattctgaatttctattttttttcttaattgtatttctatatggactctatactctacttctaatattctttatttttaattctgaattctgttattttctaattgtatttctatatgaactctatactctacttctaataattcttatttttaattccgaatttcaggtatttcctaattgtatttctatatggactctagtctcctattctaatattccttattttttaattctgaatttcaactatttctaaattgtatttatatatggactctaatttcctcttctaatattccttattttttaattctgaatttcaactatttctaaattgtatttctatatggactctatactctacttctaatattccttatttttaattccgaatttcagttatttcctaattgtatttctatatggactctagtcttctattctaatattccttatttttaatttcgaatttcaactttttctaaattgcatttctatatgaactctattctcctcttctaatatttcttattttttaattctgaatttcaactatttctaaattgtatttctatataaactctgttttttctttttctccgattaatatgagaatttctaggccatgagagcgaacgtggaaactcatttttctattactttaacaatataatagattgactatagctcttgagcggtcaggatgtttcatttcattatcataaaaaagcgggtaggaaagaatttcaaggattagttcatgacttgctatgactgtgagagacatagaagaccagaaatcacttacgtcactcctcgcttgttaattacagtcttacttgcatatatgatctctggtttgtgtttaaaggctccaggtcggttcattcttaaatagcaagagagttcctctcatggaacgtcccacatgatgtagccacctgacatgtcggcccgtgagtggttgaccccatatgtcagtgaccgtcctaaatagcatggcgacaaccgggcctatcaaacgctgattttagtggccctaacttagattagggtctattggacctatgcagcgtactcactgtacagtatgactcaggactcggtcggcgtcggtcggtcctaaccaactggccaccggccgtatagacgccatggcatgtggccgccgagtcgccgtggtgccacttgccactagtaccatgaacagcagcagcttatcaggctctcatgggatagcctaatcagctaaagaataagctaaattttaaattttcaaacttaattttaagatatttttaacgtagtttttttttcaacattgacttttaagtcaccaaaaacacatatataaaagttttacctataaatttatttttattccttaataaaccgttttggtttattagggaaaaagccaaacaatggggacctcacctagtagccctgatttcggaaggctcgtgtcaaatccttgctaccctctcacgtgacacggcctcgctctcctctcaccggagacgcgtaactgcgtcagagactcagaaataacacaccagccgtgcccgtgccgtgtgtttccacccatagatcatgtgctccctccctatcttgaggtcgacgcgtcccgtacgttgtagatcgatgcacacgctgatacgcattgccatttcggttttacctcttcgggtgtacgttcatcgatcgatcgctgcaaatccttggagaggattgatgcggcaaaagctttcgtccggtgttaattcagccggtgaaagaaaaggtaatggccgctgtgtcggatgacagagatggccgcgtgcaattgttcagggtgaacttgacggggaggatcattaggccctgcccgctcggtcacggctaagccctgtcaacttatgtttagggctggtcttgggcttaggagtggatgtgttgagctcggttccaggttctaacctaatcacctatgctcttttgcatgctctaatctttcaaaagtgggtggcaaaaagcctatggaagtactaatactaaatgttcaaaaaaaagtactaatactatgttagtggggtatggggagaattaattgtgctttgcaatttatcactctaccaaaaaggatcatatagaataagatttcgaaatggcatgtctagaggtttctcgaagctcttttccaagctcgatacaatcaagcactgaaaagaacctagccatggataacgttgacttgctgcctaccactatgcgtctacggcggattgttgtttttgttttcgttttgtcgatgttctcgtctctcttatttttctttttcctttttttggcaaaagccggatttattgatttacctgagagcccttctccattttcttatgtttactttaacctgttaataaaaccataccatacgctaggtgagccattagcgcatgattaattgtgtattaactattttaaattttaaaaatagattaatatgattttttaaagtaactttcctatagaaaatttttgcaaaaaaaaacgtaccgtttaatagtttaaaaaacgtgcacgcgtaaaacgagtcacaatctcccctatctcccctaaagaacgcagccaagttggtttgaattatacctctcattatatgcttattacctgtaagtctaactaaaatttaaattttaaaactttattttctttctagtattggtttttaagatagctaataatatatatagaaatgctttatctataagttatttttagttgcttcgttaattgtagctgaaacaatcatgctctgaactaacagtaacaatgtacggtgacgatcatgggtggtcggcgtcagccacgccgtgactctcttgggctttattagctctccctgcagtctcggtgtgttatatatacatggctccatcccggtacatgtaggggcatgtgaaggacagtagcatctggccaccccgctcttcttgagctagcgactccgtgcttgagtagcaaaggagcgagtgagcatttggttctctgccatggcgaccacaacggcagaaagggatggagttgaggaggagcagaagaagaggaagcagggaggcttcaggaccatgccattcatactgggtgagtatttattgtaggattcacttatatgagaaatttttggtgaaatgatctttcggttcacttttagatagatgctgctcttgctcagtagcatctgctagctgctctgcttgtagattgagccggcaaattaagcaaacaagatagcatagtgcgcagtttctgggagagtgagttgcaatctgaatatctgatatagatgcccaagctgggcggtaatcccgtccaaaactactgcacatctttgcccgtggtttgcattttatttttttttatgcacgaaaacgtacggttcgcagttctcggaaatctggatctgatgccttgccgatgccagtaactttggtaggtttgtttgtttctagttcttttattcatcttttctttctgacggcaagagagagtgatgttaattaactgttaactgcacccatcagtaacaaaataacgccttcctatgttgttttgggaattaaaaagacataacttttgctactttattactccctccttcctataatacaagggattttaagtttttgcttgcactgtttaaccactcgtttcattcaaaaagatttgtgcaaatataaaaaacaaaaatttgtgcttaaagtattttggataataaagtaagtaaaaataaataaataataattttaaaattttttgaataagacgagtggttaaacaatataaacaaaaacttaaaatctcttataatatggaacggagggagtattggattacataaataaaacgtatacatgtgtgataatgtgatgaaagcacttatcatgacaaacttggcttacgccaatttttgtatgtccagaatgaacctatgcttcaatgcttgtatcacattctcttctatccaaagggagtatatcgttcacttcccgatttctattcagtctagtcacaccgtgtaacaagaagtcatacctccgtattttaatatatgacgcccgccgttgactttttgtctaacgtttgaccattcgtcttatttaaaaaaataatataattaccatttattctattgtgacttgattcatcaacaaatgttatttaaatatgacataaatatttttcatatttacacaaaaaatttaaataaaacaaatggtcaaacgttgttcaaaaagtcaatggcgtcatacattagaataaggagggagtaactgataataaatttgatcgataatattaaccataattaacgatgtaattaacggtcgagttgcagctgatgtgtataatcatcggtgtatatccatggttgtcgccgagaaaatctcatgagttgtctccgttgcagcgaacgagatctgcgaccggttcgccacggcggggttcggcgcgaacctgatcacgtacctgacgcagcagctgcacctgccgctggtggaggcgtccaacacgctgaccaacttcaacggcacgtccagcctcaccccgatcctgggcgcgctcgccgccgacgccttcgccggccgcttctggaccatcatcgccggatccgtcttctaccagctcggcatgctcgccctcgtcgcgtccgcgctgctcccttcgctccgccccgcgccgtgcgcgccgacgcacggcgccgcgtcgtgccgccgcgccaccgggtggcagctcgccgggctctacctcgccctgctctgcacgtccctcggctccggcggcatccgcccctgcgtggtggcgttcggcgccgaccagttcgacggccagcagcagaagcagcggcagaagggtggcggtggcgcggcggcggcggcggcggggaggaagcggagctacttcgacctctacttcttcacgatggggctcgcggtgctgctcgccctgacggtggtggtgtacatccaggagaacgtggggtgggggtgggggttcgggatcccggccatcgccatgttcgtctccatcgtggtgttcgtggcagggtacccgctctacgtcaggctgaagcctgggggcagcccgttcacgcggctggcgcaggtggtcgccgccgcgttccggaagcgccgcgccgccgtgccggaggaccccggcatgctgtaccaggacaaggagctcgacgcgctcatctccaccaatggcaggctgctccacacaaaccagctcacgtaagctttttttttattattttctttcctactgcacgtccatttcccgtgtcattgtcttcacttgggcagtaaaacaatttagcatagcgtgcacgtgacggccttggtgtctgtggtagctactttttggcggtagatacattgtcagggcagaaaggagaaagccaagcgagagtgcgctttcctttgaaagtgcttcctctttcttacctagtcacacaagcactgcccctaaagtttagatttggtgtcacatctctatctctagctattgtatcttgtgaccgggagaaaactagattaggttgaatacttattttttcgacgttagagtaggttgaatactaaattaaacacacccactattttagtttcctcccttccgatacatagcatttcctttctgaacagttcgttgccttgcgagttttaattggaataaaagaatatttgcatatacaataaacgggtttgctaaaaataagacgccatatttttcacttaatttcagtcacttttccataagtgatttttctcgctcctgtatgtaagtatgcttccatctctcatatttcctcttctaagtagataataaattacttttaatccctattctcctatatattgtgtattagaaaattacaatgtaataaggaaacatacaatgtacaatgtaattacagtgtaagttttaaaatttacagtgtgattacaatttaaatgcgagtaatttgcaatgtaaaaatgatttgattatttttatggaaaatatagctacatccgattttgcagtgtttttgtctatccgatgttcattttttgaatggaaattaaagataaggtcgaaatgtttacgttttttttggtttttttggagtgaaatgaattagcttagtagtttttgtttctattttgaaatggaaatataaatagaaataatatgctctatttgtaaatggaaatgaacataattaaacaagcatgccctttgtcaggtcgtcattattaacaattatttcaatataaacagtgattattttttaccaagatatattataaaaacatccattgcacgtgcacaattattagtgttttttttacttcataagataagtgtaaatttaaaaggtaatatttaaagcactttaaagcaatcttagtatttgttttgatgtctaagtttaaaagtttcggctgtaattttcaataatcaaagtatgtttctcaacgttgttttcaaccatgtgtatttttgaaatatcgttttcacccatgtgtaaagagaattttttgagccacatcaaaaggactgagcccgatatgttcagatttctttttgacatttctagttgttttttactttaaacccgtatcattatgagaaggggcaatatatatgtatcaacataaaagatagatatatatgtattgaaggataagtattgataaaattcttgaaaaaacatatcgcaagaaaatatttgatttgtattctaggtcaacatagatttacgtccacattttctcaagaattaaaatgatttatctccacattcatgacataagcagctggtttaaatataacaatgttgtaaaacacatattttctccgaggagtgtacactcctacataaaaggggtaaaaaaaactcaacagtaggtgtttcatgaatcacgaggaactatatatgattaattgatcattaataattttcaaagataattcaaatccgcttataatgccgtactggaatgctagtttctttttcctcaatacgggtctaagatacaagcccgaaggggaatatactatgaaacgtactgtagaataaatgcttgcgtgcgtcataacgaaataaatttgccaccattttaagcagtctattgtgatctaacaagacaattgatttttcgacttaattaactgaacgactattatagacggttccatcaaaaatacttgtgagccgtttgtgattaaccccttctgctgtagtaaccgtcccgtgccgtgctaattcgttcaggttctttgaccgagctgcgatcgtgacgccgggtgacatcgccggctccggcgagccggacctgtggcggctgtcgacggtgcaccgcgtggaggagctcaagtccatcgtccggctgctgcccatctggtcggccggcatcctgctcgccaccgccgcgtcgcacaacggcaccttcaccatccagcaggcgcgcaccatggaccgccacctcacccctcgcttggagatcccgccggcgaccatgtccatcttcacgacggtggcgatgctcgccggcctcgccctctacgaccgcgccttcgtgcccctggcgcgccgcgtcacgggcctcccctccgggatcacctacttccagcgcatggccatcgggctgggcatctccatcctcggcgtcgcgtcggcagcgctcgtcgaggtgaggcgccgcggcgccgccgcggaccacggcctcctcgacagccccgccgccgtcgtgcccatcagcgtgttctggctggtgccgcagtacgccgtccacggcgtggcggaggcgttctcgtcggtggcgcacatggagttcctgtacgaccaggcgccggagagcatgcgcagcagcgccgccgcgctcttctggctctccagctccctcggcaactacatgggcacggtgctcgtcacggcggtgcagcgcgccacgcgcggcggcggcgagtggctccaggacaacatcaaccggggcaggctggactgctactactggctcgtcaccaccctcatggtgctcaaccttggatactacctcgtctgcttccacttctacaccatgaagccattagaggtggcagaggaagacgatgacgagaaggagtgtgagctctcctccgtccacaaaaatggcggccccggcgggttggtgtgacgaggtagattaggataattttatcagggtggataatgttgttaattacggagtacgaagtaattagctgtgcatgtgcatgccaaatataatggttgcaaaatacagcctttagggcatgtacaaaaatagagtcagatatgagtctctatattatttagagactagcatcttacaacagttagagacaatatggtttctaatcattaatgtatccaaatactttttcttactcttctttcctttttttcactatcatgcaacaaaatttgctctaataaatgctaagagtcgactctgagccattgtcatgcattacaaccatacttctttctctttcttccatatcatcaaatttacttgcatggcaacagagagagaccactaatgaagaccgttgtacatgagataaaattagtatatttagatactgaggtaggatccaaatttggcaatcatgaattcatgatcatgatcatgcagcaaaaggtaaccttgataaataaacatgatatatatcgtagccatgtggagagataatcgcagaccactttatttgttggagtacactagtcactgatccccacaaccggctcaatcaaagagccacatgcccacatggacacatggtacaatgtttacacgtaattcgtgcgtaagattgaattattaggcatctccagactagaaaatatcaactagttttcatacttgctatgttatatagatactatgtataaaaactatatatacaatggattgaatcttcaaattaaattctcatccaatcatctctcatctctctccatctctttttatctatatatccccttattttcatttttgttgagttgtttcttgtgtaaagaaggtgtcttcatctttttacctctctcctcattaactctcttaccacatcagatttttcttatgtgacagtgtatttaatgctacactacatgatatgaagggttagggatggccttagagagagggagatatttagtgcgcattatgatatatgtaaaaataacgatacaatcataataaattgctagctttatgcaccatccagatagacgtggccatgttgttggtttagtaagctactagtggaaaaactctgagtacagtcatgattcataaatttttgaaaggtaaaatgaaatctaaaaaaagaccaacaaaataaaccatcttatcatctcaaacataatactccctccggttcaaattacatatcattctacgtttgttctaagtcaaacatatctatctttaaccattactttttaaaaatccatgtataatttaacatgtaaataatatattatgaaattaatattttggtgaaacttaaaaatataaatcctatgatgctaaattatataaagtttataaaaattatggttaaagataaaatgtttgatttagaacaaataagtaatttgtaacataggaatacagttatatttttggagggacagagtactctcaattgacaaacctataactaggtaaggcaattttgcccataggtctacccggcccgatgggtatgagaatgggtgcaatattttacccgtggacacgcctgctcgagacctgacgatgtggtgggtagcagctgggtctcatttattacccacggataacccatgcctgatccggtgtatgtattattgattttggcccatgcttgcattctcataccacttcctcttggcccattaaccccacacacacacacacacacacacacacacacacacacacacacacacacacacacacacacacacacacacacacatatatatatatatatatatatatatatcccaacatcaaaccctaacctaatttccatcccacctcacatggcggaggtggcgactcaaggcacgtgcgggtaagcgacgacgacattggctcaaggcagcgcgtgggcaagcagcgacagcggcggcacgagcaagtggcggtggcaggcaatggttccagtggagtcggcggcgggtggcgctacagagtaagcggtgcaacgacgggtgccctccgggtatgcacgtgcccattgggcacgtgtatgggcacaaagttttgtccactaaaattattgggtatgattcaagtgagtattgtttttctctgcccatgcctgacccgacccgttgccacaatcttctctcagcaaaaccaaaatccattcaacaccaaaacatgaacttcatctgacgccagtgggatatggtggacgccaactatttgcctttcatcagccttggtggtcccctcttcatccatagccaatggcggcgctgctgtagtggacggagctctccatcctcaattccccttgatgtccaagggcgttgttcctcggcagcttttcttctcttccattgacgttcgattgctactcctggtccagacgccaaggcgcgtattgttcatcgcacttactctctggttggaggggatgacattgaggccaataattatattgtcataacaaaacaaatttacaaacttactggtcagactcatcatttggctctcattcaagctgctcgccgttcgtcgttcaagctactcaccgcgcacctgccagagacctctcctcggacgctcaccgtccaggtcttctcctctgatgagggcgggtgggaccctcctctcgcctgcgccattctccaggaatgcgagctccacagctacttacgccaagcccgtcgtcctgcgcggcgccgtccactggctctgcctcacatactcgcgtcaccgaatcctcgtcctcaagtgggaacatcctccacgcggacgctgcgacgtcgcttcgccgccgctgaaggcgtcgctgatgagactcccgacgccgtgccacacgacatgtgcctcgtgctatcgcaggcaacaaacgacgtcggcaggacgagccatcgcgctgcagcgtccctgagtgtggtcgccctcccaggcaaccgcatcgccgtctaggtgcgcatcaccgccgtccggcgagggaggttagtcgacatctgggagcgacgccatgtgatctgtgaggactagctaggagagcattgcacggccataggcagccgcatcaccagttttttaattattttctgttgtaactatcacgtagatgccacatcaatggcatcgtgtgacaaagattagtcaaaggaggtacgttggcatcatattagccaaaatcagggacattactattgaaggaacttgtttgcacttgttttgtaagttgagggacctattttatctggtatttcggttcaagaacgaaaatcgaacccactataaatttaagttaagatacctaaaatgaactttattcctttcagaacgaaagaaaaagctcactcatgtaacaacaccaattctgaatccagaccgtgtcaatgaatcgttcccatagcacgcgagacatctacattactgaaaaggaaagctaatcccatgatcccaccaaaatgagccaagtaatcaacaaaacaaaataatgaccattcgattcacgtggagacaaaatagcttgaaaaaatctaagcagttggataaaggaagtagcgatcttcttcttttttttcactactataaaacatcaaataggtgttgccactgtaggtgctggtagtactaaaaccggcatctacaggcctttttccacctccacgggttgaaatcgtaaaaaactagcacctttaagtaagtaattataggtgtcagttctaaacaaaaaccaacacctattatattttgtgtcttttttaaaaaaaacccggcatctataatatattataggtgtcggttaattaaaaactgacaccccaaaaatcgagccaaatagagccgagccaagccaagctggagccaagccggcgggccccaccacgacgaggcgataaggtctcgctctctcgctctcttcttcccgcctcttctcctcttctttgtctcgctctcttctctcgtctctctccctcccgttgccggctactagccggcggaggcggcagcggcgaccgcgccctcccctccaccagattcagcgggaggggaggcggctgcgacaggaggggaggcattagcggcaggcatagtcggcggtaggaggggccgacggggtcggtagcgggcggggtgtctagatctagcgtcggcggcggacggggtggctggatcctgcttcgacagcgagcggagttgctcgaggaggggaagcggcgggctcgatgaggggaggtgacaaagggcttgctggcggggaggagccctcccatccgccagatctggtaggaggggaggcagcggcaggggcggcaggctcgcggaggagacacagcggcgggcgacatcgtgacggctcgaagacaaccgaccgtgcgatgacgacttcattcggcggccagatcttcttcaacaaggcaagccaccaagccaagcaaatccctctctctaccattcccctctcgcttctccggtggtggtgtgatttttttcattgaataaatttgtgttgtgggatgaatccatctttgaatgttgtgggatgaatgttgtagactgctcggctcgatgtgtcggctcgatcgagccggctttttttttattcgtcgaacctaaaaggtgtcggttctaaggaaccgacacctttttaattttcaaatcagtaccacctcccttgtgccggttggaaaaaccggcaccgaaagaggtttcccaaccagcactaaaacctttttctgtggtagtgtttttagaaaaaacatggagagtctagaaggctcatgagcctactaagaaaaaggtattaaggttgtggatactaatatcacttcagctatgtacctgtcaatggtgttctcatgattaattattattacaaaattaagcttagtgttatttaaacaacctataaatgtatctaaagtattgaaagcaaaatggtttcaaagcacctcattggtccatagtggcaaaaaaatatggatcatcagattgataaaaagacaaaacaagaaaagcaaatgtgggccatcagatcaaggaagtagaaaaccaggtcaactgataatgatgagcaatctaggtacttcatgcttgattattttttcgggtgcaatgctgaaagatggtgaatgctaaggaagaaaagatgaagtagaattaggggtgtttagatgggactaaaactttttaaactttttagtccctgttatattggatgtttagacgttaatttggagtattaaacatagactaataataaaactaattcataaatgagagctaattcacgaaacgaattttttaagcctaattaatccataattattaatggattaattagacttaaaaaattcatctcgcgaattagctctcatttatgaattaattttattattagtctatatttaatactctaaatatgtgtctaaatatccgatgtgacagtgactagtccctgtttcccaacaccatgcttgtctgagttaccagttaaacataatatcaataatatcaatggtgattttaatcattgctttttatatataaagcaaataggctcatatattactgattctaatggtcgggttaaagttgtgcgaatccacaactccactggctagaacaactggaaatttctttcctgatttaataagcatgtactccctctgtagcctaatataaggattatttattttaaaaattaagaaattagcaaaagtacaaataatggtacaaaatatgataggatatagaataaattagtacaaaactgggcagtcgaaggaataaactgtacaaaagcggatatatgtgagagaataaataattattttgggatcataaaatttcttatattttgatacaaatttgaagaccaaaataccaaataccttacattatatggcggatagagtaattaaagatttaaatgcacatgcaaatatgcaatgccaccctttatcattggacactccacacactcgacctatcaacttcaagtcttcaactagtccactgttcgggaatgatccaattatttatttgtaactactcaaacgcgtacctaaacactgatgcgtacatgatatcggcttgacatggacagcaagccacacacaaggtcaagctcaggccaacgtatggcggacagtcatgacacgagacgagaaacaatcacaacctggaaggtgctacacgtacggtggagaagatgcgcttctctgatctccacgtctagtggcggtcgacgaagctcttgatggcgtcgacgagctcccgggtcctctcgccggtggccgggtccatgtcgacggcgtacttgttgaggtagaaggagtggctcatgccgcggttgaccagcacctccacgtccttgccggcggtgcgcagcgcgtcgcagtactcgaggttggtgtcccggatgaggtcgtgctcggcgacggcgaccagcagcggcggcagcgggacggactccagcggcggcgcgttcggccccatcgggcacgtgtacgggtggtccttggtggcgccctcggggagcgccatggcgaggaacttgtcgagcatgtcgagggtgaagaacaccgagtcgggcctcggctccagctccgacttgctccgggtggcgtgcacgaaccccgggtggagcgggatgcctccggcgacgcggaggggcgcccagctgtccgccccgtcctcgccgacgcgcgcgccgacgtggtggacgaggttgccgcccgagctgtccccgatgaggaacacccgcgagaagtcggcggccgtccggaggagctccgccgccgggtcgccgagagcggcggcgtcggacagcgcgatggagcggagccggcggagcccgtcgacgccggtgtcgatgtgcgccggcaggcggcgctcgggcgccaagggcagctcgacggcgaccaccacggccgggagcgcgcacgcgaggcgcgcgtagaagtggtggtacatgagccaggacgggtgggagatgcagaagccgccaccgtggagctgcacgacgacggggaggcgccgctcggcgagggcgacctcggggaggtacacgcggaggttgggctcgccggggaggtcgtgcagcgtgtggccgtcgcgcggctcggcgtaggcgggcaccggctgcatcagcgggagcacctcggggggacccgtccacgtgcggtcgacggtgccgtcgtcgaacacgcgcagccagccggacacctcgtccaccaccttgcgcccgaccgccgccgccgcgacggcgtcggtggcggcggcttgcacctgcgcctgctgcgactcggtggcgatggccattgctgccgtacgtacgtcaggctagtggcgttgcttccgccgtgtgtgcgatgcgattcgatgtgcgcggtgcgagagatggatgaagtggcgagggttttattgccggtgaccgagtggctccgtgttgcagttgccgattgtactactgggaagtttcgcacggaatatcacggcgattgccaagcaaaattttcccggattcgcaagcagagttgctgcagagtggtggagacttgacaggttaggagtagggtcgtgtgtggacttgtagagcgactagaccaaccgaatagcgagtgttctttttttattgcgaaaattatattgactttggtggttatagacgagattgcaagaaatgatcaggtcgtcctcaagtttcatactactacatgtggcctgtggccatgtggatacagcaagaagccaagaagtatatcactaatccgttcgtgaatctgaatcttaatccgtatgaactagggcgttcatgaccaaggacttcagtgttttgcaggttaggtcgatcggagaataacaacagggaacatttactatgctgagttataatcgaactccaaacaacaattttctcgttttctgtttaaacttaccgaactaaaaaaaaatgatgtctcttattaaaaaatgtctatatatatatatataataaatctattttttataataattattccctcgtcccgaaataaatgtaaccctcttgttacttattttattttagaatgaaagaggtaatacttaattaattatatgctaatgagttttcctgtatcatgtacctccaaatctcctccccaacctgttgtttgaaaagctatttttttttcagttcgtgcgaaagacaaagtaatttctgtagaattcgtacggtaagttccaaacaggacgcaagtacttacatctggagtacgaatttttctctccataaaaaataaaaaccaatcctaattacaaacctaggtttatctttttttaaggacgaaatagtaaagaatgaataaaaaatttgaaggtagagaatgaacaacatccttatatccgttggatctaatatggatgggtcggaccagatcgtttgttaccgttctaatgctacagtaccgttccacatttttgaaaccgggcacagtgatgatatggacgtggaccagacctttctactactgttctaatcacattttttgaaccggacacagtattgccacactgatctgcattttcaccgctgtgcgccacagttgctccacgactttgcttcttcttcttcatcaggtcagaagttcagtcaggcaagtctttctgtgcgcgtgcgtgactcgtgcggccctttttgtgcaaaccgtggggacggatcgcgcgataaggtgaattattcgaatcgtctttagcactccaaattcgatcaggcagcaggtgcagggtcgtatggatttggagctttggacggaccagaggagggacaggattagtggggctacagtaaagcatcagagtaatcgccatcagcctatctagtagtactactgtatgttgggtctcttgaataagtcggtcagtcgttgtggtcaccattcaccaatgtacaaattaagcaggagattaaaatactactgtaccattcattaatgtagaatgaaaacgagaagtgggtattactgattcgatgactaaaacgagaagaaaaggatgtaatagtaaagagatttagggtgtgtttgagtagaacgggattgaggagattgagaagatacgtaaaacgaggtgagctattagctcatgattaattaagtattaactattttaaatttcaaaaatagattaatatgattttttaaagcaacttttctatagaaattttttgcaaaaaacacatcgtttagtagtttgaaaagcgtgcgcgcgaaaaacgagactcaatctcccctatcaccttgaaacgaacagagccttagtgaacttcactttaaaaatatagttttttggataaatttttggactagaactttagtctttagggtgaaggacagaggggaataatgtttatgcatgataacttgggttgggcttgggcacacggattacacctctcgtcaactggactaagttatacccctgactactttaatggaagcaaagtggaaaattggcaggttagtagtcagaaagacacattcagcgcttctgctaaagctagtaaagtctcttgaagcgaagacaagcattcctaatattttaggaagtattcccaatattttaggtgtagtactatatggagggcgtgaagacgtcaacgattatccacgggccttactttactgttttttttttgagaacattactttacagctatgatgctatatctgtttatatatacgagaatatatatattttttactatatgcacctacactcttcttcttctttttcgttcacaaaagatattgcttatagcggtggtggaaaatttaacactcagtctttaccatttatttcttttaaagctatttattttttctaaagtggtatagatatcataccctaatacaaacataaaacacagttcctactacccgactcgtgtgtcacattgttgtatgagttaactttgttttgaacgacttacaccgaatagagtaggaaaaaaattacaagattgcaactctggaaggtcgtaactaggaaaaagaaaaatatatcatcacccacacaccgacaacgccaatacacaggtccgggagaaggctagcaccggaccagtcgccgttaagcgtgaccgaccgccactaggccaataaaggaatatagacaagatcgtccaaaaaaacgcctttacaaccaacacaaagcccaactctatctagagcgcgcttgcaccaatcgttcaagaggtttcggcaaggggatgcctagacgacatcttaagggagagaagcgacgggaaaaccgccaccgccgtccgttagggtctcaaaagagccaaggttgggctttcacccggcaaccccccttaaggagtgagacgacacgacaatgccctcaggagggggaatgaaccatcgttgttggcccggccaaggccgagctgggttttcacccgctgctcaccacctgcgagtccacgctgatgcaccgatgctccaccactgttcaaactctgccgacatgtggggccactgcaccggtgccccctgccggccagccttcacgcgccaaagactgcgccacacccgccagcagctccttgcaccgtggtcgcctccttcaccaccggccgcgcctcatcgcgttgcgccggtctcctccaccggatgcacctctcgcgtcaatctggcctccagcccacggccgcgcctttcgtgccaagccggcctccgtcgcccccagcagcgcctctcacgccgtgccgacctcctccaccggacgcgcctctcgcgccaatccggcctcccgccatcgactgcgtcaagccgacctccgaccttcctacaatcgctgtcgcgccggccagatgcggccgtcttccttgccgccggctagccgtccgagaccgccatgcctcctccaaccgcagccatggtcacgcctccacttgccgccgctagcgatcgtctcaccaccgctgccggccgcacctccatccattgatgtcaccggccacccgctgactccaccagccatctaccgacctgcagccaccggccgccgctcggcagtgagctccacgccgctgtcccacgcgctccgtactgccgccgcgacggtcgctcgatctggccgtcggatccacctccgactctgccggatccgccacgctgacgccaaaccgtcgccgttgccaaccctgccgtcgtcgccatccccgccgccaccgccatctccaccgccgtcgtcgccattctggccgtcgtcgcccacaccccccttgcccctaccgttgccgtctccagccctgcgctgtcgctgtccccaccgccagccgccaccccgctagatccggccacagtggcgcggacttggcggtcaccgtcgccgccgcactagaggctccccttgctgctcgcgcaaggagaggcgtgaagccccgctgccgccgtccttgcggccacgcggctttgccggcggccactcgggcagcggcgaggcggaggaggaaggtgggggaggggaggagggggtgaccgggttggtctcgcgagtcgcccctgggggagagcgacacgggggagaagatgctgtactttatgagttaaactttataacactaatggatggagtatattataaagctaacaaatactgcatccatccaaaaatatttgacaccagtgcagctttgtcagtttaatacacaaactgcccaaaagctgaattagcgcaactctacgattccaaactcgtcaaaagatggaagttgtgaagaagtataaaggaaattgcatagatgcggaatacttgcaccatcttttcttaacggcctgtttggtaacctgagggaaagggattgggagtttacatgagggaattgatgatgagattaagatgggaatttgatttttaatcccaatatcttgtttggtagaggcgatgaaaattgatagggagtttagttggagattggatcattaaaaaaaacggatggatgagatttgcttagacaaagtaaaaaaggaattccctcccaattacctgcccctacccaggtattgaaaaggagagagttccttcctcaattccccatctccatcctaccaaaatttccatgtttcccaaccaaacaaaacacttaatagccttatccctctaactaaacaggccgtaagggaaaaggtggggaaaggagcaaaatgattggcgcctgtggtcactgcacacaaaatatggacaccgcaaaagaaaaaaatgtggcgacgtcgtttatgtgataaaaaaacataatttatgattttcaattaaaaggcaagagggaaaattgtccatgattttcaaactaataaagggaataaaaaaactaataagaggaaaaaacctgcactacagtacataatttactcagtgtcacaaaatgtcattttcctataacttgttcgtggcagtagtgcatggacgtctgtttgtggcagtgcactccctcaatcgattcatcccaaattcccaatctcggactctacagaaggtgaaaggtgcttaccacctgacaggcaaacagcatatatagtattaacacctacaagtgcagtagtctgctacacgagtacagagtagtagtttaaagtttaaaaccaagattttgcagcaaatattctgttgtaagtagtctacctaattatgaatatagacatgaaagggatcttctatctgccatgttcctttcctttccgtttgaaaactgtcttgaccaggccacacactttgtggctgggaaaaatatttcagaactccattggaaatttcgcggaatatgtaggagaattggatgggaacccaaggtaagctgtgttagtattttcttcaataatgctatgtacaggaaattagaaaagcagacagactacttgtcttaagtcgggtacttacatggttggcagcatatcctatggaaaccaaccatactgtgcaaactttggaaactcccatcaagatctctggatgggcatccgatggataggggtggaggtgggacaattttgtaaataaccgcccgcaattagccttgctaatctccttttttgcaaatcaacccccgcagtaaccctgttcggcgccctaggacgcgtcatccgcgtcgcttcctttcgactccgcctcccgtgattcaagacgacgacgacaccgcccagtgaatcgccggacgccgcgaacgcgatggagcccggcaatgccatggactctgcgatcgagtatgctcgcgtgtccagcgacgccatggattccggcgcgcgcgtcgacgccgcctaccagtgcgttttccaggaatacgacagggacgcgctcaaggccaacatcacggcatggggcccctggtgctgcccacctgggatgagctgctgttcgtgctcctccttcctcctcttgcttgtctgctgaagctcatcacggccatgaagctgaagctctgctgttgtttgttttctgctgttaaatgtactcttaagatgaattgagcaatgtactcttgtgcggcgcccgccatggaatgcttcttgtaaacacttttttttactagtgacatcattcagcttattgctcctaattttcagatcaattgtgctgcatgtacttgccaggtcaattttgagttaatcacattccattttgagttatttgaatatctgcacaatcgtctctgtccagctcggcgcccgcggcatctccactcggccaatggccaccttctcttcaccaccgttcacagtcccggccttgctacactccatcgccaccgctcacgcgacggtgccaggggccgttgccggagaaggactgcgccgccaactcacgggcgggcgggcgcgggcgactcgcgaaggaacgacgacgcagcgagaaacgaaggggcggcgggcgtcggcggcatcatgtgaggcccgcgaccccggcggcgtctggcgattcattgggcggcgacggcgtcgtcttgaatcgcgggaggcggagtcgaaacgaagcgacgcggacaacgcgtccagggcaccgggaaaaatttgataatttgacatttttttcgttgcctaattgctttaattgacacttgtgaagatgacatgtgggaccatccgagtgaataaaagtgggccaggatgtcaaataatcgaaacccatttaaaggagtgttaaattatcaaatctctcggggttgatctgcaaaaaatgaggttaagcataccacttcggaaaagtagaaaggcacggtgttaaaccacaggcctttaatggaactcgatcactccatctctttggacatgcatgtgttaaggacatagcaaggctaattgcgggcagttatttgcaaaattgtcccacttccacccctacccatcggatgccgagctctgctatacatacgataaacatcgtacgattagtgtacgatgccttctaacctctaatgcatgcagcaaatatagggtccacaatgtttccatggcccaatcatttattatgcatgactggatcgtaacaagtttatcgtatatacagcaatttccatcggatgcccatccagagatcttgattggagttttcaaagtttgcacaggatgtctggtttccataggatacgctgcctacatagttatagggtaaggaagacgacgtcatgacgctaactgtgagatatggtcaacgtgcaaacatgctagcctcgtctttccgcttatacttatgtttatcagccaaaatttaaattttcaaccttaaatttgaagttgatttttgaggtttttttcaatcgaagtttatttttcagccttagatatggtcaacgtgcaaacatgctagcctcgtctttccgcttatacttatgtttatcagccaaaatttaaattttcaaccttaaatttgaagttgatttttgaggtttttttcaatcgaagtttatttttcagcctttaattttagatcgttaagaacacgtatataaaatttttatttacagattaattttcgtttgtaaatatatcgtttggctttttcagttttgtgttttacctgtggtgaaaagaatagtataaacatcatgcacatattctgttagtctggttagccttgtgttctgtttgttctgcctttctggtttttaagagaagttgctcagtaaaatcatgactaacagactagtgctgcaatcaacatatataccatcaagtagaacaaagatgcgggaaggcacttgatttacactgatggatagagcactggcatgaatagatgaatgaaatgtttgcaagtcgagttcaattacgtacctgttggatgttggctaatcatgtagagatctaaccatttgcacaagagtactcttcattcttcacagatcaaggactgtaaaattgagcaactaaaggttgtcgtctcatagaattgtagtatttaagaatcacataactctttgaacagcagcacagttttaacctaccacagtgtccagtagtgaccaaatccataactaacagtcaatagaatccataactaatatttcctatctccagttcccttccatcagaccacgggcagaaaactgaattaatggataaactctaccattttctacattcccaatgagtatactcacttaagggcaatgatgatgagtacatgagatagctcaacttaaattggagaccatcttgttcagaagtttcagtctttcacccacactggtaacttgacaaacaagagccacacatagtggactgtttctctccatactcctaactccttagtgacatgcaggagtactgcatgtttctaatatgtgatcatcattttccttttttcatcaacctattgtccttatcagcttgagaagtggcttatttcatgtcagcactaacacagtagctcaaacgtactttcatgtataaagggcttccattaagtcatgatgttgatattttgagttgcaaacatgtcccatttgctcttcctttcattaagcacctatatttaccttcaaattatatattgcactgagtgtatatcaccagacacacttaactgctaagcaatacaaaatctgcatccattatatgaaattgatcatccagatcttggttcagagacattaacatcaaattcaactgaactatatccaggaagcttgtcaacttttacttccttcatgaagcctcttattctctctgcatcactatacctcccagcatctgaatatatgtttgccaagctcatgaagtaaccactctttgaaggtgacatgcccatcaacttctttgaaattcgttcagcagcttccatttccccatgcactcggcaggctgctaatacacctccaagcatggcctcatcaggctcgaaaggcatttcctctatgagcttaactgcagcaacaacacggccatcccttcctagcgcatcagccatgcaagagtagtgtttgagctcaggtttcacgccatgccgtttcatcccctcgaatattgcat

SEQ ID NO: 74656 - DNA, 3661 bp, Oryza sativa
cttccggccaacacttaggaaaatttcagccaatgcagggtccagaagttccgggtccagggaccggaacttcctgccagccttctctgttcggtctggacccatttgaaaaaatggctctcaaaaatattttatcactaggaacccactaagagcacttttttatatctcagaacaacacttggaaccccctcttaatagtacggtttttactaaaactcgattttaaaaattaaactatcctattgaccttcgagcttcaaatccgcttgaatgagtgttgttgggggtctccaagcatctcttgatcacctaagttaactatgggactaattaccttaaagtctcaataaacacattagtcccttaaccttattcatcattaatcaccaaaacacattaggggataaatgcaacttcaattatatgtgcacatacatgagtacaccttgtaacacagtggggattgtctgtagtattgctgatgcagtagcagacaccgatgcgtgggtccggaggccatcgctgaatcccttccctcgtattaaaatgcacatcgacgtgtactccatgaactcgctgaaatccgatcaaaattgacgcacccgctttgtaatcactggccagactaacacctgtttaaaacatacttgtgtatacgtaatattaattagcaacataatttaaaccttagcgattagtgcatgccccaacacttctactactacgcaattcagttcttttccaaattagtgcatactcatacaactacgcgtacacgaactcacaaagtaagccttatgatacagatgttggaattaatgaatgggccttagcccactcaaagattaattctttgaaaaatcacaaaagcccacctcatgggatggcatgcatgtggagtttagtaccaccttgcttattctaggaaagggagacctccttaaaagggaggatgccctcctagccacttgaagcatgtgtggtggagagaagagggggaacacacacgcgcgctcgctcgcctggctgttttgttttgctgcctctatataaaccgagccgccgccttcacgcaacacacgcgaaatcaatctagggtttgcctcctactctgtgctgcgccgtcgctcgtaggttactccatcctgctcgccggtgtgcacctgcgatcgggagagcaggtctccggaacctctgccttcgatgtcctgcaccgggagaaggcggcaataaggtttttgggaagcgctttgcgcgactgctccctgttcgtccacgacggctcgtcttcctcttcgctcgcgcgttgcgtgccttcgtagacacctgcgaaaagtttcgaccgagtagccggtctttccgccacctcggtacgtgttcaatatgttgcgcatgtttgatctgttcatgttatactgtgtagtttacatatatagatctaatgatgcgttcatgctagttttcatctgtaatgtcatgatttatttatggaatatattaaatcattatatgcctataatctcaacaatccaaaaaccttattataggcactgtgattttactatggctggttttgccgatgcactgaggccggataaattcaccggtgcattttaagagatggcagatcagagtcactctgtggctgacagctatgaaatgcttctgggtgagtactggcaaacctgaaggagttcttactgctgaacagcagaagcaattcgaggaagccactactctctttgtgggatgcattcttagcgttcttggcgatcatctggtcgaggtgtatatgcatatgaccgacgctaaggagttgtgggatgcactgaatactaaattcggtgctactgatgctagcaatgatctgtatatcatggagcaatttcatgactacaagatggctgacaaccgttctatagtcgaacaggctcatgatatacaaaccatggctaaggaactcgaactccttaagtgtgtcttacccgacaaatttgtggtcgggtgtattattgcgaaactacctccatcttggagaagtttcggtactgcactcaaacacaagagacaggaatactccgttgaggggttgatagcgtctcttgatgttgaggagaaagctcgggaaaaagatgctgcgtctaagggcgatggtggccagtccagtgccaatgttgtgcacaaggcccagaacaagagcaaggggaaatacaaagctcagcagaccaccaacttcaagaagcagaagaagaacaacaataatcctaatcaggatgagaggacttgctttgtgtgtggtcaacctggtcatctggctaggaagtgtccacagcgcaaggggatgaaggcacctgcagggcagatttctaagtctgctaatgtgaccattggcaacactggagatggaagcgggtatggtaatttacctactgttttttcagttaatcagtctactaattggtgggttgatactggggccaatgtacatgtttgtgctgatatctcattgttttcttcttattaggtcgcacggggttccaccgtcctaatgaggaatgggtcacatgcttctgttcatggtgttggcatggtagatctgaagtttacttcgggaaagatcgtgcagctgaagaacgtgcagcatgtcccttctatcgacaggaatcttgttagtggctcccgtctgactagagacggatttaagttggtttttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactgcagcgggaacaccactgcacaggcatcctagacggcacggacgaagcctacttctcggggaaaccttcatctgacataaactcatcctctggggttgggaaaaggagagcaagactgagtactacccactgtactcagcaagtcatcccggaataggggtatgatgcagggaattaacaaagaagagctagagtggttcatttgcataaatactggcatttataaacaggaattgaatacgaaaacggttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcgcggctattcgaatagctttactctgatcagaggtgtacaactgtacccacaagacacagccccacgacacgtttccgtgcgccgacatgccaccacgacatcccggaaagaggctgtgacaggaccattcgcataaccccctctaaccaagcacaccacacctcaggtttcacccccactccttgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataag

SEQ ID NO: 74657 - DNA, 7673 bp, Oryza sativa
ttaaagatagcgatctttagttccggaatcttagtcccgctttgcaacccgggattaaagggggttgcaaaccggggttaaagagggtttccgcagcagtgacatgactagtatataggggtaaaaatggagcagattcggatggatagtggtcataccatatcctaaaccatattttctaaacggattcagagcggctgagcggattgtttcagatgttggaaatggtgcggactcggttcagaaacggattaaatttgttggatgttatgtgtgtatgcaagcaatataccatcgagttaacaatgcaagggacaacaatgcaacaatcaatgaacgacccattgtaataattatgtgcttaagtactaaacaaacatcatgaatacatgatatccataatataaaaatatagctaagcaagtgtgagatagacggtgaaagcctcggactaaggaatctaggttaattgatgaattgggccattagatgtgctagctcatgttatatgtaacagattgagtggttgcatgggttgataattttggattatccaacaaacgacttataggataatttgacagaaatgtcggataatctgcatccgccagattttagagagaccatattcgctagatttttagaaacccataccatatccttctttcggacggatttggaatggagcagagtggataatatccgatctgttttcacccctactagcgtatccagtgataattatttgaaaccagagaaaatacaacactgggccatctttgtagcacaggtgttaaaagataaattatgttgagaacacgaatatgaattttgtttgaagatacattaataggaattagatactgaaggttgagaaacatgtatactccccaatcagccaagaattcttcagggcgaatctttaggccctgctgccatgcatgcatatatcaataccatttgcatcagtaatctggtccataacatttttgtctgctttacatttgttgtctacttttcttgtccagctctgactgcaagattgactgctgaggctgagcacccaagagttgttgttggtgagatcagtgatcctcatgtgccaagtggttcacaccaacaacagagctcttacatggacaaactgcagcagctgcttacacagaggcaaccatcacaaacccaacaaaatcagccacaataatatgtggaacttttagggtgatttctcattagagacttttgaaaggcttattgattttttttttgctaaatgttgagtaatacatgtgtggagactttcaatgtacaactagaagataccccgtgcgttgctgcaggattacagaaggtttattcagaaaaagaagtatagtttataaactatattcagttattcaccagcaagaagtgtgttaccttcagtattttaggttcagaattaggcttgattggaaaacggaaatctaacatagcctacatttcatagtagaaaacgatcatgccaataaggaccaggccagtattcccatgtgtggaatttgttcttggtcaacacaaacaaaaaactctacactggaagacaaggacagtggcaaggtatcctctatactacttctattatttgtctgcagacaagatcatcaaattgcgcacatccccatagttgatagttgcgtaccttagaaaatcaaacttcgcagaaagtggatcatcaaagtctttaacatggccggttttatttgtatgcatagagaaaagttcaggcatgcaatcaatgctaatttttgcaaggaatcactatatacaattactaccaagaaaatttaaacattatttacccattattcacgcaccaagctagggacaaagaaagccagttgggatcactacgggtcccacaccgcagtgttagtggcaggcgtcatcacacagaggaacaataaacaagtgtaccgtttgagagtcaaaacagagaaaatttggcatattacccgttttctctctccgtatttaccctcttactacgccgtcccatcaaagggtagttggcttgccttgttgtcgaacccgagaaaggcaacatggggcagcgagagaagtgacgggtggcagaaagtgtgatgatggctgtaaaggtgaagaaagttaaggatagaagaaagcacagaagagttgagacatacatgataaacatctaagaagaaagagaagatcgtagagacgtatatctccaaagaagaatagggacacgtgcccagctcgtagccgtccgtaggccggttgcctgagaggtgataggtggcaagccacctcgggtggagtaggcctagcataagtagttgggcattgatgtgtggcagtgtgatcagctcaggaccatccaccgcctcactcccagcaggtgacaaatggcggcccttgaggtcatcgccgttatcaacccgattacgtactagacatggcatttgttaccctccaagccataggcaggggagagcttaggaggccccgtgcactgacctctaacctatacgacatgctaaggagagtagagttgcaactatggtatatgaaatcgtcatgattaattgtttgcagtgtccctattgcttgtctctctagaagtccattaagctttggagagtatataagcaggagggggttccccagtgtgggggtggaaaaattttcaaaggatccaagacacatcggagttggagtgtgagttgtacatttttttgcttgatattccaaaaagggcagcagtagggtcatttcggattaggtcatatccctaaacccaccaagaaacaccgggttcgctggatttggttctgttgggcatcgcccgtcaacaccatgtaaaaaaataaggcatgccacacataaactagatggagaaattgatggatgcacaaaacagatacatagatacaatgtttgcaaaggaacgtgcgatgtggaaaataagccaaaatcgccaaagaaaaagagcatacaaaaccaaacgttttatagggagtgcaccgaaataataaaaactttgaactatcaaataggatattatcatgatagtcacatcgttgggagattcatacacatgttacatatacaatcatcatgaaaggtcaaggcataataagctaagaagttacaaaactcataatgtatagcaaatgatactacctgtatcaacagggtccaaacagacacttcttccagaattgttttctgaaagtaattatcttttctactctattcataaccgaaaatcatttatagcctttttgggacctaacccgatagagtagtaatgttctacataatctttgactagtgtttctctatacaaagcaggactatcatcggacagtagctccttgatcgggccgaacatccttgttgacgctagattgttgggaaaacacgcgatggatactcttggccttgaactttgtgccaccaccctatgttccacgcttctgaacttgtcatttgagattatctggacattggttatatatattcagaaatgaaatgacgcacatgcgttttgtgggttatcaaaaatatatgtccaacaatataaggtaaatcaagttgagttttcatgttctctcaaaataaaaaaatgttgatatttttatgtccattatgtgttgtgaagattcttgttacaaaaccgacccaaaatcaccatcgataaccaaacgtggaagagacaccattggagatccaacttccaaggacattgaggcataatatttgttaacgaggttccgctgaagcctgtgtccctgggacacggattacggtagatccccggccgaacaccaccggaagccattccctctcgcctatgctaagtcatcatacggttacaataggcatgcctctctaactaagagagcctaggatagagtctgactcttattttattcctatacctagtacaacttcaagtgctaaactgtaaccgactttgtacacatattcgaccgtaactgacaattatgaacatgatacctgtaagaggccgcctaaattcattgtgttatgtggattctaaacatgataccagcaagagacaccctaatttcattatgtgttgtggattatggcaatgatatctgcttgattcattgtatttttgtggattctgaacatgatatatgaaaaacactgtttaatttcattatgtgttttatgaacactgaacatgatactgttaacagtgaaatttggtaatcggcaaagacgtcatcggcttagaatcagtatcggctgcagcatctcggaattagccgattggagttatcaagtcgccaatagtcggattcttgctatattcggttaaggaaatcaatctactaaaggaagcttatccctaagtgaccgagtttaaagaggatgtggcatggcagtttatctattaattaggaatagtttgttagtttccttttatctttaggaaagtgtgtttagtgtccgataaggactttatattttccttttatctttaggttagtttctttcttgtccgacaaggacttgtatcaacccatgggtataaatatgtacagccggggtctatgtaatctatcgctacgatcaatacaattcggcgcatcaccagtcctccacaacaaccggtgggtcgatatcacgccattacctggagcattcatcatcaatataggcgatctcatgcaggtacctgttgacgaaaaaatcaaacacaccggcctaggagatcttcttagctccagtgcaggtccaaatatgatgagatgcgggcatgctagtcagtttgatcctgcaactgacaagatatgcaaatagtagatcaaaacagtcaatcggctgacaagccgatggagtagttccagccgatagccgataatagccgatgccgataccagccgatagcgatagggtttaagcaatcggctatctgtccaatgtagataatgatataaaggcaatcggctgatgatgatgtaataaaataacaatataatccaatataagccaatcggctagcaatgatatgataaataagcatcgatccgaaggttaaagcacacatcggctggaggtccgatgtcatgaaatccacaagattagattaaacaatgaaacctttgttgtcatcggctaaatccaacttatatgtatatgcaatcctcatgaaccgatgcaacgtccagataactcaacggctgaaaccccgatgaaacccttattggcaatcaataagcaggctagagattatggttctaagcacgacttagtagatcaaacttaactggtgcagtactaagtatgaaaagaaacataatatctagacaatgaagctgttgactgagttttcagggtggtagatgtgtagctaatctaatctagcaatgcgatttagcctataccggtagaaaccctaaaacgagaagcagccgatagagctaaattgatatgctaagactagattaacagagacatatgataaataggtaggcaaatatatcatccaaaccagagcaatccaagaggccgaatgtactgatgcagccttgaacgacgccgacgtagacaatacaattgcctgggccggcggaacattgaacttaccccttagccggagatcgaacaccgatgcagccccgcgtcaggtgccaagtcccgccggaacgtaaaaacaaaagtagtaaaggtaaaaggtggcgatgcgccgaattgtattgatcgtagcgatagattacatagactccggctgtccctatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaatccgactattggcgatttgataactcccatcggctgattccgagatgctgcagccgataatgattctaagccgatgacgtctttgctgattaccaaatttcactgttaacacacacgtagtgatatatccggaatttcagaattttagaaatgggtagttcaacttacatactccctccgtttcagaattttagaaaaattcttacattcatattgatgttaatgaatctagatagatgaatgtagaaaatgctaaaatgacttacattgtgaaacggaggaagtacttttttaaaccgcaaatatagcaaggaccaaatgtgcatcatgatatattaataatggagttttttttctctttccaagagtaatgtttagctatgtatttttttatggtccccggaccactaggaccaccctttggacacatctatcagcacacgtgtttcttttacaaaattaaccatagtgatgagcatcagagattaagaggactgaattttgtactacagtttatgaaaccttgacagacagtcaaataagcttggctcacaaaacttaaaactgatgtgccataacaggaattttgagtacccattttcagatgaacaatatacacatgctttagtagtaatggtcattggattcttgcgattccagtcagtccaggctaattgtggaacaattgagtagtaaaagttatgcaaaatatatggaactcttctactattcttcaaaaaagcaaacgttatttacagccacagatttactggtactaaaaaaataaaaagaatgggggaaaaaaggaaaagaaaagagcggctctcaccggcagtattccggcaggtcaccggcgggcggcgggtcgggtgccatacggaggtagagcatgtcgcgccagttggccgccggcgactggtacaggtcgaagttgcagttgtacttggcggccctcgccgggtcacgcgagtagagccgcgccttgtcgctgccctcgctgccgcgaccgcggcgccggccacctccgccggtacgccgtggcccgtcacctagaggaatgcccactccaccgcggcgcgccggatggtcacgaccactgcctccctgtccccgcccgtgccaccgaggtcaaccaccgggatggacggtggaagcggcggcgattcttggctgctgctcggcggcggcggcggtggttcggggtccgggacgcggaagatgctggggacggcggtgacgcccgaggcgacgaggccgtggactccggacaaggtggcgttgagcgcgcggtgctcggcttcgcggtcgtaggtggcagacatggtgaaaggcttggaggggagcgtggaatcgccgcggcgagacgagaattcaagcggtaggaagaacgcactgacggttggttgagagggagaaaaaggacaatatgctatgccactcttttcgtgtggtttcgacgaaatatcacccattagaatggcaatgataaaatgccacttaataggttatttttaggatattttgccactttaaaaagttttaagaccagaatacctctgctatggacagagaggaatgtgagcgcctgggagaaggctgagctagtgctcgccggtggcgggcggcgagcacgcgggggcggactgcgatgtgc

SEQ ID NO: 74658 - DNA, 585 bp, Oryza sativa
atatgatcctaagcgtatgtttagttcaagggataggatgggtcgggttgggttgattctattttttaggtatttagtttggaggtagatgggattgcacaaagatccaaattgaccttgtctcttaaaaactgaccaaccaatccaaatcacatttctcactagctgacatgtgggccatcccttaagaagtagtaccacgacacaactatagatccagacatccgtgacaagctaatgctactcgttggagatgactcatctctaacaggtcgaaaagtatcacattttaggtatggttatagggataacccaccatagatacaaggtcatttgtgacgggtcacagttgtaacatgtcacatatgacctataacgggtcacaatcatgccccatgaaagataaaggtcatctgtgatgggtgtaatgagatggcccataacagatgagtagtcctaacttccacccatcactaataacattatttgtgattcacacataacaagtctctcaagtttctgcatggccgtggtaaaatcataaacttctggctagtgatgtgtgaggaatgatatagtaatatt

SEQ ID NO: 74659 - DNA, 1493 bp, Oryza sativa
cggactgcgatgtgcggaggagggtggcggctccgaagggggaggacgactgggcgacgaggtggaggtgggtagcggcggagacgacgcatcacaaggaggagccgacgacgtgtagggcggcatcgacggtggaaggaggatggcggcgctcgcaacttgcagcatgtgtgcgcgctcgccgcctccaacgacaacggcagaggaggatagagcgggcaacaccccgtccaccttgtcacccatcttcatcccagcgtggacaccaccatcgtgctgccccgtcgccgttggcaaccctcccccgcgtgctcgcaggccgcaaccgcgctccctcgcatgctcatggcctgccgccggcgagcactggctgccgctcccctctctcccttcctctctatcaacaataggggtattatggtcttaaaacttctcaaagtggcaaaatatcctaaagacaacctattgaatggcattttatccttaccattctaatgggtggcattttaccgaaacctcatgaaaagagtggtataatgtcctttttctaaccgagagggaggaaaatggagtttgactaactgttagagtgttgaaggttgcgttcgctagcttgattggtgatctgaccatggcatcgaagacgcgagcgttccgctccttccaaaccatgcatccaagttatcgaaatgatactgaaggactatgttggttagtaggctgaactatgaaagcttaaaacactgcttgattaagtctcccagagcttgctgggtgtagggacatcgcatgaatagatgcagacaggtcactggcaacaaggtgcacaatggacacgatagttggcttaccagccgagctggttgacgttgtccgatgtcaagcagctttctctggtcgtcaagtacatgaagaactttcagctgtctaaactttttgccttccatacgattttgccgcaagatgcatgccaatgttttgccaatgaagagtattggcaagaaagcaagattccaccgtagggtccttatcatgctgtaaggctatccacggcctctattgttgtgtgtggcgccactatacacatcgcattcgccggtgtgtgagtgtggtgttgcgttgtagtgctgtgcatgcgtgcatatctaccttgtaatcaaattttaagtcaacttgtggttttagatgtcaaaatttcagttttgttttcgacaatgtcaggtagttccagtcctacacatgtgcaacttgctttgtgagagcgggcaatgcaacgaggctgagtgagaagagccgtaccatgattggattaaggtgaaataaatagctatatttgtggtgtcatatttttttttattaaaaacagttaaactttttacaatacaaattacatacatttacaaggtatttatgttataaaatttaagactgtatttttcaaaaattttctactgcacattatataagagaattaggataaaaccattgattac

SEQ ID NO: 74660 - DNA, 11430 bp, Oryza sativa
cataggccctgaattgcctacatacataatcagtttaggacatttatcaacagcagataactaaaaatccttaaacagaaacacaaataaaaaaactaaatgtgaataataaaaatgtgctaatgataatagtacttactagattcagttgtcccgctagcagaaccttcattcatctaaagcagttccatttgttggagcctatgaagatcattgaaaatgattagttgaattgtacttggagcctattacaaagcttcttcatgcaacttactttttgctcagtatcctccatagtttcactctgtttactctcactttttacatccactgtctccagtgaagattgaagttccttttgctgcaactcttcaggagaaacgtcaacaaaggctgcaaacattttgttacaataacatgagatatgcatgacaaaagtatgaagaaaacataagattagacactaatcacaagctccatcccctattcactgatagttggagaagaattctcagagataaacggccaataccaaatttcttctttggctgttcagccacatcagcctcttccaaagttccagttgcttccactttagtagctgaaacatcgacagttgcagattgaggagaggtatctttccttggttgtgagtatgggtaactgctaggagctgcaggagctgcctgtggtggcatggcaaatgggaaaggcgagtttgagccaaaagtgtttggcggtgcctgggtcatcattgacttgaatgcttgttgcattgcatatttctgcatcagaattagcaatgtgtcaaaactggcaagcaagggagagttatacgattttaagttccaacaagacattatacagatcaaacctacaaagagaacattgtattaattaaatcagtgcaacaatggatacatcacgatatactttcgagaaaagaagtggtgcaacaatgttaactctctagtaattaaaagaactagtggaagtgatgatgctgtatcatcctcactttggatcttttatgggtgaatttatgtatacatgtgtgttacttataggttttttttgtaaaatattgcactattttacatgccaatattttgaagctgggtgaggtgatatgatcatattttacatgcagaatttacattagaggacttcctttagtcttttatatataaaaaaatttgatcttagtgagtactccctccggctccataattcttgatgttttggacaatgacacggtcttcaaaatatatctttgactatgtttttctattataatatataataaatatatatatttttacttttattattgtactttataagacaaatctaaatatgctgttctagtacctttaaactaaatatttttaaagttattggtagtcaaagttataaaaatttgacctcaaccttgtccaaaacgtcaagaattatggaatcggagggagtacaccaaattgttttgacatccatcacaatgcatggatattatgctattttatcaatattgaaaagaactagaaattatgtgataagaaaatgaattgtctaacaaaactacaatactccctctgtactcgtaaaggaagtcgttctggacagcgacacggtctccaaaacacaactttgacttcttgtttctataaaaatatttattgaaaagtgatatatgtatacttttatgaaagtatttttcaagacaaatctattcatataatttttacattttcaaactcaacaacttgagagttattcatgatttatattcccaaggtttgacttaaacattgtcctaacatcttcctttacgagtacggagggagtacactgcaacagtaccacctttgctagaacatatgccatgcattgcttcaaactattaagaactagaaaggaaggcatggctcacatgtgggtatgtaggttcatcacaaaaaaagctcactaaaatacctctcttgcttatgtactagtatgcagaggtgaccatgggtcattctcaagatcaagtatgcaattgatagggtacataccatttgaagatgtagaaacagaggaaagttgtgaactcacctttaccatcgaagagacctgatataacagccaacaccaagtattaaaatacaactctaagaacatttaatcacaaaaaagcattacaggtaattgtattcacaccatagaaaatgctgcggacaatgctacaccaactccaatccagaaaacaggcgaaccgctgcacaaaggatttacatgtcatcatgcagtgtaagttgagaaaattgtagccagacaaaagaagggaaactggcgcacatgtatgacgatgggggtggcatgggaggtagggaacccgttccagttgacatattctcactgttggtcgaagacgacatgcttgcaaatccatttgtctttaatccctcgaaacctgttgttacaactaaacaatcagaataatggagatcctccggcagcataagattaaaatgggggaaatcctaagctgattgggattgtctattcgtcggctattactacaaacaaggacagatatgctgaccattttgtactcatcatttgccacactaccaatactggataaggtggccattactaactcaccaactgccaccatactacgaaaataaagacagtattccatcacggatgcatgacttaaggtcactaaattcgcaaggataacacactcaattccactaacgaagcccatggcacagcgatggatccagctgatacacagagtataataaaattcctgacaatcccacaaaaaaaaacactatagcacggacacttgaagcgagcgcatacgagagctttcagcgcgcacctacccaaagagcgcatccggctcgcatctaacgaacaaacctaaaacggaagcacacccacacagaagcacaccacccccctcaccgttcccggacccgcgggccgcggcggcggcggcggcgacgacgacgagcttggacctcccagctcccctccgcccggacgccgcagccgtcgccgggagagtctgcgaggaggggcggcggcggcgggccgcggagaggggaggcaggcggggagaagcggagcaggaggaggcgaggaccaggctctccatgccgcctgctgcgcgcgcggggggagggaaaaccctagcttagctctactgctgctgctactacaactaccaccccctcgcccctccccactcgcgctagggttttgggtgggtgggtgcgcgcgtgagtcgacgagagacctcgggctcgtgttgtgtaggctacgttcccccttttacccctgcggtgagtgataggaagctgaaacggaggggagtcatcgccttccgctgcgtggggctagtatccatcgctatcgggacattcagagtttcagactgtcagcggctcatttcaggcactaattgcagacagcaacatttaaccactgatgaaaaaaaataatactactactaattaagatgcgatgtttcaaaattcgaatatctcaaaatgcaattcgggccagttcaaaaaatgaaaagggaaatccagtaaagtcgaataaacaacttttatgccttgttattaactgacaaagttcaatgttttggttctgaatttgagagaagagagaaaattaaagtaatcccgttcaccatggaatggagtgtaactagtagtagtaatttgtgccattgcagaaatcatatcgcgttcaatcactcaagttacaaaagtacaacggtatacatgaatgagaacatatgcatacaaccttcagttcactgtgctaagttatttcccatcttacagcagaacaaatgttcagaaaagccgaacgagatattctaacgttgaagggttgcctgcacatatattttgatcaagcaaggtagagcatcatgcagatcaaaccaaggggattatctcctggaaatgctagaagggtgaaaccatccatcattttacagtcttcccgaaacctcaaacaagaatatgatgaccttagcctataagaaaaaactcggtgagtatctctgcctcgtacttcatatctgctgcgctttggctttcttccgcgccagagctctttctctggcagcagcaagtgcatcagcatttctcttatagtgttcatccgtgatctgtgctggttgagtattctgtggattctgggtctgaggagctggttgggtattttctggtgtctgggtctgaggagcatccaaggaaacatctgcatttttctcggtagatctagcagcagctgaatcccttgattgagttgtagcaggttcttccacacttctactttcattggccgtctctgctccttcaccggagtcccttttgtgcttaggagagcgatcggatacttcagcaccaaccttgctagttttagcatcttgaactttctcgtctaacttttcaggtttagcatgttttgtattgtcatgtgtctgtgcaccgaaagcaacattcttactaagaccaaagtaaaaatcactcaagtctttcttcttagtaacctgtacaaaaatagacgaaggaaacgtaatcagttacagtgagccaaaagaattttttgttgtgaaccattagaagtaattttatcttagcaaatactccctctatcccataatataaggcgcggtcaaagttggcacggtcttcaaaacgaatgtttagcttataatttctcatataccataaggtttgtagtaacaaaattataaccatatgaatgtaaatttaaatctcgatctaatggtataatttttaacaaataaaattcattttatattatactaagtgttggtcaaatgtttgaaatgttgaaacttcaaatgcatgcgcgccttatattatgagatggagggagtatctgatttggagataaacaaaactattgcattaatttggtgatcaacaaacatatttcagattcccgaaaggttgcttgtgtaagcagcaaccagaagatagtgtttttcgtaaccagcaaaaagcaaagtgaagacagtcctttaaaaagaatgctaaaaacatataaaaaaaggtaggtttacaattttgcatagcaatataacataaaaataagtgaaaaggtcctctcttttctctctcgtactcttctagcaagacagatggggcatgcagcacactagtgtgaatttgaagattgtgaactcaaactaaagagtttgactataaacattacaacaattcaattaatatcaagtttaatgcataattttgttatgaccaacctcacaagagacaacacaagaagcattggtagaaataaattatggagataaacatgcacataatcaagagtcatgaaaaaaaattgagaaaagcttacatcttccttttcttcttgaagctgccgccgcttctcttcctccagccatttccgctcctcctcaagtttcttcctgtaggcagatgtaacaaatttgtctttgtcaccatataggtggtcttccttactcctctctttttgaagcttcctctcataaataatgtcctgctctcgtttacgttgttcggctttctccttaagtgccgcaatgtattttgactgagagaagcatagcattcaaacgatgagtagccatttacatactctctgtgctagtgcacatttgggagaaccaaacaattccttgtaaaaatagcaaatcacaaacttgcactaccgacaatcaaccatgaaggtagatttcagttagccctgaagtatgctccaatatacatctagcaaacataccagctggcagctgctaatccccaaaaatgaaactccctatgctcaagcaacaactactgctttttttttatcaaacagcacaaaatctctaagcttcagcaacaaaagtaaaacccgactgcctcacatccatcattaaatcagtaccacgaggggaaataatacaaccccttcactaaaaattaataatgtatactctttggaacatcccggtgaccataaacaaagcaccaagagaattaagtaatcaaatcagagggagacttacctcgcgaactaccctgtcctgcatcttggggagggcggccttctgcttcatgtcgtcataaacctcgtcgtaggcgaacaccgagggatcctcttccatcgccttcttctgctgctcttccaccttcagcacgcaacgcaaaccccaaacaagggtaataagtaagtcaatctactcgtgacccgcacggcccagccggcgacggtggaggggttggggggaggggattcgagctagttaccttctgctgggatcgcttcttgtacgactgccggaggatgtcggcctccacgtcatcgtcgccatcgtcggcgaaggccgccagggggcgggccggcggcggcggcggcgcccgcgacgacgaggacgccgccggcttcgtgcggagctgcagcccgtacctctgcatcgcggcggcggcgtccaggtggtgcgcggattcgacgcggagcaaaccctagtctcgggcaaggggaggaggcctcctgacgcggagaaatccctaggattcggcaagggggaggagacccgtgatgaggcgggcagcgagcgaaggaagcaggggcgacgagccggcgaccgacggcgacggcggtgagggtcgccggcggcgacctcgtccagcgactcgcgaggaagaggagcgaagggcccgagactccgagaggagttaacggcgaaatccagatgggtattttaggttggatccactgatactaaaatccagcgcgacccatacagcccacctccgcgaattgggctgcgataccagatttcgaggcccaatacatgagatacaaactggccccgtacgttttcgtgagattaaaatcccgaaaactatagcttaatgagcacactaatattgagatctttctttcctagctattgtcatatcgaatgcaatgaaaattttactgaactgcgagatagtaacaatttaaacacttgatagtgttgaatatatttggtttccaagcttaaacaaatttcggttgtgtttttaagagtagaagctttcaaaattaataattttcaacaggttagcattggcaatggtatgtagtttgaacactgctccctccgtttcacgatataagttattctagcatttctagcatttcttatattcatatagatgttatatatatctagattctttaacatctatataaatgtagaaaatgctagaatgacttacattgtgcaatgaaggtagtaccaaattttggtagtgttaaaagtagcaaaaactgaacaggccatagctccacaagaacaactgctcttttcctagcaggagaaaaatacattcagaaagaagagattaaggcacccaacgaattgttaacaatcacatttcatagaagcacgacaacttgctcaagattaaaacagcaagcacctttgatgctgtacatcatatcatcattcttaacaatacccccataattatctggtgaaacattaacaggaagacgcacaccatcaacatccacatgtcaaaacaataccacatcccgttactcagggggggcaggggcacaaaaccaaaatgagatgccactttgcactctagggtaacttctgttggtgaccacggtcgcagccgcctaaacagtggattctcataatctatcaactaattcacttttatttagcaaaccaggcagtctgataacttttttttatctcttttgtagatacatggcaccgctaacctgcgaacagaagtcagaaccagacctcttctttctctagagatatgtacacccatctctgattagttgaggtcgtgtatattctccaggggtctcagaaatatgtgaccactgtcacgagggtaatgatgccaacctaaatccttccattgctccagaatagcaaccttgggcccaaatcaagtctcacccaaagcaatcaagagctacctaaagtgggttatgttaattcactattgctgtgaatcaaatcatataagctcccttttcagctaaagctgagatttcgattgacaaatctgagattgcacttcatggaagcatatgatcgggggcattttgttaacagtacttcacaggatcaagctgcaaaatccagaactccacaacttgcaatatttgttttgatgagtatctgcaaaagagcaaataaattagcgtgtatttggtgacacacttctagtaattctttttcttgtggtgcatgtgttttgataaccaaagaccaaaacaaaatttctggaccacaaatagtttaccatcattggacaagatcacgtcgccgagcttgatttttgaacccacacttgcctctacatataacattcatatattataagaaatctagtgaataaaaatcatttcacgcaaaacataggcccttgaaatgtcaaaggcagaataaaaaactatattctgatcacacctcatgagcaccatattggcagaggctctctttgaaggctttccatcagatgtgcttgcagaaatttccatctccttcagaccacgtggaggaccacggcggttagcatgtctatgtcctgaattgaagattgacagtattaaccatagtacagaaaatgatctggagaacagtttgcatcatttttcatggtcataattgcaacaactaaatatacaaaccattttccacagggcctccgcgaataccaccatgaccccttgggtctatttttctctctccatggcctgctttgcatcatcaagtcacataattaataatagggtgaataaccaacatgatccttgaactttcacttaaggatcaatttagtccttgacatttcatattggccaaaataagtccccaaactttatagtgtgatttaatataatccttggacccataaaaatgccacgtgtacatgccacatcacatgtgcatgcaaattcaacatttaaaatgtccattctacccttatacattctccataggaaataaataaaaagaattaagaaaaagatgttgcattggtaactaaagaatgtgtcatttttcttttgttttaagattgctttcttcatgttttccttttttttttcttttttctatagaaaatgtaagggtaaaatggatatttaattgttgactgtacatgcatgaatgatgtggcatgtccatgtggcgttttaagccacatgataatctttagggatttgtttggacaacgtaaaacatcaaggactaatttgacccatgagcaaaagtttaaggactgaattggctattcaccctcaataatacaataactcaagaactcaaatgaacagtactaaaatcgcttcaaaaggaatcttaccatctgcttgctgacagaaattttcaccagaatgttgctgcattggtgagaactcagatgacgaggaatgcgtcccacctgatgcagatttgtcatagcgacgaggggcccatacaccacgatcaggcctatctctatttctagcatgtctttcagtcttttcactgatgagcccagaaccatggagatgactatgtttgtcatccaaatggtttttctcagcattttcaactacctgatctttaacaacggaacgtgggtttggaatccgtggtgggcgcttctcagctgtaattatgtgaccttcctgatcatgttgagacgtaaccacatgccgtccttccttgtttgaaagtatagtcttaataattctgccactgccctcaagccgcggatcttgcctagaactagattgtgcagcatttttcataggggtccctgactgctgctgagatgtgacatcagatgtctggaaaaaacatatcaaatgacagtcagtacagttaccaacaaaatggtcaaactattcgtggagcttatatacttacattagaatcgacccttgctcttcctttcaaaagcacaattttctcttttttgttttccgcgacatgagcagaaccagaaatcccgccacttgtagcatctacgagacaattgaacgaaacagcaatattaacaactaaaaaggaactttcatcaagacatatgggcagaaagtgcaaaaatagcatacatcaacaatttacaaattggaaggatagaggctaacagaagacgacaagaataatactatacacttcttggaaaggtaactgactaatagaactccatgcaaagacaaaatgatggaagttcaaaatgaaatccattttctataggataggacattgacgtagtgtagcaaaagtagatgtcacccaacaaggtacgccattgccataattggatggcaggtagccatacaaatgtccacaggcctatctcaacacaatagctattatgccaaataagtaaacaagcccaaactaaacttgtctatgttgatggtgcttttagcattgcagtggttttagtttttgttttggaatagtcataaaaacaactaagatttaacctatttacttaaattgtacaggtttcatatagctagatttcaccatgcaacacagcataataagatcaacttgatcttgcctcagttctcacagaattgaatcaatcagtgtcatcaccctattacctaactcagctcaaactatacattagttgatacaaccttttatcagcatatataggcatggatatgttatagcagagaacagatacttagtaataatcaataaaataaaaggacatgttgatatgaatggttacaacaaagttatagtgattatctatttcttgaatcagtaccacctgaagttccagcagtacctttttccctctgcgcatgctcgtctctctttggcactaagatataagttggcttctccttagcattctctcgtagaacatattgctgaagatcacatgaaaaaaagacaaaaacagtagcttgtcataacctcatggcatagtttttgtgcggaatgaactgggtactttttataacaatgcagcatgaaacccaaaataaccaaactgagacacagtgcactgttcaaaggttgaaaaagaatagatgaaaactcacaacaatagcccagaaataaaatatactccctgcatttcatattataagttgtttaactttttccttagtcaaacttctttagaaaaatataatgatatttttaacacaaaacaaacatattatcaaaatatattcaatgctagatttaatgaatctaatttgatattttagatgttaaatttttctataaacttggtcaaacttaacaaagtttgactagaaaaaagtcaaaacgacttataagatgaaacagagggagtataaaacatataagagcatacaatacacaaacagtagcacaaacagaaatgcacactggggacagga

SEQ ID NO: 74661 - DNA, 4911 bp, Oryza sativa
taagactactgaaacagggaacaaaaccatttttaatggattctacacatttttcttgatttactgagacttgaatgggataaacggagctcggatgaattagttatgaattttagaagattcactgtgtttattactataaccataatccttaaatactttattgcgcaataaattccagggctgacgtcagcacaggtggcgcggcgccgacatgcggggcccaccggtcagcgacacggggaggagagaggaggcgtcggcccgcgggcccaccggtcagcggcacgggaggggaaagaaggggcggcggcacccggcgcgaaccggctcaaggccggccgaccgaccgcggcgacggcgacggcgcgcgcgcgaacgggttgccggcgacggcaaccggcggcggaggcgacgcaaaagcggcggcagcggacggcggcaacgacccaaagcgacggttagcgcgggtggcggcgacgcacggggaaacggggaaggagaggagaggagatgcctcaccgagggtggccggcgcggaggaagacgatggcgaacggcgacggcaggccacgggaggcgacggcgaccggcggacgagcttcggcgtgccctaaggaaggagaagagagggattagagagagggagatagaccccggcgatcggaaaccatggccgaaggcggcggtggagatggcgctcacccgtgcgcgtggggatgagggctccggcgacgaacctcgacggaggaggggtggacgaggtggacctcggccgcgcgaagctaacggcgacgacggcgcaagacggcggcgagcctagcggcggctagtggcggccgaagtagcaaaaacggcggcggcgggtggttgcacggcgcgggagcgatggggagctcgggagaggtcggcgaaatggggaaaaagcgagagggggtgccggcgatgcttaaatagggggagagggaaccggacgtggccgggagcggcgggaatcgccggccgacgcgggggagtggggagaagagagaggcgggattcggttttcgaatcccggccatctcgggcgcgggcgcgagcgggagagagaggggaatgggcgcgggagacgcggcgcacgcgcgggcgtggtcgacgtggcccgaggaaggcggagacgtgggcgcggcgacggttgcgggcgcggcggcgcgccggaatcggcgggaggagggagacgggtccgacaggtgggccccacctgtcggcgaccccgagagaggaggcagcggggcggcctggctgccggctgggcctcggcctgcggccggcccaacagagaggagggggaggaaaaggagaaatgggccgacggcccatttgacaaaaaggaggaaaaagagaggaaaaagaaaaagaaaaaggaaaaaggattttctctggaataaaatattgcttgctcaattttaattggttgaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgtaaattacgattttggcttgggaggaaaacttcggggtgtgacagtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtttcggctttccagcatgtgtttaattcctaagttttccattgtcaaaggttctaagtgccatagttgtgtgcaatcgaagcaacctcgcaagcctcacaaagctgccgaggaaagaaacttggcaccactagaactcctacattcagatctttgtgaaatgaaatgggtgttgacaaagggtggaaaacgatatttcatgactttgattgatgatgctactagattttgctatgtgtacttgttgaaaacgaaagacgaggctctagactattttaaaatttataaggcagaagttgaaaatcaacttgacagaaagataaaaagacttaggtccgatcgtggtggagagtttttctcaaacgagtttgacttattctgtgaagaacatggcttcatacatgagaggacgcctccctattctcccgagtctaatgggattgctgaaaggaagaaccgcacactgactgacttggtgaatgccatgttggacactgcgggactacctaaggcgtggtgaggggaggcattgttgatctcgaatcatgtgttaaacagagttcctaacagaaataaggacgaaaccccatatgagatatggattgggagaaaaccatcactttcttatttgcgcacatgggggtgcttggcgaaagtcaatgtaccagtaacgaagaagcgcaaactgggacctaagactgtggactgtgtctttctgggatatgctcatcacagcattgcctatagatttttaatagtcaaatctgaggtacctgacatgcatgttggtacaattatggagtctcgtgatgctaccttctttgaaagctttttcccaatgaaggatacacatagtagttcgagccaaccatctgaaataattcccggttcaatcacaccaccagaacaaactgaacatacacatgaacatgtcactaaggaggatgacagtgaagctcctcgaaggagtaagagacaaaggacggctaagtcctttggtgatgatttcactgtgtacctcgtggatgacactcctaagtcaatttcagaagcatatgcatctcctgatgcaaactactggaaggaggctgtccgtagtgaaatggattccattatcgctaacgggacttgggaggtgacagagcgaccctatgggtgtaaacctgtgggatgcaagtgggtgttcaagaagaagcttagacctgacggtactattgaaaagtacaaggctcggcttgtcgctaagggctacactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcagcctgatgggtttgtagttgaaggtcaagaaggcaaggtgtgcaaattgttgaagtctttgtatggtctgaaacaagctcctaagcaatggcatgagaaatttgacaagacattgacatctgcaggcttcgcagtcaatgaggcagataaatgtgtgtactatcgccatggtgggggtgagggagttattttatgcttgtatgttgatgacatactgatatttgggacaaaccttgaggtgataaatgaggttaaatcatttttgtctcaaaattttgatatgaaggatttgggagtagctgatgttatcttaaacattaagctaattagaggtgagaatgtgattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgcgcgcttgagcgagtaatgcgctatctgaaaggtactgtggaattggggcttcactatactgggtatcctgcagtactggagggttatagtgattctaactggatctctgatgtggatgagatcaaagccactagtggatatgtcttcacactgggtggtggtgctgtttcatgaagatcttgcaaacagaccattttgacgaggtcaactatggaagcagagctgacggcactggatactgctactgttgaggcagaatggctgcatgatctattaatggatctgcctattgttgaaaaaccggtgccggctatccttatgaactgtgacaatcaaacggtcattgtcaaagtgaatagttcgaaggataatatgaaatcgtctagacatgtgaaaagacgattgaagtttgtcaggaaattaagaaactctggagttataacgttggattacatccaaacagctagaaacctggcagatcccttcacgaagggactatcacgaaatgtgatagacaatgcatcgaaggagatgggtttgagacccatgtgagttatactatggtggtaacccagtctatgtgatcggagatcccgtgaattggaatctgggaagaacaaaccataagtaaattagaggagagtaccaatctataccctctctaagtgaagatgcatgtactctcgtgaactgcaaggcaggttgactatgccttaatgagttctgttggctttaattggcgaagatgctgtcctgcagagcattcttgaaagaactcacctttgtgagcttgattgttggtcgcagtctatggagattttgggtgaatcttctaggaagcttactaaagacctaggagtatgacttatacgctccacccgaggggtagtctacagacggtctagtaccagataagactctgagtgaaacttgcttgcacaagacttgcaattcaaggcttagtctattgttcaagttgtgagtaagtgtagcttggagttctaggtggatgttcacccttaatcggtctccatcgaact

SEQ ID NO: 74662 - DNA, 2165 bp, Oryza sativa
tgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccatgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaatggccaagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcttggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttccccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccacgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcagggggggtgtgcggcacaaccgcatgcttgaaaagatcgcctccaaggagctccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcg

SEQ ID NO: 74663 - DNA, 12641 bp, Oryza sativa
  unsure (1)..(12641): unsure at all n locations
gtggagtttagtacccccttacttattctaggaaagggagacctccttaaaagggaggatgccctcctagccacttgaagcatgtgtggtggagagaagagggggaacacacgcgcgcgctcgctcgcctggccctggcctggcagggcaggcggcgctcgtgcacgacgtacgcgtcgaatggtccgtcaaaattggttcctcaccttgcgcagatgcagtctcctttggcagttttgttttgctgcaaattcggattcgtttttgttttggaaacatttcgaaaaatccggtgcgtgcaaacggcgtggagtccggataagttacgcgcgacttatccggttcggttacgcgcagtggagatcgttcgggcgccctgatcaagcgacccttctctatataaaccgagccgccgccttcacgcaacacacgcgaaatcaatctagggtttgcctcctactctgtgctacgccgtcgctcgtaggttactccatcccgctcgctggcgtgcacctgcgatcgggagagcaggtctccgaaacctctgccttcgacgtcctgcaccgggagaaggcaacaataaggtttttgggaagcgctttgcacgactgctccctgttcgtccgcgacggctcgtcttcctcttcgctcgcgcgctgcgtgccttcgtagacgcctgcgaaaagtttcgaccgagcagccggtctttccgccacctcggtacgtgttcaatatgttgcgcagtttgatctgttcatgttatactgtgtagtttacatgtgtagatctaatgatgcgttcatgctatttttcatctgtaatgtcatgatctatttatggaatagattaaatcattatatgcttataatctcaacaacagatgcttaaatagaagaggctgtatctccatttgtattgtaatattttacaacactatgattctaccaaattgaaacgataccgatcccatctaatatttaaattagtttacatagtattttcatacggttctatggaatcttagatattacattgatttctatgatctttataatcctacaaaatattattaaaaataatatgaataaatatgcttaagtttacataaaactgattaatttttttaaaatcaatactatatactataatttatacacaacacacacacacacacacatatatatatatatatatatatatatatatatatatatatatatatatatataatataaaaataagtactttctaaaatttgttagtattccaatcctacttagcatctcgatacggattacctttggatggagtggagccaattgtccctgtgtcacgaaaattgaattgacgaaaaataccctccgtgtgagtgtgacgcaccttacatcccagcacagagggaggtggagagcacgaatctcagcgcatggcctgcaccaaacatgatactactcggtgcagcagttagtgggcccgcattgccattggctgcagggaccagcggagtgggtagcaacgacggacggcgcaacgtgtgggcacgcgacaccgcacagcaaaaaaaaagggtaaaatgtcgggtgcaggcacaaccccaagtaaccaccactgaccaaagggccccacgtaccatcctaccccacctgtcagcgtgcgtaccgggtacagaacccggtgcaaaaaagaacaaaccagggccgtttcacgctttaccagcctggcgcgtcgcgtccgtccacatgcccccgcactacccctcccctccacatggcgcgccacacccacgagaccaccacgtgcttgaccacatgggcccacctgtcattcactccaagatctccggcccgggtcacgcgcgcgcggccgcattgattaataagggggaggggaaaaaaatctcccgtgggccgctgcaggtgggctccacgttagctccgggcccacgtgtcatcggctatgtaataataatataatataataataataattgcagtatataggggggatatagtcgcggtcgcggggagccctaggcgagcgagggagaaagagagaggcgttggtcggtggccgcccgtcgcttctcctcttccgacgccggcgcggccgagagaaatggcggtggctgcgagggctccgctcggggtggtggcggtggtggccgtgctcgtcgtcggcatcttcatgcccgccgcggcgcaggccccggcgcccgcgcccgtcagcgacggtgaggatatcgttgcccgcctctctctctctctctctccctctccgaagccgcattgcgcgccggagttctcgtctgctccgtagcctagcgcattctggttctctggcaccgtgcggcggctgactggttccctggttgttccccagttgttcgtcgatccaccaaaggggaaatttaatgccctctcgttaagagtagatttaattttgttttttcgacctgcgcctgaaatgtagtacgcattaaccttttttttttcagcaccagcatctatagcttgcgttagatccctctttttctaattttagacgttattaataattctagtatagtagtattggaccgagcatatatttagtgctataaatcattcaaaatcttcggcagattcggatctctgttgtgacgtccttgaaatttcctttcaatttcagttccatttggcaatttctgcagcgcattacacgaattaaatgctatatgatgcaaataccatatctctgttgtagtgagacgtatactagaacgatctttttttgttttgttttccaattactagatgatgtccaggagtagttgatctattgggcgtgctggatagatccacagtttacctttttgttgcaagtggaggcaggcagcttacacttgcctgtcattttatactattattggtggttcccgttcctggagtagctttcagttgatattggttgccgcccctttacacgtctctgactgatgttacagtttgggtagcctgaaaatgaccacaatttctatcaaaatgtgccatctgtaacaactgattagtggaggtggcaggtattacaactttacaaggatgcgccatttgtattactgaacgccgcaaatggcttatctttgtttagttatgaccttgacatataatctgttttaacttcggtttattattacgagtcttggtaacaaaactgtaaacaagaacaacctgtgacattttatagtatatgcaagagacttaaagttccattttctacttttctaggcctcacagccaacaattctctatctttgtgatcaccttgtatgatatgcttgttatatctctctgttcgcacgaattgaattaaaaaagcaacgtggtaactgtgatatgccatttcctatcaacatagcttcactatttttttttgttatgaacctagttgcaatttgccacatgctgttggtttgctatctattcgataactttctccatatgctgttttgatttaccatgacactgatgtgcattttgctcctgtaattgctttccgcaggcacatcgatcgacctggggatcgcatacatcctgatgctggtggctcttgtgctcacctacctaatccatccactggatgcttcttctccctacaagcttttctaatcccttgttcttccttcatctggcttggttagggtaaattctacttattatttagccatggcgacgattgttaacattttaggtgagatgttaggaggtttggagtgatttgtctgtccatgatgggggtggtatcaatcagatcgttgtttggtggtgcgattggctgtattggattccatgatttggtgccaagttgtgcgtgctggattcgttcattttctgtttcttttttagctggcctgtgactggttggcatgtgctctctgacgtgcggtggttttgtccttgtgacaactattgcgcctgcttgcctgctctctgtgtgtgtgttggtgctcgtcagcactactgactcgatgacggtttcggtttctctgtgggccgatgcaaatggtcattgttgtttttattcccaccttgtcagtcaaaaaagtttcaaacgactttcttcctgtgaaatagtagaggtaggccttgtttagttctaaactttttctttaaacttccaacttttccatcacatcaaaacttttctacatatataaacttccaacttttccatcacatcattctaatttaatccaaacttttaattttggcgtgaaataaacactcccgtagtagtagtagtagtagtagtagagctgataagtatcccttccggtcataataataatcatttgatgacaagatttgagcgctttgtgtttttggtgacatctcggtttaaaagggagtaaatttaattgtggtagacctgatgaacctcaaattaagatgcatgccgcacggtatataatccggattgtgttaagacggacgtaatcctgtctgcaacataagggagagcaataaatgtgttgatggctcgagtttagtcatttttaacaagacttttgatgttgcatggatccaccgttgtttatatccgataattttagtgcctcgagtagtgagttaagttgatatgtgtaggtaacttgtgcacgaaagaggatgctttggatgatctgatctgaaatagtaagaaactacgaagatgcgtcaaaaaccacgcagcacctaaactgggttgggcctaattaggctgtactaagggtgtgttcggcaccccttttcccccttttgtcacgtgcatgtttttcaaactgctaaattgcgtgttttatttgcaaaaagtttctatatgaaaattgtttaaaaaaattaaattaatataggcaaaatatataaatagtagaattaatatttccttaatagagaacatatggaaaatgattttattatttccgtgctataaacacatctccatcatcacgcaacaaagtaagcctagcaatgctttagttttccttcaaggcactaaacgaacgtaagatcagggcatccaggaagtgcccatgcgtaaaaagttggtaaaagattattttaactcttatctggcataaaagtttagcattgacaccgctcaacaatttaaaccaagaacgccaacttagatcagatgcaatgcaatggtgacacagctcagcaggtcttgcacgctttaattctagacaaattgcagaccgtctctcaggaaaagaaattgcgtgtgtcgaatgcataaaaaaaaaggtagacttcccctacaaacaattcgcgctaaaattgattattgctgctatccaatctgaactatctatggagtattaggagttaaaatttggatattcgtagatgaataataaccaaccctgtctttccattctgttcagtaatagaataaaaaatgacaagagccttattttccctaaattctctgaaaaaagaagaaattctacctctttatataagatttaatgaaaattgagatgatcactccaatcctttagttatattcaatcttgtaatcttgtatacttaaatttcaatcctgtaaccctgaacaaaaataatatatatgctccaataaacatcttcaatttcaatccagtacattgccaagacaaagaatagcaaaagaattatagtgaaaatagcaggatttctgcactcccctgtgttatatgcctgacatatattgtggcattcgatcgtagcctagatcaatctgtcctacaggataaaaaaaatatcataatgcaaataaacaagagatgctagccagtatagtactgttttggtgctgcaaaatttccttggagcaaactgtatcctgctgcctgttcatgtccattggtactgccctgcaaaatcaattggaagcaagatctactgcaaaaagggaaatgtaattgcaggagaacagagattggccaactcacagcatggtttcttggtccttgattgggtacatcatattatcctccatcctctgattgaaccaaaacaaaaattcccactcaaatctaagaaacataaccacatatcaaccccaaatcaaatgaagtcccaaatccagctatacaagagcagcacaaatttgttggatctggagaactaacatttaagggcattgtgttggttttggagaagaaaaaattctggataatacacgtatgtgcaattgtagatatagcgatagcacctagccgtgaggtccacactcaccaggccgaccacagctccccctttatatggtcgtactgttctggtatgcatttagcaaaaacattttctgaattcctcataaaacagagaaatgtcaatctctggaccgtaggaccagagatggggaaccaaattcactgcaaattaaggaaccatctgtttaacttttcacatagataaaaagaaagtagataaactttatagaggttgttgaggaaatatcataaataaatccaaattaaaggtcaccatatctgacaaattaaagctacacttgaccatagacaaattaattaaccgggcttgctagaaaaatctgagattgatttggtagcaaactgcacaagagtgcaatgaacgcacgggcatacaagcacctagaggaatcgatttcagataggttcagttggcattataaaacaatatgcaaacacctgaacaagcacctagaggaaccaattttaaataatgcatggtatatataatacaagtgcttctgaccaccatattctagataatcatgacacattgttcagaaatgcttttgaccacagtttttcaggtctccactgatttaaaattcagaaatttattttgatggattattaggaaggaaagcagcaactaccaaaattcagtatagcattataggatccaatcaaacaaagtaaaaatacacaaaactcaacatgtataaatttgacaaaggataaactgaccttgcaataaattaagagcacctcaatttcataaactccttttgttatctcatagctcattgtaagcagatattaggtgcaaaagatgatacttacaaataaggatcttgtattgatcagttcaacaaccaaacttctatttatcactaatcaaaagtaggattgtactgcattgatctgaaaaaatatccgtcgcatgagtataaggaggtcaatagtgcagatgatgtgtagcatgactacaaagtttgccggaatgaccgaaggaggtcattcaatgtaattaagataggaagaaaaagttacaagaaaaatttacatcgatagctggctgtcgaggaaggatgtgcaccagagcacacgccccgaaccatgtgccaaccgtccgaacacacactacagagagggaagccaagcaccgaaccggccatcgctatgcgagaccgatcgccaccgagctaacgacaccactacgacacgaagactctaaaatgacgccctcacgagggtcgcgacgccaaaagacgccgtcgtcatctatccaaagactggacaaggttttcacccagagctccttgccgagggaggagggatacctcaacagtgccctcaagagggttactacgtccgaaggcgaagtcactgttggcccaaagaattgggctaagctttcgctcggaaccccctgcccccgtggtacattacccaatccgaattcaccatctgaacatcggcggcacatgggtttcggcacacccgaccgacgccccttcgtngggcggcttcatcgaaccaccattcctgagagctggcccaggacctcttcgtttcaccacccgccgggcttcttcgcagatctgggcgaaggagaatccgggattggatggcatttgttcagcagcctgagcttcccccgctgacgagctgccacctcaatccagcttagaaactccccacagagaaggggaggagctccaggaagggtgagggtgttgaccggcaacgaggaagacgacccaccgccgccagctcccttagcacaaccatctgggcctacgccgacgccggaaacattgccgctctggctccggcgccaccctccggcctcccattgcccggccaccgctccccacctggccaccacggcgtaatgctggcagtacttacagcttacttagaaaatgaatagacacatagacaaccaaatttgcctcacatgactcacctttgccgcactcaatgtatcagctctgagtcctttttgttcataagcgaggaaggaatcaataagggagtactgcaatgttaaacaaaccaacagatcaaatccctaagtaagaatgcacaatttcttaatataggaaatatatgttcaaatcccaaaatgtgagtcatgttctgtacaatcagtcatcaatttcagtaaggaaactatatttctcataggcatatggactcgattatgacataatttgactataaatgaacagaataaacttgcagggatgtgagcgcatgttacttgcatgtaaggaccttgtggatattgacctgcatcgatagttggattgtgctgcagtgaacaacaataagatgaatttcatgagcataaacgggaatataatattgaccaaatgtaaacctcactctaataacacaaatggtcccatttatacaaaagtctgcttgtttttatactcactgtttgtattccgatttaatatttcatgctatcattatgtcaggcaataacaagcatccgaactcatccaattgtagaagttatatcatatagatagtgcaattcagtttatattttatttataatggccacgatcaaaggataactcatcagctgaatgaaattgtcacaagagaaggtttccaatactcaccttggagagagcagatagcatgacaatcctgatggggaagggatgattttgatttggaataaatttagcacaatatctacctaaatgaaatgaaaccaaatcaacgagagagattcaaaagaaaataccgatgacatcctaactgcagcaaccaaatgcagtttgaatgttttcaccagtaagttcacaactcgggcactaccataatgagctggtttcaacttttcacaaaaaaaagattctgaaaaaaagaaggcgggttcatgagatatttgaccatatttattcaatagttgccgtcaacagtggaacatgcatgacataaataaatataccagtggtgcaggcattaattctcttaatactccaggttaatatcattggttctgaagcgatctaccagtggtgcatacatttattttcttaattctcaaggttaataccactggtccttccttaccacttgaggctttgacaatgccatcagtccatattctaaagatgatgaactacaacacaaaatggacagttctgtaatttaaaagtaccgaacaaaatctcattaagaaatatgtatcttgaaccaaaacattcagactgaagcacctcgtgtatttctccgggctaatgatgccagggtttaactaacaaaacataaaccagaacggagatcgtaaattattggctttttctaaatagcaacataatgatatcttgggttttttttctcactgaacaccttttgaatcaagaagaaggaacgcctgctggttttgaattgaaaatcctaaaatgcgttctctaattacattagatcagactaaaaacaaaatcataaacaacacaatctgctatccctactgacatggaagaagcactatacctttcatcatcctcaaaacctcaagctacaacaatcaaaatcgatgaacaacatcaagagtaaggacaaattagagaatcggaaggaagcagcagaggagtagagtagcagaggagggaagcagagaagggttagtcgggttcgtcacaatggaggagcagatgaggaaagaatactccctctgtttcacaatgtaagactttctagcactgctaacattcatatagatgctaataaatctagatattactatatatatatatatatatattcattagcatatatatgaatgtgggcaatactagaaagttacattgtgaaatggaggaagtaccattttataacaccaagccttcatcacgagccaatacaccactactccctccgttcaaaaaaaaaaaaaaaaactctatcctaggatatctagattcgttgtcctacgataggtcacgtcgtatcatatcctatgatatgtcacattctatcctaacttgggttttttttttttaacggagggagtacttattggcgatgcaatagccaacggctgtgcatgcagtcaagacctgcatatgatgccattgaactggtgtacggtcaacttgtggtgtaactctaaaggagaacgtgaggctacctatactgagaggcggaggcagtttctgcgcgtcgtgtgaggccatggctgtcataaggaagatgtgtgggagagaacccgggtccatggcgaagatcagagccggcacagccgccatcgccagggcagagctagagcgaaatggagggtggtgccatttgcttaatttactctactttagatcgagtttaagctgatgcgggtgcctaagtttgtattgaggggggtgcatgcatggtgaaaataggtgaggtatagctaaaaaattttcttgaccgggttcctgggcaccccctattacatagtagctccgcccctgaattatttgccaccagcagaagccaccatgagcagcgccaccaccaccagaagcagcagaaaccgtcgccattgaactctggatgctgagggagcgaccgtgaactccgagaccgagttatgtgctaaactatattgactaaatatggacaaaacttgcatcagtaggttttaaaacttaaataaaatcatctacatgcacctgaattcacatggagctgctggtagcaaaaaatagaaactcacatttcctaatggctgacatatatacttgatcctagcatgtttgacaattctcaagggttgaacacaaattcagtgactacaacagaaattcagaactcatgtgaatcctcctgaactcggatgcattttgatttttgaaatgtattgtcaaatttaatcatagcgttagcacggggagaactcatgtgagtactcctgactagaggaaaaaggaaatgcaggagtaatacattacaaatgtcatctcttgaggtgctaaactgtcagatatttttccagaacaaagcagtatgaacatgatattgtactgccagatatataaatttgaattcctcagattacctcatagcagcctagcatgtagccttagatttaataaatctccaattgcttcagctggaaccacaagttgaaactaaaatgcagaaaacaaacaagtcattataaataccctttattgacatgttcagatccactacaaaagaaattgatggtgagactatactatataaaatgtcatctcacagattatataccatgtgtatataaatttggtggtggtatataaaactaactgagaaatgaatcatatagaggtttggtggtgatatctaaaactaactgagaaatgaatcatctagaggtatagaacagaggcaattgagagccgtagatcttcctattattcccatgttgtgacagtaaattttcagacttacctatcttatatttttcagaaactttcagtgttaaaatagatgatgttgcatccctatgtatgcctatattttatatatacatgtctattaagagaaaagttctgctgcagcagaatatgcatgacaatactaaagaccataagagaacatgtaagtaaccttaaattaaataaccgtgaacaactgacatgtgtaagatagtaggtgttgtctgattttagagttaggtatagcaatcaagagtttaggttttcacctagagattatagcatgtgggttcacaaaatctgaataactggagctgtatccttaaagcatcaatctgggaacagaaaaatgcaaaagaagaattcgtccggtgaaaacatgtgggtttgcaagttgaaaaatggaaaattcaatacattggggatgcaacaccatctatttcaacatcatctattggccggcggaggggttcgatatagtagaaggcataggttactaaggaggtttcatacatttaaaatattcatgtatagatttgaaagaggtttgaattatcaaatgaaaaccgctgctcacaaccatcaacttgaaagtcccaactcctaaaaaccaaaatctatagaattcaatattagttcgattgctaggtttctgaaattgtaatctctactgtcagtcagtcccagtcaacaaagcatcatgtatatagaagtgattccttgcatgagttgaagtcaacatgagcaatgaacaaatataattgatctctgcatgactcagatattaagcaagatagggatattatggaagagttgaggaccttctttttctgttatatgaatttttcactaagacaaaaacttttttggatacactattactaaacagtaggtaaagaatagacaaattagatgtatcagaaataaaagttgtaggaatcacgaccaccattatggtcttttttagtagtagagataatgatgtgaatgtgttaatg

SEQ ID NO: 74664 - DNA, 3886 bp, Oryza sativa
agccggatagtccgacatgcattgttggacagtctggctcaacgtttgtttggctgtcactgtgtaagttcaagtgccttaatttggttttggtgattaatgacaaatctagttatatgagattaacatttttatgagcttttgtttgactagtctcatttggatatgaaagtaaaaaatgattagaggtatgtattaaacttcacatattctaacttggtctctcttgtggatccaaaatatagtgtgagctccctcattgatcttgattgattatgtgcgtatgtgttcctttatatccatatgtatgcacatcttgagggggaggttattctatattttgtttattataagatttctatcttgatttgaaatcatctttcatctcatctctctatattgtttatatcggattattatctatcacaaaagagagaaaagattgaaagatcttggattaaacaatttgtgtaattgttgctttagtgatagatgataaaccgatgtttatgggattaacctctcttttacataagttttcaacaaagttatttcccgataatgagatgtggtagatatgcattctttggtgatggaccttaatcatgacaaggatgaaattcatggagataaagcaatatgtatcacttcttatctcctactttttgataggttcatatatatgatttccatgttattgttatataagtgtgagactaatgtttacttgagtcttatcttatttagtctcctttacattgagaacatggagatcataaaggtatgtgttttttgctttatctttatcattgctacatgccttctccatgtgtataggataaaccccattggttcttcataacttatgcatacacttgcctctcttgtatatttatttgtatgcatatatttagggggagcaaatcctatacatttattgtgcatgttttagatccacgttgttcacctattatttatattggatctttgcatttgagcttgcatacgagtatatgacacttgcgatgttaatgaatactcaacaaacatatccatatctttcatatgcaaccggttggtcaccaagtggaggatgacaaccgatttgttggtactaatgttcttctttgagatgtgcaaaggaataggtctaattgtgatgaagctaatggatgacaccatgggttgatggtcaccaagccaagggcatcgccatgtcaacaagaatgaaatcaagcttgtgatgagaagaaagtcttgacaaatgatggtaaataccttggtataaacatggttgaatcaaatggtcataagtattgatctcgactcaagcttgaccccaagatggatggcgcaaggcaaaggtactaagaatgttttcttagtcttttcccggtcttggtgtttggtgtagaccagatttgctagataggtgccgtactatcaagaggggtctataaagcgagcttgtggatgatcttgtgccatgttagttcatatgcatgtaggtgcatttggtgggcttgtctagccaagtgtgatgagttttctcaagtcctaaaccaagagagaagtgggcatgtccaataggagtgagtgacatcttatgggtatgtccggtggatatcctttggagtttgagccctttatccttgacttaagttgtatttcttggatggttttttcatgggttggatggccctttgaataagctttccatagagtccaagaacgccaaattccgagacccgagtcaagagatatcgtcgttttactaacggtcggttaagctgaaaagtgacctgcggtctgaccgtgggccttaggccggtctggccgggcctattagccggtctgaccggtgtgataaggccggtatgaccggccgcactggtctgttgcactggtctggtttttggtgacgatacagagccgctagaaccacaaccggtcagaccgagccgatggcggtctgaccgagccgtggacaatctgaccgcctactacactgcggtcagaccggccaggttgagtgggctcaatggttgccctgtaacggctagttttctagtcgttacaaagtagtccggtctgaccggccactctatggcgatctgaccggcagagcacaaagttggggatttcaacttcaacggctagttttggtggttgggggtatatatactcactccccagcagcaagggcaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagtatcctagacttgttactcttggaggttgccgcctcctagacggcttgtggaggtgttgcccggtgacctctccgaggagattgtggaggaggcccggcaccgtttgtgagtggtttggagttcaccaccttcagagtgaaggaagaactaccccgagttatcaaggcttggatagtcctttccgtgggccggctcccgccttgcccaccccttgacgaagggggcgtgcggtggcttcgtggttgagcggtggagttgggctcgcctcaacggggattaggaaactggcgagtttctgaatctcggtgaaaaattccttgtctcttgtctcatttatttgtcgcatttacatttgtgttatttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcacccccctctagtcggtctccttgatcctacacactgggcaatggtattgaactaaccagatggtctagtgtcggtaccggacaatgggcaatggacagtccaagtgataccagattgtttggctctttatagcccaatggctatttggttagttaccgtttgaaaggtgtaaagagcctgactgtccgttgcgacaccagactatccaacccaatatattttctagaaacatgttcgaacggtagcaaatggctagttagtgcaatagagcaacctaatggagagtcccttgagcttatttgggatcaaatccttgtaagtttaatgctcatagtggcttagtgtgcgcccaccgagagttccgttcttagtgtttcaagtgaagggtgcatcttattgttcttgacatctttgtatgcctagctagcctcagaggcgaaccctgtgacgcctcaagatgcttgtggaagacccgatgtgattgtgaagggtttggggttgaaccatcaagaagagagcgccgttgaaagggagcaacactcctgtgtgtgctccaatgaggatcaatgaagattgtgtttgattccttctctctcttcactctcttgcatttagatttctagcttgaactagatttgtgtgtggtcagctgtaggttgcagtccattctttgaaacctgggcacttaggctaagtttatgttagagtttctaattttggccaatttgtttagaactaaattggagctcgccattccctgtcttcgaaaaggagcggcaaggtgacaatttgagagagctttatcccccctggcaccaactatatcaaatattatgaccaaatgcagcagtatttgtcttcttttgtaaagtgcctagaaaacatagacatatattcatccaagagcatatttttagaaacagtctaataatttaaagagtaaagtgcattggcggtccttaaacttgtagaattgtgtcatataggtccctaaactctcaaaatgcatat

SEQ ID NO: 74665 - DNA, 5025 bp, Oryza sativa
cgccggtcagattcccgcctgagggcctctgcgaccgccggatcctcggcctcagactggccggacttggaatggcgggagggacgcgacgggatctcgctgaaacgaaagaaaataccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctacttcctcttcccccgggcgtcggcagggcggctgctccccgggcccctatcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggtgaagacaaggggaataatggcgaaaggaaggaaacagatcccttcctcagtgcctttatactcttgccaacgctgtgcccggctccttgcttctcgcgcccactatttcgccccctcgtttctcgcgcccacgcttccactaatcccattcgcccgcttgcggcgcatgaggtggatatgcggttgtggcagtcgaaatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgtcctagctaaaaagccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggagatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacgacaactatacaaatctccgtccatttatgaaaagggggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcagcccgaacctgtatacatcgcccgtgtcttgtgtgtttcctgtctcgcgagccttccacatacagagagcttagaatctctccctgagtccccggccgaaccggcaaaggggggcctacgcggtctcccggtgaggagccccacgctccgtcatatgtcataataaggacacgatccaacatgtaacatgtatttggtgtaatttacttactggacaatgaattgacaaataccctgcaatgtgatgtctaattttatctactttcctccaatgcatagaatttgtaatttaggcagagtttgattcagctagttggcttaattacttcctcacttttcaagactcagggcaatctttttcttcgcatatgaccaattacaaatgtaattgtcactacatatttcttgcaccggcccagtagtttcatgagaagtacatcttaaatgcaagccatataattgcttatgggcttttggcccagataagtcataagcgcgtgttcggaataaaagacaagatgagagattgagatcggttttatcccacgcgcctttccctttctacatgccactcgtataacacaaacaaagccttcacattttgttcattgcttccctctctcacattctcaatcggcgaatcctcgtgcttgttggtaacctcccccaaaccctagccgccacttcctccccccccacccccttgctttgtgccgaacatggagggtgaaccctcacgccgcctctctttgctggaccggtgcgacgatgggagcgaggatccggtggtgccaccgcgagttcccaccatcctcaacctcacctcccaccaccgtcttgaccgatcgaaattcctaccattgatccaccctactcctgcccgcttcatctcttcaacaggatcttccttccccccctactcggaaccaccaccttcggcccctatgctagaacttggtagtggctttgggcctgaagacttatactcgttctttcctaatcattttttcttgatggaatccatcagtctaccaccatatgatgttgtagatgtgccgccggtgatccctgtcgcactacggtcggggagatctaaccaggggcttcctagcaagctaccgcttattgaggggcataggcggtcgcatagcgacatccccttcgggtattcacaagaacacccacaaatgccacctgtagcatcagttaagccggaggtcacaacgatcaaggggcaccaattggaggatgtggcggctgctgccctcaaggacatgggcatacaggcatggagcccttctggtagcatagacaaagaagttaagagctccggtgctggcagcacaacccaccattgccgcagcttgtcggttgacagcttcatgatggggaacctcaacttcggagttgttggacagcagatgtccagcccccctttgctaactacagaggtgaatgttggtggaggtgagcccattggtagtactgcttctccctttgctgcagagcttgcgaatgtgaaattcactgaggatgagaagaagaagattgtgatggataaatccctctcagagattgtcttgactgatcctaggagggtcaaaaggtgtgtgagtttcaatctttgtgtacgagactatttagggggattgacagtttgacatagtgttttggttactgaaaatcaacatcttattgtacattttcaggattctcaacaatcgggcatctgccacgaagtcaaaggagaaaaagatgaagcacgtaggggagcttcaacgcaaattgcaggtgctgcagtcggaaactactacattaggtgcacaagtgacagtgatgcaggtatgttttcaaaacaagtaatcatttgattaggagttttcacaaccttagttactgttggtgttgtttgtagaggaacaacaatgagcttgtatcacagaacaatgaactgaaaactaggttgcaagcaatggatcagctagcacagttgggagacggtaactttccttccttgtttttcagcatttatttgtt

SEQ ID NO: 74666 - DNA, 5044 bp, Oryza sativa
ccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacctaacaatggtatcagagccaccctagagtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcagcgaaggggagtgggacggcgccgccgtgtcgccatgccgccgccggcgctgtgctagggtttcggcgacggcgacgccgctccgtgcaaccgcaagagaaagaagagaagaggagctagggtttcggcgccggcgggcgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacaggagattttaattttaggaacattaattatgtgctatgatgttgtaatttttctgaccaatgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcagttttagaacaatgcatacaatgcatagaatgcatcggtgcccaaaacaccgtatgagctatggatcctccgtgtgtgggggagtcctgcaaaggataaagtatttaacccaaaacagtaagctgccattttattggctattctaaaagatcaaagggtcatcgtttctactgtccaaacagttatacaaagtttgtagaaacgggacacgtcgtcttcttggaagacgaaatgattagggggagctcggtaattcgagaaattgatcttgaggagagccgggtgtctgtacccgctccgtcgactcagcaacctttcttctctctacctgctaatgttgtgccagcaatgcatgccgttgcggtaccaaacacctgttgtatctctcctgtggcaacaatgaatgaaagtgaggaacctgttctacaggattcaacagaaattattgccacatcagaggaggagatgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaatgagccaaaacagtaggctgtaaatgggtctacaaaaccaaatatgactctagagggaatatagaaaagtttaaagtgcgactcgtggcaaaaggcttcatgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcgaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgttacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcccagtgcactggaaattggtaaagaaagtcttgcgtgtttgcaaggaacaaaaggcctcatgatgtcttacagaaaagcagaatcgctctagatagtggggtattcggattctgactttgcaaaagataatacaaagttaacatcgggatacatgtttaccctggcagcaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaatccacagtaatgtactctcacaacaattagtcaagtggtgctgccaaacacattgacataaagtactatgttgtgaaagacaaagtccgggatcaaacaatcagtctcgagcacataagaacagaaaggatgctcgcggat

SEQ ID NO: 74667 - DNA, 4343 bp, Oryza sativa
aagcgctccaccttttttatgttgaagattgcctcgtcatcgcccgctaccagcaagtcaatcctcccacacttgtagcaatcatttgcccaataagttagtattgtctgctcttcatctaggacttctaattccacattcttcctgcagcacacaagctcaagcaaaatcaccccaaagctataaacgtcgaccttagaagtaatccctatgttcttgaaccactcaggtgcaacatatcctcgagtaccccgaatgccggtgtttgtttgtgtctgattcaccggaagaagctttgctaggccaaaatctgaaatctttgctacaaaattatcatcgagaaggatattctgtggtttcatatcgcagtggatgatttgtttattacactcctcatgtaggtagagcagtcctcgtgccaccccaagtgcgacttgaacacggaggctccaatgtggatgggtatcgctgaagaggaatgtattgagtgatccattgctcatgaactcatacactaacagcctttcagttccctcgttgcaaaaaccaagcagtctaactaagttcctgtgaaatgtctgcccaatggtttggacttccaccaagaactccttttgtgcttcctgctgaagcttttcgattttcttgaccgcgatgttagtcccaaactcatcttgcagctgtcctttgtagacaacaccagaggctcctgtgccaagtacttcttggaaaccaccggttgccttttccagctcgctgtaagtgaaaatctttggaggtaatccagagttattggacggttgcgataactgggttttcttcctcgaggtgatactacaataagtaccaaaaagcataacagagattaggagaaagttcaccaatacagagcttccaaaaagtaatgaactcccaagaatccaatactttttggtcctccttccatttgcttgagccgctgctgaacacggatggtgaattggtgctcctaggcaccttaataagaactgtcctcggtacattgacatccattttaccgttcgacaaagggaaccttttcttccaacaagtgcttgaagctttatcgaacacagctacggcacagaaacaatcagtcacacacagccttcggcattcggtctgatctatgggattgtattgctcatagtcagatagaggccaatcaacgcgatcgattggtgccatgtcatactgcaacattgctgtcgtctcatccagatcacagttttgtggctcaaaatctggcctgcagcctttgtatttccttttatcatcgatgaacttataattctgtgggcataaacaacttgtcgtgttcttggtgccatcaatggtgcagtaactgttaaagccgcatgctccactacccaccattgtttgtattgactggcagatgttttctggaagtacatcgactgcagtccattgctctggccataagggcctggcatgtatgttttttgggtaaacatattgccggaacacaccatctgtgtcaagggtagcacgatggaagaaatcacccatagagtccacccctgcagaagtgatatttacctgtgaaccattaattatagtgaagtatatccttccagtttcattgaacactagctgtgagccattgtccactgtgttactagcccaatatggatcgtataagtatccagaaggtacagcatctggatacataacaagattaccatctcgttgaacttttagttgaaatcggccattggaatagtctgtggcgaggagacggctgtggagtgccgtccccagtgaaagcacttgtgtgggtaggatggtatcagaagggtcaccaaaggactcccactttgttgcgccatcggtgcctaaaagcctgaaattcccggtgtcgagcattctagcatagcccacatcagtgacttgtggattccatacctcattgccagatggatcgcgaagagagagtgctccatcagcgagcttgaggacagagccagattggacttgtaccggtattgtatcatctttcccattggagctagtccttgcgtaccagacgacggtcttgtcagcgatcttgttgaaccagacggcgagcaggtaagaggaggagtttccatctaccgccagaaaaccgaatgcaaaatcagcagagggcgagatccatgagttgtttaccccctggggtgtcaaagaggagcctatactgatgtttagctgagcttgggcagatttcgtgcagtatagtagcaagagttgcaggatgggcaagaacaggagatgagccattgctattgatcaaccttttgctcgtactgatgacaacaaaacttatagcccttggagaacggcatttgttagtcttgagacctgtgaggcaacggttgaacctgtcaaaagcaattacaaagctgtcaatatgatagacatgagagggagattagttcacatttcattatcagaactttagaaaatgtcggctttgaatgcattaaccatgctgggttctcctgacatgatccttgctggtctttcctaccgcgtttcagaagaacagttttgaccagcttaggttatggtcaacccaggtttaatcttatcatcataatataggagtacactgtaacattaattgatcaggttttttttgacagagccagaacctgctttgctgatcgtaaggccattcctactgggaggttcattttgaggtttccaaaagtcacctaatctaaataagctcggattaatggatgaaacatatagacctccaatttacagtttcatatagatggtattgttttttgacaatgtccctgtggcatttaatttaatcagaataaaactcttatgcatgaaacctgcactaaaaatggcctaatatatgttttagccatttctaccacgcaacgtcagtgctccattcaaggggagctaggacacattgactaatgatgtccgtctatctaatttaattagaatgaaactcttatgaaaccatggtagcaagtagcaacatatattttgaacattgaactggtcaattggaatcagtacctcctgagtcctttccaagcttgcgttgcagaagtcttcaagtctccctggtccacgttaggtcaagacggcttctagaatacttgcttctttgacagaacagaaggcaaactctatttcagattctgtttacggtaagtacaatgattgtgcaaagtccttttttattggctaagcttacaggtaggtatgaaaacggtcggaaatgatcggaaaacagcctcaaccatttccgtaacctttctcggaaacgaaatcgaaaacggtaaagtcagaaacgaaaacgatatcggaaatatcggaaaaccggaaacagaacaatacggacagaatgtcggtacagatcggaaaccggtattaaatacgaaaacattaaactataaaaacatatatttaactttacataagtatgttatatgtatacataaatttaagcttatacaatataaattataaattaactccattttagccatgcacaaaagttagatatttgattgaagagtcaatcaatctgtaagtagagacatgccctataaatatcgacatatttagaatacggtaattatcatattataagaaacggtaatttccacaagaatacggtaaatacggaaacgattggtataatagcaaaaccatttccgttttcatttccatattttttaccatttccatttttattttggtcgattaccatttccatatggctcaactggtagaaagtcgaaacgaacatcggtcggcggggaattactgttaccgttttcacccctacttacaagtttgcacaacttcaatccccgttaaatggctaaaaaatgggttaatttgatctgtgccattgcaaatatgtctgttcagataaataccattataattcatttatgcgtagccgtgccactcaaattttacgaaattagaaccatgctatcactgtcaggttttccatcttccgaatcggcacatgggactcacccatcagattcttcttcttccttacaccctccattatcttcttccttccccatctcttcgtcgtggcaaggagcgcgggcaggatgggagggggtcggcgacgtgtatggtgtggccctataggagagcaccgactaaggcgacgaggccgtgagcccctacgcttccatgacctagaatgatgggacacgcagcacggtcttcgcctccctcctagcggcggcgaacgagcggatggacacgccgagcgcggcatcagcggtagcgagcgggaggaaggcaaggcgccaacacggaat

SEQ ID NO: 74668 - DNA, 16194 bp, Oryza sativa
cttgttgtaggcaaatagatctaggatttactttgctatttatgctgactccgaaaattttcggatatatccgaaaatttcggaaatatctgaaaattattgcttccgcttttaattgaattttttgaattagcctattcaccccccctataggccttattgacactttcaattggtatcagagcctaatctcctaattcggcttaaccgcttggagagatcatgtcgggccaagtgggggatgggaataatggtgataagggagctaagattccttatgactatccccctacatctacatcttatgtgagtacatttagcggcaaagcttcatacttcaatggtacggactatgtcgcttggaagcataagatgaagatgcatttgaagtctattaatccatctatttggagaatagtcgaaaaaggctatgttttgcagaatcccgaagatcccaccaaggaggacgacgagaacgagcacaagaacgctcaagccgctaatgcaatacttagcgccttgagtgaaagtgagttcaactgtgtggatggcattgagagtgccaaagtgatttgggacacgcttcagaacttgcatgaaggcacgaatagtgttcgtgagtccaaggtggagatcctcaaggggcaatttgagaggtttgtgatgttggatggtgagagcccaagcgacatgtatgatcggttgagcaagatcgtcaatgagatcaagggacttggctccaaggacatgaccgatgaggttgtggtcaagaagatggttcgagcaatcactccaaggaactctaccttggtgaccatcattcgtgagcgtccggactacaagactctcacacctcatgatttgcttgggcatatccttgcccatgacatgctcgtgcaagagtccaaggatgtcatccaatacatcaaccaaagctcaaccacaagcatcaagaaggaagacttggcattgaaggcgaagaaagaagaagaagagaaccgcaagagcaagagcaaggcagagatcgatgatgaagagatggctctcttcgtcaagaagttcagcaagttcatgaggcgaagcggcttcttcaagggaggttcttccaaccactactccaacaagtcaagtggaagacactccacaagagtgtgctacgtgtgcaaagagcccgggcactttattacggattgcccccacctcaaggatggttcccacatcaaggaagataagaagaagggtgagaagaaggatgagaagaaggagaagcacaagcatagcaagcgggaacattatggccaagctcaccttgggatgatattcggctccgactccaagttaagctcaagtgatgaagaaggagctgccacgttcaccgtcaagccttcatcaccaccgagactcttcgaccactcaagtgatgaggatgctcccatttgcctcatggcaaaggaatctaaggtaccttctcctcacaagtcatttaatgttgatcttgttagtgatgaggaggatgaggttctggatgacgaattgtttaagtccataactaaggaatccctaccacacttgagtgagttacttggaagaattgaggaccaatatgcaactcttgagaggcaagaggctttgctcattcgtgagaaagagcggtcttatgaactcaagaatgagctttctaaggagagagaaaaatgaggcttaggtacggttttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgagccatcttgttccaaaattgtcccaagtaatgaaccatgtgtgagatgcaaagatattgatattgaagcttgtgctactaactctatttctttgagtgctttgcaaaagcaaaatgagaagcttatgggactccttcacaatggcctacttaagtgccatataggtagtaaggccctaaaggagtacctaggctatcaaagggacaacttcaaccatcagggtcttgggtatgttcctccactaaaaggaaaggtggacaagagtgtgatgatcaataggccccaaggtcttagcaattttgttaaggccaaaagtatccttcctaatgattatacttcacattgttcttttgatgcatcttatgttcttaggaagaatgctagtggtcgtgttgttgctaagtatgtaggcccaaggggcaagaatatttctatcaagagagtactttgggtgcctaacgcacttgttactaacatgggaggacccaagcaagtatgggtacctaaaactagaaattgatctcttgtaggaatatgtctccggtggaagaagttgggtgattgatagtggatgcaccaatcacatgaccggagaagaatcaatgttttcaactcttgatctgtcacgccctaaaaatcctaagtatataaattgttgtttaattggaattattagaatttattttaaaagcctacaagttaaactctaataatctaggaaaattttcaacataaaaatggtctagataaaattttattaaatactttgcttgttcctctattttctagatttttctaggaattatttgagcaagggaagtatttttaataaatgaaacaacatttcacaaattattttttaattgaaaaagttgaaaaatcctcccctaagtcgttgggccgatttcggcccaactcttctcttccccgcgcggccgaaccggcccaagccggcccagccgacgccgcccgcccctcctcctcgggtcaccgacatgtggggccccggacccatcttcctcctccagccggccggttgccaggccgagccgtccgagccgccgtttgcgccgtcgattccccacatcctcctctatctttccccctaaaaatcggagcaaaccgttgagtattctctccgaatcgaactcgttttcgagtttatctccaaaaccgagtttcgtttttcccgagtcgatttcttgcgggaggagtccgatctcttcaatccaaggctataaataggaccccctagtcctcctctttcgtttgccctctctcccatcctctcccgtgctccgtagcgccgccgccgcgcgtgtcaagccgccccgccgccggtcgaagtccagccgcgccgccgcgccgtttgcgccgtcgccgccgcttgccgccgccgccattgggtgcgccgtggtgagaggaagctcggccacccttcctttttcgtcgccggtcaccggagctctgccgccccatacaagccaagccgccgccgttgcctcttcgtcgccggccgtcgttgttcgtcgtttggctcgagggtgagtaccgttgggttcgtctcgtcgtcctctacgtgtacttgtcctccaaattcgcagccgatcatccaatctccggcgagcttgccatccgagccggccgccattgatgacgtcatcgtgacatcaccatcttttcttttttcccgtttttctaatagattaaatcttcggaaaatcataactaaataaccgtaactccgattcgagtggttcaagttgctaaatttttctaaaatcaggatctacatgttaaaaatatccacatgtactgtttatgcttgtttttgtactgttttgttaatttttgtttaattgctttagtttccgacgttccggaggagagcgtttccgttgaggaagattccgaagcgtttgcggaagcccaaggcaagtcacacagatcccaaacaaacctttgagtatgttgaacccatttaaagctattattttatttcaactatgcattgttttcgaatgtcatcgggtggtgaacctttcccaattaattaatggccgaagatgatcttattttcctatgggttataaatttgattagcatgaaccttatatgttggattggttcagctaaatgctatatgtaagtctgcttagccatgcttagaaacattagctaactaaagggattaattataaactatgttacattattattttatttatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcatgattcattatagtgcgccagactgtgaagtggcgagaagtccacgggggtcgctggggagtccatgccttgtttataagggggtgattatgatccaggaaaggtgcgctgtaaaggattatgttgtgcaaggggtattgtcacaactcctttccgaggtatcgtggtggtactaaggcgcatggtaacatgttgtgggattgtgacttgtgggtacagtggtacacctctgatcagagtttaatctattcgaatagccgtacccgcggttatgggtgagttgagcaatgtttttcgtgattagtcccatattattcattaatggtaattgtgataattaatttgactcctggtttggaatggtacgttcctggtatggaggttagatttgtacaaccggggttggttgttcatatgaggttgggcctatgcaacatgggtgtgttgtatggtgttatttaatattgattaattattcaactgtttttaccattcccttaaatatttattaaatgttgtttctgcaaatgagctatattatgccatcctttgttatcctgtgcacttgcatatttgctgtgtgacttgttgagtatgtcatatgctcatttttgcaataatcattcatcagaagaggagtatctcagtgaaggtgatgatctggaggattaggcttgttcctggttaagatgcctgtggagtggagtcgccatagctgttccgtagtttgttatagtttttttttccgctgcgtagaaggtttttctttgagaggaactatctacctctgtagtaattatttatttgcgaatatcaaatagatatttatttgtactctattatcaatttgttattgtgtgcctcggttgattcctggacgagggtttaacacacatgtaagcgtttggaattttggatagaaattccgggcatgacatgatccaaatggcacttcacaagataacatggtcttcggggacgatggaaagggaaaggttatgggattgggtaagattgcaatctctaatgatctttccattgccaacgttctcttgttaaatctctaaactacaatctcttgtctatttctgaattatgttctatgggttacaattgtccttttaccgatgttgatgtgaccgtctatagaaggaatgattcatcggtagtctttaagggtgttctcaagggaaagctttaccttgtggatttttcctcaagtaaagccaaacatgagacatgcttagtggctaagtccaacacggggtggctttcgcatcggaggctagcccatgttggtatgaggaatcttcacaagattctaaagtacgatcacatccttggactaacaaatgtttaattcgagaaagatagggtgtgtagcgcgtgtcaagccggcaaacaaattggagcacatcaccccgtcaagaatgtgatgaccactacaagaccattggagcttctccacatggacctcttcaggccaattgcttatctaagcattggaggtaacaaatatggtcttgttattgttgatgacttttcacgcttcacatgggtgttctttttgcatgacaagagtgagacacaagccatcttcaagaagtttgcaagaatagtacaaaacgagttcgacctcaagatcaagatcattcgaagcgacaacggcaaggagttcaagaacacgtgcatcgagagtttccttgatgaagaaggcatcaagcacgagttctcggctccatatttacctcaacaaaatggagtaaccgagagaaagaataggactctcattgagatggcgaggaccatgttggatgagtacaagacatcggaccgtttttgggccgaagccgtcaacaccgcatgccacgccatcaaccgcctttatcttcactaccatcttaagaggactccctatgagcttcttaccggtaacaaaccaaatgtctcttactttcatgttttcggtagtaagtgttacattcttaataagaaggctagatcctctaacttcgctcctcaagtggatgagggattcttgtttgggtatgggtcaaatgaatgcgcataccgcgttttcaacaaaacctccggtattgttgagatcgcgcgtgatgtgacatttgacgaaactaatggctctcaagtagagcaaattgactcacatgtgttaggtgaagaggaggacccgagtgaagcaatcaaaaggttggctcttggggacgtacgtcctagggagccacaacaaggagcctcttcctcaacacaagtggagccacctacatcaacccaagccgacgatccctctacctaaagcttggatcaaggtgaagaaggcgagcaagtgctaccctcctcgcccaagaatccaccaaagtatccaaagagatcatcccaccgacaacatcttaggagacatcaacaagggagtgtccactcgttctcatattgcaaatttttgtgagcattactcgtttgtgtcttctcttgaacctctaagggtggaagaagctcttaatgatctagattaggtgatgccgatgcaagaggagttcaacaatttcacccggaatgaagtgtggactttggtgtagcgacctcggcaaaatatgattggcacaaagtggatcttccgcaacaagcaagatgaggccaggctcgtaataaggaacaaggcgaggttagtggcgcaagggttcacccaaatcgaaggattagattttggtgaaactattgcgccggtagctagacttgagtcgattcgcatattgcttgcttttgctactaacctcaattttaagctatatcaaatggatgtcaaaagcgccttcctcaacgagcctatccatgagttggtatacatggagcaaccactgggcttagaggatccgaagtatcccaaccacgtgtacaagctccacaaggcactctacgggcttaagcaaacccctagagcttggtatgtcttcgcaattttcttgtgaaaaacggctttgaaatcgggaaagccgattcaactctttttactaaaagacatgataatgatatttttgtttgccaaatatatgtcgatgacattatatttggttctactaacaagtcttttagtgaagagtttagtaggatgatgaccaaacgttttgagatgtccatgatgggtgaattgaagctcttcctcggccttcaaattaagcaactcaaggaaggaactttcatttgccaaacaaagtatttgaaggacatgctcaagaagtttgggatggagaatgccaagccaatccagactcccatgccatcaaatggccacctcgacctcaatgagcaaggtaaagatgtcgatcaaaaggtatatcgttccatcgttggctcacttctttacctttgtgcatctaggcccaatattatgcttagtgtgtgcatgtgtgcaagatttcaagccgctccgaaggactatcaccttgtggccatgaagagaattcttagatatttagtgcacactcctaaccttggtctttggtatcctaagggagcgaggtttgatctcattggctatgccgatgcggattatgccggatgcaaagtggataggaaaagcacatcgggtacttgccaattcttgggtaggtcccttgtttcttgttcttccaagaagcaaaactctgtcgccctatccaccgccgaagcggaatatgtttcggcggggagttgttgtgctcaacttctttggatgaagcaaaccctgagagactatgacctcaatgtatctacaatcccactcctatgtgacaatgagtgcgccactaagatagccaacaaccccgtccaacactcccgaaccaaacatatcgatattcgccaccatttcttgagagatcattccacaagagacgacatagacatccaatatgtaagaaccgacaaacaattggcggatatctttaccaagcctctagatgaagctaggttttatgagttgaggagtgaactaaatattttggattctcggaatgtggcttgatctattgcatgcatgtttgcttggtagaataggtttgcataccactttgtgacaaaatggtcattcaactcatggatggacactagtcacttttgtggagaacttgaatctatgtgtatggggatcttatttttcaatgaattttggtcctagcacaacttgaaatagattcacacattccctctctcgagggtgaattatcttgtatcatggtaattccctctcttttgatccctcggatcgtccatttgacttgtggctattgttttgtgtgattgattgtgtgctagtcacaagttcaaatggagcctctagtgctcgaccatccctcctttcctaaatactatcaaaaacctttgagaaatgtgtttttgtcaaaaatttcccggtgcttgtcccttgcaaaatccatttcaaatgtttgcaaaatagtttcatcaaaattcctagcgaaatccccttgcaaaactgtgttttccaggaattttcggactttccggaaaatttttggacttcccgaaaaattttcggatatatccgaaaaacattagaaccgtgcgcaacccttctggatccgttcggacttatccgaaaattttcggaaatgcccgaaaatttcggggtctttatatatcaccccgtggactcccttctctctcctttccactttttttccccacgggattgactccctcctctctccccaccggcgaccacctcctctccggcgacttcctgcggctcccctcctctctatcctcgtgggagcgcgcttgggggacttcttggggcttgcattgtcgatcttcaccgcgttcttcaagtgttcttcgcgttcttgaggtattcgccctaaaatcaaatcctttgattcctcaagttttatcttgcgattccctttggtggagatgttcccctagtgccctagaacctgcggattcaatctcacaagtttttgttggcggatttgtgcggcatctgagttatagggttcggcaggattcttttcggacttttccgaaaattttcggatatgtccgaaaatccctggccgacccctatcacttcagttttgcacgattcttaccttcacttacttgtttcttgcctttttggcttccattcactggtcccttgtatctcgcttgtttgaaggatgcctcccagcaagcaaacctcccacaagtccaagcgcccgagggatcgctctcccactccatcctctcatgatgattcggacagtgattggtctggtggagaggatgcggttcctcaggttgccctggtggctcggggtggcaacctccctcctcggcgatctactcaagctcttggtgctggtggtggtggtgaggactcctctcgtcaactgcaaacgccgccgcatcaacccaatgtccccattggtcctctccgcattcatacccccgagagggatccagcggtgattcgccaagtgtatgattggaggcggaagactgaggttgttgctccctggtgggatgaggatccgcgccctcttcaccactccgccacgaatccgcggttttggactctctttcaacaagacttttatgagtcagtgatcaagtccaaagctcatcccaccgttcccatgcaatggatcaactgggaggagttgcaggcgcataatgatccggtgctaaactctgtgattgcaaattgtgagcgcatggggattcgctctttcatgactttgcagcaggattggtgcaacgaagtcatcgctcaattctatgccaccgttttctttgatccacaccgtgccatgcattggatgacccaaggatcttggtattctgtctcctatcctcctttggctgagatttggggtttcgacttgcatgacttactcaaccttcctgatctgcataatctacccattcctaccaacactgatctcctccctctttacattccaaatgatcctaatgtggtgttgggtaaggtcgacggtctcaaaccgtactttgcctacttgaaccggatgtttcgccggtcctttgtgccaaaggatggtgatgctagcagcattaaccgcctctccaggactgtgcttctcaggttcgatccccctcctcatcgctttcatccttatcactttgtgtgggaagaaaaccgcatggcttccattcagtacaggaaggggttggtctatgctcctcacattatgcggatgatcgagtctgtcactcagcttcagtttcgccatgatgtgtctcattcctagcttcacttgtgccttgttaaggcgccccgctcctcagccgctcgggacatcccctcctcttccactcagccgcctcctgctcctgagcgcccttcctctgtggctcgtcgtgagccgtctcctttattccgcattttgcagagtctttttggtctttgctccgcggaggccaaaaagaactgccgattgcggaattcaacgaagaaaacggctcgcgacgtcaaattcctcaaggcaaggtattatgaggatcatcacatcgatatccctccttctcctccgggtttcgaggccgagcccgatgagctagaggaggaagagattgaggatccatttgctgggtcgcctcctgacttcgacttctttgtttatgcccatggctatggctatcctcctccaccacctccagaggatcctcctcaggccccccttcgcttgagtcgtcgtctcatcgtcctctctttttggtgtcttgatgccaaagggagagattatctatcatgtctttagggtcgagcacatttggcttttatttgtatgagactatgtgtgatttctaagttaagtttaatgctttgtaagactttattgtttaattatggatgcttgagatgtaatggatcttattatgtttaatgtggtgcaatgccttatcctctttatatggtgtgtgtgatgagatgtaattattcttatgcatgtgatgtgttggatgtgatgagcaaatgtgatatatttgttgtcttgtgagcttcaatgtggatgcaaagatttagggggagctctctacttgcttttatgcacactcttaggaggagctttcactaaacctttgcaccaaaaccttaaattatactcattctctcttgtgttctaatcgtattgtcatcaatcaccaaaaagggggagattgaaagtgcatctaggcccctaatgattttggtgattaattacaatgcgattagagaggactaacatttttatttaagcaaatgtgaagcttgttatgtccttaatgagttagcgtaatgcatatcccgccaaatacgttgaagtgatgtgttgcggcaaatgagcaaatggtattttgtacccttttctttttgcttgagtcaataggaaagccgcactattaagagggatgatgcattgacaaatgagcagtgatcaaagtgctcaaaatcaatttttaaaagtgtttctcctcagttatagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaacatccagaacgatgtttttggctctgagtattttcggacttgtccgaaagtgattttcggacttttccgaaagtgattctagaacgatgtttttggttctggatatttttggacttatccgaaaaaatttcggaatgtccgaaaattctctcgttgactttgctgttggtgctgaactggaatttttggacatgtccgaaaatctttcaaaatatccgaaaatcacaattattgtgtataacaggcagaatttaggctgtggctataaatagccccctcccctcacttgtgagggctgctggtcacattggatatttttgtgcccttggcttgctcttgttgagattcacttttgagccttgctttcttgtttcccctctcacccatgttcgattcggatttggtgtgtgtgtgagagttgtggattcgagtttgtgtgagtgcttgttgttgacttcgtgaagatttgtgagcacttgcatcatctccgggagttcaatgcttcatttgttactcttggaggttgaggactcctaggcggctaggtgtcgctcccgacccaccgatctacatgtggttggccgggagaagtttgtgaaggtcggatctcacctccgaaagggaagagatacccttagtggaaggaggagtgcttagtgcaacctcttgaggaaagggttagctaagacccggctcttagtgagctcctcaacggagagtagaatccctcaaggattcgaactttgggaacaaattcgtgagcttcatctttggtgactttacttcctccctctccactagctttgcttatttgagccgctataggtctagttgatgtttgtgctagcatattcttgttgtaggcaactagatctaggatttactttgctatttgtactgactccgaaaattttcggatatatccaaaaatttcggaaatttccgaaaattactgcttccgcttttaattgaattttttgaattagcctattcaccgcccccccccccctctaggcctaattgacactttcagctctgatgtaatcaataatctttactcagggacaagtaaatgctcaatgtgatggtgttgttgacggtcctaaagtaccaattccgaccgtcaattcatgcacaaatgcaaatgaaagagaatactaaacttagaggtagtgcttattactaaccatttccacaagtcttggtgaatatttgtacgtgggtgcattatggacgaaaatcacccgccatacgacaaaatacatatctagacaatcagacgtgagtacacggattggaggccctacatgtcaatcataatcgcctacaattgagcccatctgaggtacaacttgtaggggggccactaggcagcctcccagccaaaggattggctgggaggtgggccaatggggttggccgaacccaaggtcttttgaaccacctttgcctctccttgccatctgccgacgcgtggagcaagatcttgaagccccaaaggtggttatgcttgattaccggcagttaccgaccttccaaccgacttaaggaggctataaaagaaggagctcactacactctaaaattacacagcaagtggagtacaactcacttacacatttaggctgagttcgggagtgagcgttgggaaccctcactcccaacatgcaaaacagagcggtgattagtgcataatttattaagtattatgtaaaataaacttgaaaaatggattaatatgatttttaaaacaactttcctatatattttttttttcaaaatgcacaccgtttagtagtttgggaaacgtgcacgccgaaaacgagaaaggtgagttgggaaaagtaggggaagaacacagtcaaagggtgtgttcgggaggaggggttgggaatccctcctccccagcacggaaaatgaagcacgtattattgcatgattaattaagtattagctattttttaaaaaaaaagattaacatgattttttaaaacaacttttatatagaaaaattttgcaaaaacaacaccgtttagcagtttgaaaagcgtgcatacgtgccccaaatgtcggacttctctccgaaggagtgctagagatgtcgacattcttccaaggagttctagaggagtgccgaagatgtcagctctctgtctctctatctctttgatcttgtacctcgttggatgcttcttttacataagtatttgtgatctcatttggtattaacttttcttatttaagtaagatatattctcatcattccaggttcatcgctgtacttagagtaccttaatcttatataagtgtgacatcgagattggggtaataatcaatagcgtagacatggtgttaaggctagagtttacgtttgtttgttgtgtgctccacgggttgtagaagtagatggcaggtggtaacagccatatccgtcctttgtaattctccatgttcggtacgtcatcgagctgtaggccggagtctccttggaagatcacgagtaagctggtgttcgaaacaattgatagagttttaacttaacttaattaacccataggaatccgctctttcctaagcatcccaattagttgttgtccttggttgaatcttgttcttagattacacgcacatgttccctgtgatttgatacccttggaatactctaaagtgaagtgctacttcggtatccatgttcttgcggatttatttatgactgtagcaaataccaacagcgggccactattatgttgtcgctagtcatgcattgtgcacacattattaatagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttatttttcttctcctctctctttctcatgcatatacatttagtgcatttattttaatgtgtgtgaagagttagctcttggataccatcagctcgccattgttgaagcccttaccactgcctaggattggggacttggggtgtgaggcccagagagaggttaggagatgggaatcggttgaatggttgaaacagaccagaccgggtggtcttcacgggtggcagggaaatcttgtcttttcaaaacatttctcttcttgtataggctaaaaataataaaataattgacagagcatccttcagcagattaccatattttttttaggatgtactcagaccgttctatatttttgttatgtctacatgcaaaaaccacaaattttcaatgtgcggtaccaaattttgccaaacaaccaccctggaatgataattaacaagtatgaagtttgttacaatcgtctcaaacttatttgttataaagttattgtcaaagtatgaccattaataccatggaaaatgattaaaaaggacaattatcgttatattggagggaatataaatttgtttgtgcagttcattgatacaaatatgaaaaacaaaaattaaaatgcccagtggatagacctcatgaatgattttgctatatggtttatatatggaaagtggcgaataaatatcatggctagtgtagtgggcaccttatccaaacaatgcataaaaagatagcttgaacttgcagctaaattgttcctttattccacttctttttttttattctcccaacagtggactacgcatatctgggccacgttgattttttttttccgaaaatggccacgttgattcggtggtccaatttaatgcacttgcgagcaactaattccgttccataaaaataaaccgatataaaaataaatctattatgggatatgactgtcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactgactgtaatatgtaatcacatgataaaagtccattgaacatcctacaaacacttctaggctgtcacatggtattcctataaatactcctaagtcgtcatatggcactataataaaccaatggaaccattacattcaactactaaatttatctctttaggaaaaaaacttaatgaattgattt

SEQ ID NO: 74669 - DNA, 26601 bp, Oryza sativa
  unsure (1)..(26601): unsure at all n locations
cgtcctattctacaaaccaaacacccgaatggaatcatcccaatcctcaaatcagggatggtttcatcccatcccacctagtcccagaaccaaacacacgctaattgagttttgggattcacttttcacctgtaaagaccaaagtttttcatacttgttgtctatgtctgttccacatgtaaggggttgcgctagaaaagcctagaataatctgtcttgctgctttttaccgatcagatccaacgattttccttcgtcctatttctctatgggatggttcagtgttttttattacttggatcaattaggtgttgtcttgggttttattgtccctgactctgaaatgctagagcaaactggatcctaatacaatattcatggtataataactgcaagcttagtgtaacttacaatagaaccagcaccgattccctcataatttccagtaggtccgtttaccattaatgcccatgatgcactaagatcattttgtcctcgcacttttggctcatagacattgattgcaacttgtgttccatatatttcatcatatgttgtacacccagctctctacatagaagatagagtcatgtttattattagtaataaaaacaaaaattttggatagaagaaaaacttcacacacaacacaagtaacactaaggtgagatttcttgattcctaattgttttagggataaatttattacttgctactaaaattgtactcattcacttagtttgccacttatactgtcctaatgacagtacgtgggggtttcaagacacgcatgtcagtaagaaagtctgtgtgtagaaatttgagaggaaactaagaaattgccataaaagacattctttttttagcgtatctggaacgttgatctggaaattctttcaaaatcgttcttacttgtggagctctagttgatagagttagaacaagggaagaaaaagatgcagaaggagggcaaggtttgtgcaaatattaggaaaaaaatatatgctggaaactacatatgtagtggtaaacctggaaactaccattagattgaaaaatggacgtctgagattcgtccacgtcaccacggatacaaattttactagtaggtttatatttttactcatggtgacgtgtacgaaatctcagacgtacatttttcgatccgatggtaattctaggtttctactacatattttccaaatattagtgttaacatttatctgcattattacggtgaacttttatcattgttttattcaatacaaatagtcgtagaaaaatgccaaatttcaatatcatattatttaaatattttatgggcatatattttctaggttagtgcaaatcaaaagaacatttgtaacgttacaataaaagaactacttgactctggaaagtattcttttgattagtttgaggagtaaattagaacatacctcccctccacgatgatgggtattaccgattggatcaaaactaaattgtgtcttcagatcagctttactattttgtaacaatggtattgttccctttgggcatgcaatggtaggcagatgagcttctgtcgctatagtgtctgatgatgatttgattttcagctctgatggataagaggtgggctccatctggttgaaaagtttacaaataaaaaaatgttgggcaaatgaaacaagtcataaaacactatcacattactatttactccctccgtccccctaatataagagattttgatattttccttgcactgtttgaccactcgtcttattcaaaaaatttgtgtaaatataaaaaatgaacagttgtgcttaaattactttagataataaaataagtcacgaataaaataaataacaattctaaaattttttgaataagatgaatggtcaaacagtgcaagtaaaatgtcaaaatcccttatattataggacagagggagcaatatttactaaactacaaacatatgcagtcatatcccctttccttccattgataataaagaacaacctagatgctcaattaattttgccaaatcaagcagttgatttgcgccaaagaaagaaaacaagtccaaccacaccttttttgtgtaattgactaattgagaaacatgagttggattaaggacttatttgtactatttgattatggggttaggatgagaagaataaagcttgataatatgaaaacggagaaagagagtgtgaaatagcaacatacctgtattatgtgccctttcaacaatggatgagatagtgctggttgtagattgatatcgatgcaatgaaacacgtcgccgtctccagtctattaattgtgaaatttatattgcttgtcaactagacaaaggaattatatatgtaaatctagaagaatcgaaattatatggagatatgaaatgaaaaaggtgtgtagatagtacctcaatgatcttgttgataatcttgtcggaaataggttgatcataacttgcttcatgctttacatatctaccttcttgtattcctgccgcaaggaggacaagatatgatatgaaaattatcactggaagttctagtggtttggtcattgagaaaactgaattgttcactattctaggatacagacctaccgttttataggacatggagggtggctaccgctcttacagtaacccccgttttaatgaatttggtggaaatgaactgtcatgtctttgactcaaaagatatagtgaagatggaaaaaacaaaagacatgatgtatataatctgcgaatgatgtacgagtattagtagagaaatcaaatatgaccgctcaagaagaatgaatttaatgcctccagagaatctcatttattgcagttgccaactaagaaagatatagagcaataaacttaataaatgcatgaaactagtctatatttattagaaaatatataatctacagaattattggcacaaaaaatattgcaacgatatataaattgttgcaattagttagtcagtgattgagtccacgactcctcctcgttgtaaccgtccatgcttccccattcttctctctcgctctgtccctctctctcgccacgcgcaaccgttgtcggtcgtcgagacgccgccactgtgtgcctcttggctcccagggcgccgccttcctgttcttctcctcttcaactcctcatgtactattcctcctctcccaccctcatctctcccaatgtggcggtgttccttcggctagatctaaccatccctgatctcgggtatcagatccggggcgaggccaccatgtagatggggagagaggcatgaatatggcttcagctcgggagcttcttgcagccaccatctccatcgtcatgtcccttaccggtccgatagaggaggtgaagaagcagatgctggtgctgacaaaggtgaagctgatgtgcttgactagttgggaaagaatattgcaaaccatattcttttgatgttgcacataatgtttacttggtgtttcaatcagtctctttttggatgttgtacaaattggtacaataatttcttgatgttgcaatattctggttttgtgtgttgcaataagtatcgttgaatgttgcatgtgattgaaacatctttcgatagagcaatgaaacactcttgatcaagtcatggcacgctgaaacaattctcgttgaaacattttttcatcgaattatgaaatatatgaaacattttttttggatgtgatggaaccctatccgatgtttcttcttccatcggacgtccgatttgtagcgctctcccaataaaatatgcattgttatcatattttagaattttacttgcaaaagctaaaagttaccatgatgaaaaatattacacggtttcaattttcattgtaataaatatgctctcatacctcactatattgatgtggtaaaattatttgaattttctttgaattataaataagctattgcgacaattagataactattgaaatatgcttggagtagcctaaataaaactctgttgcctggattcttacgttacagaactaatctcagcaaagtacagccacaaaccagcccatctctagttctccaccttcctagcaaatccagccagccagcccactatacccaagtccttctagatggaaataagttcaccggaggtccctcaacttaacaacgagattttttaaggtcccttaactacaaaatcagaaatgtgtacccctaatctcacacaaaccatgcacttaaggtcctatggcagtatatatgggtgggtttgctgacgtggcatcctagtcagcaaaaaaatatttaaaaaagtacgtggggcctgtatgtcagctgcacattttttttttcttctccttgtcttctcttctctctcttctctcttctcttcctcttcagtgagggaggccggcggagtggcgatgggcaggcagcaggcccgtgcagcagcggagtggcgatgggcggtggcaggcagagcggcgccgggctgtgggcggagcggaggcgggcgaagctcatcttggggcagctcgcgggatcatggggcggggcgcatccaaagcgcacattcagatcactatttgtggaatgatattttgcacaaatctggtttgcgatggaatgaactgagaaacgagcatcatctcccctgtgtcgtcctctgtgccaccgtgagagcacacgacacacctacaagagttcagacattcatggaagcagctgcaagggacccatcatatctgctggaagaagacaactaacatatttcggctgggcagaataacattcgtatcaaatccaattcttgggtgcaaactctaacatattttggcttggtttgatcgcaagtataggttttggacaactgacagatttttttttatcatagaccagagactgacagatgtgctctctatgagggagaacaatacaggaggctgccctccacctgctgctggcccaaatatccaacagcgagagaacaaaatctacattaattttattacggcaaggagaaattcactttgagtacatcgatttggtggactcatgtagagttaaaagtactctactaatttggttgggagtaacgttaatctggttaatttcgattaagagcaaccaaaatactgtattttctatctataaaaaaactccaaaaatacaattttttttatttgagaaatgcattacaaacgtagatactcacaatacacatacacccatataaacgcacacatacacccaacctttattagcgcctcgaaaagaccgaacttgcatattttgagagtgacaaagtcatcactggtacctcgttatcgataagtacgttgtctagaattgaaaaaaataattagctgtaaatatgagtactaaaaaatatattgtactcctctatgttctatctattatatgcaatacaaatattttcagttctgttatcctaaattcgattgccccaatgtgcaaaactctccataggatacacacatcactctaatcctccattacctatgacaaacacattcattccgtgtgaaccacgtttgatttagccaatcacattcaccaaggcaaatttggagcactcaaattccaattttgtattcatattcccattcaacaaacccccacagcataatttaaaatgtaggcgtctgtgtgctgcaggaaacgtacgtccaatccacaataatttatacacgcgtatatacttcacggctacgcagactgccgtttacacagaaacacaacatcgtacacgcaccgtatgtgcttacataagttcgtaccactgactatatataccaatgcatcctaattccaattcaccaaaccaaagtagagttcacagaagcagcagcagagcagcaaccaacagcagcaggatcaaggtcacacaaagcctgatcgatcatggccatggccaaggctctgctcttcgccatcctcggatgcctctgcctctgcagcgctgttctagcagctcgtgagctgagcgatgacgcggccatggcggcgaggcacgagaggtggatggcgcagtacgggcgcatgtacaaggacgatgccgagaaggcacgccggttcgaggtgttcaaggccaatgtcgccttcatcgagtcgttcaatgctggtaatcacaagttctggctcggcgtcaaccagttcgccgacctcaccaatgacgagttcaggtcgacgaagaccaacaagggattcattcctagcacgactagggttcctactggattcaggaatgagaatgttaacattgatgcgctgccggcgaccatggactggagaaccaagggcgtggtcactcccatcaaggatcaaggccaatgtggtaagaaaattcaggctactcagatgacattcttcagtatcttttatgatagagttttgtgataacatctattgtgtccaatgcattgaacatgaatgattattgcaggttgttgttgggcgttttcggccgtggcagccatggaaggtattgtcaagctaagcacgggcaaacttatctctcactctctgaacaagagcttgttgactgtgatgtccatggtgaggaccagggctgcgagggtgggctcatggatgatgccttcaaattcatcatcaagaatggtggcctcaccaccgagtccaactacccatacgcagcagtagacgacaagttcaagagtgtatccaacagcgtcgcatcgatcaagggctatgaggatgtgccagccaacaatgaggctgcccttatgaaggcggtggctaaccaacctgtgtctgtggccgtcgatggaggcgacatgacattccagttctacaaaggtggtgtgatgaccggctcatgtggcactgacttggaccatggtattgtggccattggctatggcaaggctagtgatggtaccaagtattggttgctgaagaactcctggggcatgacttggggtgagaatggtttcttgaggatggaaaaggacatttctgacaaaaggggcatgtgtggcctcgccatggagccttcctaccctactgcatagggaaagctcaagtgtgatgtggatgatgtatagggattgatgaataatgtgttgctgtggttcatactttgtttgttcaaaatatataatttataatgcacttatctacgagatgcatggataacatgggttggatctgataaaataggtcaagtatatattgtccatgagcaaatgagcctttgctacaattaattaagatggctggtaaggttataagtagaacaaataacatgtactgtcataatttataattcaaattgttgaaatcactagcaatcacatacactactactttctctgtttcatattataaatctagacatatatatatatacatatttattaacatctatatgaatgtgggcaatattagaatgtcttataatatgaaacggagggagtatagaaaaggaaatttgtgctggttgggagatgaccataggtgccagattttccaacgccacccagcaaagcaacacctttgaggtcccaggaatgaaaaaaaactggcttgatgccttgaccaactctccgtcatcactgagatcaccatcattcacatcaaacacaatcacaatcatcactgagatcaccatcatcacaaacagacaaagaatgtcaccatcacatcgacgaccgggccaaccccgtggtcgtggcggtggatcagtccctgtgttgacagtggcgttggttggatggagaagaagaggaggaaggaggggtggtggtggtggctaaggaggaggaggaggaagaggaaggaggggtggcggtggggatgaggaggaggaggaagaagggcagtagcggggagaaggaggaggcggcagaggataacgccagtcggctcggttggccggttttttttaattataggcggtcttttaaagaacatgcacatataatatcagtataggtatcgatttttttctagaatcggcacctgtatgttcttaaagatgccagtttttaattttttttatcccatgaaagtggaaattggtcaatagatgccggttttaaatgaattggcacctatgactatgagccgtttcctattaaggtttccattgtagtgttataatttataattataataatttatatttttatgcttcttggtgtattttgttagataatgtcttggtgtacttatgtaccattaaaattactactgatgcttggtattacaaagctaacattttggaaacatgtcaccatatttttataatattaattatcgttctatgtaaataacttaaaaggtggaaaattcttcgtaaaatgtcttatccctattatgatatataccagttataaaaaaaagaattcattttagacctgctatgtaaagttaatttatgtctgctgaatcctgagtaatctagcagtttgttctccctatatacttttcaagtgaaaaaaaaattgtaatttccataacatctggactggctattctcattaattaagaatgcattcaaagaattctattcatttcaaatattttgcagcgaattcagtaatatttttactagagctccctcctgaactcctgcattgctttcttagctttattcaacaagctcgcagcatttcgcctgtatttctctttccgatctccatccatcatcacctcgctgatgcacctcttccctccataagtaccattcttgtcccattgcacctccgcgcacctatgccccacaaggtctccatatagtatgcaatggttggttgatcagcccattgtgcattgccaaaggggcacaccgttggcaatcgcctccaatccgtgatgagcccacttatttgagtaaaaattaaaaagagaaatattgattattcaccacttgaataatatttatctcttctctccctcccttctctctcgctctcttctctctctccccctcccatctctcccgcagccggcggaggcgatagtggcaaccacgccctccgctctgccagatccggtaggaggggaggcggcggcngcaggaggggaggcgtcagcgacaggcaggggtggtcggatcctgcgttggcggcgggtggggtggctcaagaaagggagccggcggagggctcgcccgtggggaggagccctcccctccgctagatctagcgggaggagagacggcagtaggggtggtaggctcgcggggggttggtggtggcaggcggcgggctctctgaagggagacggcgcgatgggaggtggcgcgacggatgaccgtgcaacggcgacgactgaagaggtgtgatattttttattccataaatttgattagagtgccaaaatttgtgtcgtgggatgaatgctgccaaaatttgatatgtggatgattccatctttgcatgttgtgggatgaatgttgccaaaaaaaattttcttgttctttctattcttccaggtgtgggaggagggactgcttggctcaatgcattggctcgattgagctaacgcatcgagccggcttttttttattcgtcgaacctaaaaggtcccggttctagaaggtcccggttctaatgaaccggcacctttttgatttcaaatcagtgccgcctcccttgtgccggttgggaaaaccggcaccggagggggtttcccaaccggcactaattaccttttctgtagtagtgatactagctttggaaacaaaagtacataaatactaatgttataattcaacattcaacaaatcatacgctttcaaaaatccacattgccacaatttgttatagcaatcaagctaagaaaagcagcagacgaaaaactgtgcaaagggaaaacacaacaataagaaaaaaaaaagagaatatgagataatctaacttgtgaggtagcaaggtctcgtgcctcaagctcgcagcgaaaaggagaggggagggtcggaacaactgaatctagatccaccacctagggatcgaactaccgtaagaacagggcaaggccgtcgtcacaatctccgtgctgacttcccgggccttcgtgatctcacgacacagtcatcgaccatggagccaccagatctgccaccactccctctccttagatccccaaccagcggatccaagtctccgccatcactcctacttaataagctaccattgtcgtcaccgccattcctaccaatcaagcactatcactacattctctgcccctaacttctcgtcccccacgtagtggaggaagcgctgcaaggaccggatctagaggaaccctgagcagccccgagatttgggttttagatctggtccttgcatcgcccctcgctgcgtcgaggaggagggaggagcaagagagaggaggcatgcagcgatgtttgggacagcaaaaggagatccccatggtagggttggggatgcaagtgggagagacatatcggtaggcaaacagttctcctcccccgcgtagtggaggaagcgctacaaggactagatctggtggtaacccttagcagccctgaggtttgtgtaacatcttgaaaattcctgacaataaaaatcactaaaattttgaactttttaaaactttttgcatcatgctagatgttatggttgttattgcttgccaaaccataaattgacacaatggaaaaatcaatctaaagatttacacccgagcaataattacgatttacaacgatacggtatttattatcaatcccataaatatttatgcacatgaaagccaagccaaataaagtacaagttaattattaaaccgtgtagtataaatcacaaatcaaatattaaataatcaaaccatgttgatagcctgatttcatatttaacaaaaggaaacaacatggttgaatatgattcacttgaatccaatctcacatgagatataagaacacatgaaatgatgatcaccactataatgagatataagccaatgccccgttcagggaatccaaaacctctgtatcagcaatttcatagacaaggaactacaccacatggatggaaaggaaaacagaaaaggaagatgtcaccactaataacctatgctgaactggatctcagtaaaatgggaatagaaatcggtgatttgcctgaagaagttgacgagctacaactatggcaacgaaagagagatggctgttgtttttcttgtggacaagtcggacattatgcaataggctgtatttaagacactagtgaagaacaagaaacactgccttcacagatcagcccagaagaggacagagttccagaaccatccaaagaactatcgaaggttaaggcatgtactctttgcggagagataggacactatggtagtaattgcgttactcaatgcccctattgcgaccaagaccatccagttgaagaatgcccaactacgaagatcacctgcttcctctgcgaaaggatggatcatgtgcccaaagactgtcagctgagcccgttgcttaccaagacggcagaagtacaaagagtgacgcttcgcttcgctcatcaactcatgaagtcgggaagccacgaagaccctggatttcctacattcgattagcatgtttgtctatcgatcaatatttaatgttgaactagtttaatgtcatcgtagttccaccgaatctcgaggacaaaatttctttaagggggtaggtttgtaacatcctaaaaattcctgacgataataatcactaaaattttgaactttttaaaactttttgcatcatgctggatgttatggttgttattgcttgccaaaccataaatcgacacaatggaaaaatcaatctaaagatttacacccgagcaataattacgatttacaacgatacggtatttattatcaatcccataaatatttatgcacatgaaagccaagccaaataaagtacaagttaattattaaaccgtgtagtataaatcacaaatcaaatattaaataatcaaaccatgttgatagcctgatttcatatttaacaaaaggaaacaacatggttgaatataattcacttgaatccaatctcacatgagatataagaacacatgaaatgatgatcaccactataatgatcgtgtttataaataagtaattcaccggaatatatatagattgatacttacaacatttcgccgagttcctcatgacatgaaaatcactcatataaaataatggtcacataaataaattaatctttatatataaacaagaatatgtgagtgtttaaaactagattaatgttgtaccgagtcttaatatactatttatagaataaatagattcaacctatccgtgtaaaatatattgctatgcaaataagttcactcaatgtgctattgtaataataagggccacattaggatattctaattaattttagaaccctcaaagcctccaaaattatttaggttaattttagaattagacctcatttaaataatacaatagaaaaatatatatgagaataaaatatgggtaatattaaaatttggtaaactttcatctaaattaaaacatataatgggtaaactccatttgtgtgaaaattagggtttatggaacaagaattgaaaaggaaatcaatcaaatagacaacataggaaaagtcactgttcattatggcctaggtgtttgatgtggtcccctagcccttcccccctcctctgccgcgctccccctcgcgccccgcgcccctgcacacgccgcgccgctgccgccctctgctgcgcgccgcctcgcgccctgcgccgccatcaccatcgccgtcgcctcgctccgccgcgcgctgtcgcgccgcctcgcgccccgcacgccgtcgccgtcgccgtcgcgtcgccatcatcaccacgccgcacgccgtcgccatcgccgtcgcatcgtcatcaccgccgcgccgcttgcctgtcaccgtcggctgcgccgcgccgagccccacgccactctcgtcgccgccgtcgcgtcgcccgtcgcgtcgccatcaccatgcgccgcgagccgtcgccgtcggcctcgcgccccgagccgccgcgcgcccatcgctgccgccgcaggccgcgcgcctgtcgtcgtcccgcccgtcgcgtcgccgctccgagccccgcgccgtcgcgtcgccgcttgtcaccgtcgcctcgctcaccgcgcgccgcgccgtcccatcgccctcaggccgaccgccctccccgcgccctataaacccccccccctgtcgccattaccctcatcaccttctctccctttcccctctctttcccatctccggcgtcgccgcctatttggaagccgccgccgccgccgcggagccgacgcgccccgccgccgcgctgcgcctcgtcgccgcgccgtgctccggcgtcgaccccgccgccgtcgtcgccggaccggtaagcccttccgccttccttcgttgccggtagccgcgccgcgccgctcggctgtgagagagagaagaaagaacgagagaagagattagtgcacagtaattacttagttcaccccggataaatgagcctatgacgcgtgggtccggatgattagaaatctaattaaaatcaacattaagtttacactctatgacgtatggggcccactggtaattaaacaagcaggtttgaccctaagtcaaccagggccggtcccacatgtcaaccacagtgggttttggataatgtttccgattaaaaataaatcatttatgaacagtacatttttacaatttctcggattaactcaaatttgaatctttaaactagcataactctctcattttaactcggatttgagtgaaacttgaacctaaatttatctaaatttataagctttccaatggtatataattcactatttgataaaatatatttataattattaaataattaatactaagataatgcataatagtcaacttaaaaatgtgctaacaaataaaattagtactttacagtaaggtagatgtaagaatatttgtctctaacatgctttgtcaatgtaacagccacacaaactaattttaaaatatgtctcaaattaatgtataggaagatactagtactattaaatggttgtataattaaacccatgacttatagattatttaaataataaagttagccttataattaggcaaataaaatatggatacacatagatcgttcctaggctttcttgtgagataataacatagccatcctaatcacatatatcgaatagcttacggtaaatagcaactattcagtaaatgatccaatgttaaaatattgttgcacacacgtatattgtacatcccaatttagatgtacagtatatcaataacctacccttttgaatataataaactaaggagtctatgacaaacatctatagtggataaatactaaatataaatcatgacctaatataatctaagttcaattgtaagttaggattattcgttgtaaaattatgtggtgggataatctgtaaccataatacgattagcctaaacaactctaacatacaaagcatggataattattaaccttttataacttattgtgacaagtaaaatatgttcataattaaagtaaagcctccatcaattaaataataataaaaatgattcaatatttgattgatcctaaatccatctaacaacagaacctctagtatataaccgtcctatttacatagatgtatacatagtcataatccttccatagccatttcatatatatatatatatatatatatatatatatatatatatatatatatatatatatataccataaatgctatgttggttaactcctaaatagatcacgatgacaatagaatgattaagaagctttagcccttagcatgattggaatccattagcaaacacgaatagtacattttattgtgcatatttgattgttgtttgaatattggtttttctcgcgtattatagaccttgtgtatcggttagtcgtgaggcaacgtctgcaatttctaggaggagaaggttgatcaagattatatcaagaataaggactatcctgagcaggcaagtcatcactattctttgatcacgttgatcccaattgcgaaattaatttttgtttacaaataagattgtatgtaatgatgaacatcctacttgtgattatgccatgccttgattattgtttacccttaaatctttgaaaccatgattacgtatgagtccctagtcaactatgacacttgcttagaaatgctactttagaatcttgcatactcatgtttatcaaatattatatgcttgggcaattacctttgggaaggtaattgagatgcggcatgtggagacatgagcaccacattgccttgataatgatgacatgaaaggaattaaaaacctttgttttagaccggggtggacggtggatttgggtggtatccgggaaaggctagtaccgtccccggtcaattaaggaccgagccatgaagttaagcatgaaacgaccccgtacaaccacatttctcgaatggggatagacctagcggagtaaatagccgagcggaggcagtatccatgcatagtggtttctcatgtgtaaggcagtggctctacaatggtgtcgccattgctaggactgccgtgtgttgagttgaacctagttataacttaattacatgggtgtaaaacttcccttcccgggtgcgccagaactcctctcactactagaaactgtgtacgcctagagtgcatgaggatgaaaagttcatagagcgggtattgccaatgcgaggttatcgaaaagctttgtcgtgacgcgtctcatatgttgagacaaggctcatgtgttgggcagtcgcggggtgtgggtaaagtgtacatccactacagtgtaagtaaaccaaatctattcgaatagccgtgctcgcggttattgagcaccgggacatgtattacacttggctagactctaaattcttaacttgtgtgggatgggatattgcatgatgaattttatgctgatggagccacttcttgagaggagggaaggtggacgtcctcagaaaaccatgacgactcaatagcgggaagctatccttgggattacaatggatgatggacagaaccgtcgttgtttaatgtgaacactggtattaaaacttgatcagtctatgctaggtcttaggcttgtgaaaagaattgcaaaactagctttatgcaaaagaacctgaagccgttccttgaaataccttctatcatacgcattgttgttgtggtggcttgctgagtacggttggtactcacccttgctatttatatatcttttaggagagtgtcgaagagaagcccttgtcggtacgcttgcgtatccaacaagatgatcggagtgcagtcttgttctaggtctcgttccccagtcgactgcctgtagcatgttaaccgggccctattattattttgtcttccgctgttgttctctgatagttgttggcctacctggccttaatgtaagtatttaactcttatagcctgaattcattcgtgatatgttgtgatccaactatgtatgtgtgtaccaactactgatccagggattggtacggataaacatagaagatttccgatttccaaaatcaggggtctacagtttgggtatcagatctggtccctgcaccgtctcctacactgcgtcgaggagggaggagcaatagagagggggcatgcagcgatgtttgaaagagcagaataagatgcacgcggtagaattggggaggtgagggggggaggcatatcggtgggcaaacggtcacatcaatggctgtggagagcgaaaggattgttatgtcaacgtgtgagaggaaatgtagagatagcttatgcgcaagagccaagcttagacttatgtatgcacgcgttgtgacctgcgttgactgtttttaccatcggttaattaagaaaacaagcaccactgtctattttttatcatgaacaaataggagtatttttatatcacaatgaattcattaataaaccggcctgaatagtatcattaataaaactgagaatgatataatttccagaaacaactttaaataatccggcaatgacaatgaggctccggttgatggttctgtgcgatagggtcgttacgcaagattgaagtctcaacatttttaaccatattatttacatgagtttttccttgtgctattttttagcttcgtatagtatggaaacttgtaattagtaggagagagatatatttttgtaatggcaagttctaatagaaaggatggattaagtggagaacataaataacagtttgtctggtggaggaaattaaaatgcacatatgtgttctgtaatttagaaagacataacccttgtgctcccaaagtatggaaagcttaaagaattatttttttttgtcccgatatgtctatgcttagcttgttgtcctcgacgaggacataagctaataacacttcaggtaaagtttggcgtagctctggatacgagatttcttaaatttggtcgtacctgcaaatctatggagctgtgattacgtgaataatatttagattaatcatttgttcctattttagatgaaataagaaattttaaaacagtataatttgatatagaaacttcaaattcagaagggatatggggtctggagttatgctagacatgaccttcattatgaaataaaaattgtaagtaatataaagtaccattttacacagtccgtaaacttaatttacttctgctgaattatggaaaacatcagctcctcgacctccatgaacttttctaggaaaaaaaattattcataagctagaacatctctaggctaatagccattctcactggattgtcatttcgaatacttcgcagcaaattcagcaatattcttgtcagaccttcctccttcatgcattgcctctttagctttcttcatcaaccttgcagcactcctcctatagtcctccttcctatccccatccatcacctcccgaatgcacctctcaacctcttccctttgtatgccgccactcttttcctgccacactctgacacccatgccccacaagctctccatatactttgatatggttggttggtcagccaaatgtggcattgccactagcggtacaccattaacaattgcctccaacgtcgagttccatccacggtgcgataaaaaacaaccaatacataacatattttattctaattgaaaacgacttcaattgagctattgttgtctagtactcattcactagtctactacacactccctccaggctaaaaaaaataactttgaccaatattttctattaacatatatatataaacaccaataaatatatgattttattgaattgaagtactttttagattaattatacatatggtttgcatatttctaactcaaacattatacatgttatttatagtcaaatttttaaagtttcacatatttcttataaaaatgacaattattttcaacctggaagaaaattattttgttgtcaaaataaataatttaagtttttgttggttccatacctgtggccttgtgagaaagcacctccagctgggggcaaaagggaacaattagtcctctcttcccacacttttctcgaagttctcgagataacttgtgctcctcgttggacctcacaacccaaaggaatggcttgcctgaattgcaaaggccattgccgacctcctcgagcttggctgcgtcgtagccggagaaagtcccatacgacacaaacacgacagagcgaggaggctgcttgtccagccattccatgcacggcacggtgctcgtgaagaggttgaacccgtacgccgtgttcgacggcaaccggccgtcgccgaggtagaacgacggcaacaacgggccgaccgtcttcgcacgccatgtcgcctccatgtatgctgcctcctgctcatttcacagccaaaatgtgtaacaattttgggaccaaatgatcttgtttgttgcaatgtaagctggatacactagattacctttggctcgaggtcggtgaaggagttgacgagcacgtcgtcggcgtcctccagcccggcgaactgcgccaccgactgctcacagaacgctggtgtcagctctggcgtcgcgacgaacggcggcaggtcgtcgtgccccagctcgacgcctagcgcgccccgcgcgtacaagccgctcacgtccgccggcgtcaccggcagcgcaaggcgcccggcgcacacctccccgtagatgaggtcgacggcgcagggctgcggcatgaacgcggcggcgcccacgccggcgtcgcgcgccacgcggagcgcccacggcaggtgcgggtcgaacaccagcacgcgcgccggccgccccgcgcgggcctcggagacgagcagctccgccagcgtccgtgcaccgtgagcctcgaggctgcggtggtactccccgtagtccgggagcgcggccatgccgccggcgtcgtcgtcgaagccgtcggagaaggcggcgacgcggaaggggtcgccgggaggcgggctcctggagagcacgtagcgggtggcgacgagggtggggcggaggccgtggtaggcgaggcggcggccgaactggagcatcgggttcatgtggccctgcgccggcaacggcacgagcaggacgtgggcggtggcgccaccgtgttgatcattcatgctcgccatgggttcgaatcacttggtgatttgacttggaggtagcaagctcgctcgcggcgacgatgagctttatactaggtgtttgaagggttgagaggcagagtggcgcgcaagttaattttggttgtgctggcgcgcttgacgacgacaagtttgtaggcgaaatggagactcgctttgtccagggactatgactatcacagcctcacagaatggataggtgttcgcgtggtcgaagagaagttgctcaccgagattcctgcccttgaagtccttctgtcaaacaaaacaattgctcttagaggtgtgcttgggccgactagtagacaatctctatctctatctctattataaaaatagaagatgtttttgtcggtattttggtatgttatccatataagagtcagtttttaagttcgtttgcttttgaaaatacatatctgtatttgagtcagtttctaatatcattcacttttggtaatacagaatgaatcatataagaaatctgtttaaaaaaaatcgcatgctaacttgagacgatcggactcttaactgcagttcatgattttctatatatatatatatatatatatatatatatatatatatatataagcgaactctcacagtgaatttcatcttaactaaaccatataacaataataagattaaaatatacttcactcgttgcaacgcacgggtattttttgttgctctaactaaaaagccagaaagcatgtttggggttttgtgcagctgcaccccttctccgaaactccatctatctactatatgattaaaacagcctagaaagaaggtaacacatttgttttggaaaacaactaggggttatccatcattggcatgacattagcatttcatcaagaaacgacctgcacacagcactgaccggccctttattatcagtcataactggcattaatggcaagtcatactcactttgaaaacaaatgtaaataaataccaatacgataaattcaccatttaacaaatcatacgcattcaaaaatcaacagtgcctccatatgttgagaacaatcaagctaagaaaaggaacagacaaattaaaagttgtgcacagggacaataacaataagcaaaaaagagaacataagacaatctaacttgtgcaacagtgaggtctggtgcctcaagcttgcggtggagatgagggttggaacggctgaatctagatccaccaccgaaggatccaacctctataagctcacaacgaggcggtcggcgcaatctctgccctgagttcccgagtcttcgtgagctcctaacatagtcatcgactacaaagctaccagatctgccatcgctctccctccttagctagatccgctaccagcaaatccaaggcttggccatcactcctagtctctgagtcaccgttgtcgtcgtcttcccattcccaagccaccaccattgttcctgcaaatcaagcactccaactccatcgatctcctcccctaaatctctcccgtgcaacgaaggaagcgctacaaggaccaaatctggttgcaaccctgccagatccggtccttgcactgcctcctcccctgcgtcgaggaggatggaggagcaacagagaggaatcatgcggcgatgtttgggagagccgaaaggaggtacgtagtagtagtgggaaggggagtgggggagggggcatatcggtgagcaaacgggcacatcaatgaatgcggagagagagagaggagaggtgcgtctgcgtgtgaaaggagaaggagcgatagcttctaggcaagagccaagcttggacttatgtatacacgcgttctgacttgactggctggactgctttaattttgccatatggtttcaaaaccaacaagtaccactaccggtttttaccgttaatagatagtaatatttactatcagttcattaataaaccgcctggaatagtatcgttatattaaactgagaatgatattaatttcagtaacagttttaaataaaccggtagtgctctggttgatggttttgtgcgatagggaagttatagaagattgaagtctcatcctttttaaccatattatttacttgagtttttcattgcgctttatttttttgctttatatactatagaaacttgtaattaataagagagatatattgttgtaatgccgaattttagtagaaagaattaagaggagaggataaataacagtttttccggtatcagaggaaattgatgcatgcacatatatatgttctgtaatttggtaagcaagctatgtccggtactctcaaagtatataaagcttacataattcatttgttgtcctgatatctctaaggtagcttgttgccctcgacgaggacataagctaacgacacttcagttatgaaataaaaattgtaagtagtataaattaccattttacacacactgtaaacttaatttacttctgctcttaatttacttctgctgactcgtggaaaacatcagcagttcagcaccttgacctccatgaacttctctgggaagaaaaaacaattgtattcagaactagaatatctctgatatatagctgggtgcttgagatttcagcaataatttttgtcaatttgaatacttcgcagcaaattcagcaatattcttgtcagagctccctccttcctgcattgactccttagctttcttcatcaaccttgcagcattcctcctgtagtcctccttcctgtcaccatccatcacctcccggatgcatctctctacctcttccctttgtaagctgccgctcttgtccagctgcactcgcacgcccgtgccccacaagctctccacatactttgaaatggttggttggtcagcccaatgtggcattgccacaagcggtatgccattaacaattgcctccaatgtcgagtttcatccacagtgcgataagaaacaacctatagatgccatatttggtgccaattaaaaaaaacttgcatttagttattgttgtctactacttattcactagtcttctatatactttttgttatcaagattaatataatttgagttcttggttagttccaatacctgtggccttgtgagcaagcacctccagctgggggcaaaaaggaacaattagtcctctcttctcacacttttttcggagttggacagataacttgtgctcctcattggacctgacaacccaaaggaatggcttgccggagttgcaaaggccattgccgagctcctccagcttggctacgtcgaaggtggagattgtcccatacgacacaaggacgacagagcgaggaggttgcttgtccagccattccatgcatggcacggtgctcctgaagagattgaacccgtatgccgtgttcgaccgcagccggccgtcgtcgaggtagaacgacggcaacaacgggccgaccgtcttcccacgccatgtcgactccatgtatgctgcctcctgctcatatttcgcaagcaaaatgtgtaacaatttgcaatgcaatgatcctctttggtaatacctccgtttcatattattataagttgtttaactttattctagtcagatttatttaagtttgcttaagcttataaaaaaataatagtactttcaacacaaaacaaacatattgtcaaaatatatttattattagatttaatgaaactaatttgatatcttatagctaatttttgtataaactatgttaaatttaaaaaagtttgagtcaaacgactcgtaatatgaaacggagaggtatgttgcaatgtaagctggacggaagcacacttaattacctttggctcgaggtcagtgaaggagttgacgagaatgtcgtcatcgtcctccagtccggcgaactgctcgaccgattgctcacagaaggctggggtcaactctggcgccgcgacgaacggcggcacatcgtcgggccccagctcgacgccgagcacaccccgcgcgtacagaccgctcgcgtccgtcggcgtcaccggcagcgccagccgccgcgcgcacacctccccgtagatgaggtcgacggcgcacggctgcgacaggaacgcaacggtggccacgccggcggcgcgcgccacgcggcgcgcccacggcaggtgcgggtcgtacaccagcacgcgcgccggccgccccgcgcgcgcctcggagaggaggagctccgccagcgtcggcgacccgtgagcctccagggtgcggaggtactccccggggtccgggagcgcggccatgccgctggcgtcgtcgaagccgtcggagatggcggccacgcggaaggggtcccccggtggcggcgtggtggagagcacgtactgcgtggtgacgagggtggggcggaggccgtggtacgcgaggcggcgcccgaactggagcatcgggttggtgtggccctgcgccgccgggaacggcaacaggagcacttgcccgccgttgttgttgtcctcgatgttcgaggtggtggcgctcgccgccggtgtgctcatgctccccatgatcttgtttggtttgtggtactggtatgcggcggcccgcggctgctgtgtgtgttttgagtcagaaggattattaataggagtgcagtggagtgacggccaagattgcttcctgcacggtccaatttgcggtgtacactctttcaggggtgtcgggagccttgattagcaagtaaagggtaatgttgcacgtgttgtatcacaaggtttgttttcttttttacagaaaccgcagatcgatgtagtcagacataccactatgcatatgcacaccagtgtacacgctcgttttttttgaacgtctcgtactgacagtgccaagttcgtattgataaagtagaaaaaaattacaagattacaaccttgagaggtcataaccagttaaaaaaatatatcaccacccacacaccgacaactctaatacacaaacccgggggaggcgctagtaccgaccggccgccgctaagcgtgaccgaccgccactagaccaacaaaggaactacagccgagatcgtccaaaacctaacccttagaagcgacatgaaatcccgctctatccacatctttgggattgagggagagagggtgagagagaagaataaaaccgctctccccctaggccctccgatttagccaacttgcataagctagatcgccgacataagaggacgttaatctagagcaagcttgcgccacttgtttgggaggttttggcaaaaggttgcctagacaacatttccaaggagagaagcgacggaagcactgccatcgccgcccgtcaaggtctcaaagagaaccgagactaggctttcacccggccgacccgctagagggatgagacggcacgacaacgccctcagaagggggagtgacgctcgaaacgccaccgttgccggcccgaccaaggcctggctgggttttcactggccgtccgccgcctgcctatccaccgctgacacatcattactccaccaccatctaaacctcttccagtgcgtgggcaccactgcattggcgccccccccccacacacacacacctctcgccgtgtcgccaccggtcgtgcctcaacgtgatgcaccagcatgcacctcgccggcctatgccgaccacaccttccactgcgccggccgcatctccccgcgtcgcgctggcctccgctgccggcagctattggtatttcttacgaccacagataaatccacaagtgcacggaataccgccgtagcacttcacctccgagtgacctcaaaaggatatcgaactcagggaacatgtgtaatctcctgaagactaagtccatccaaggacaacaacaattggtagactagctaggctagagagggctttcaatgtgttttagttatctaagctaaattaaaggtaattttctatctgctgctttgggcactgaccctactggtctgccagcgtggttctggctatagctctataatgtacccgaatgtgaaggattattaggacggaattcagagctgtcaccacctgtcgtctacctctaacaaatctatgggatacacaacaaacaaatgtaatatgtaacctagacaccacacctaagttattaattactactctaatcctagtactagagcacttagtacgaatactaaacaatgaacccgcaagatggaaatctatcttacttagactaagtaattaaataacataagaaaaaatcttgaatgcttactttatagaagatgtttctccgaactcggagcagagtgtaccgacagctccaatactcctccagaattcctcctagaaacctacactcgtcaaggtagaagtcagagagattgccaaactttcaagcactcctccagagcttccactcactatctaactattttctaatgtgtaaaagatataatagaacctcttgtaattcagctcaaagttgtgtgccttggaagtgagatgagctcatccttttataggctccatatgacagttaaagccatgggaaatgtccaaaataccctccaaccgtcattgaggagtaattagggacgtacatgtggaaaatggcgatcaacggcgccaggatgggttcggccgaactggtggttcgtccgaacccaaaagcccacctcctagcctctccttcagctgggaggttgcttaatgggcccccaacatcatgtattataatttggcttaattctaagtagctttgattggccctccaatccgtgtaatcgcgttgtgattgtccggaggtgtattttgtcgcttgacgggtggttttcatccataaaatacctgcttacacctatttcaccaacactgtggaaattattagtaataatccctacactaagttggataccatattttatttcattatatacaggc

SEQ ID NO: 74670 - DNA, 3333 bp, Oryza sativa
ctgaaaatgcgatactcctataaggatgaccaaagtacactgcctagtcttcatctggcaaattggtacacactgcacactataaacctgcagttctactctaactgaagacctatttacagagttacactactactacggtactaccacaaaaaaaaaagaagggggagggggatctgtacacagccaaaccagctgaccaaggccgtatgccccgtatccacattcacatattacaacgacaatttataggcttgccatcaagttgatttcagccggtccaatctgaacttcgcctgaaaaatgagcagatgctatataaattcaccgacagaaagcccttaatctttgcaagatgaattcagaatcagtgcaaggcgctactgctaaccatcatggcatggatatcgtcaaggaagggcttaagcaactttgcgagctttcgaatctcctccttcagagcagcacaatcttggcatttgccaacgagcaggttgatgaacatcttcctgtcaggaatgagtttcattgcgatctgttcaccacgtttatcaaattgtgtcagccaagtgcaatggaaccaaggattgatcattttcgacaaaatcgatgccccaagattcagtaaaccctgaccttgtaggctgctgaagagatccacccatgccatggctttagagtgaccatgtatgcagattctacaagctgtgcaaaacacttctgatcagaatcctcctccaatctctgtaatagtgcaatagtgaaatccatggatctggtgacgttagaaaaggtaaatacaaatgagaagaggcatattaagcagcctacgtattgcatatctcataatgacatgctatgaaagatcgaaattttcaagcgtaagtgcatatataagagaagaacggaagctcattacatgggctgtcttgttttacctagtaagccaaagaatagctctcgcgcagctatcaaccttccttgcagtgccctcatctacctccttctccagtatctcctctagattatagtatttggatgggtccaacaagtacaactcctgcagcctctgcaataggcagtaacagatcagaaaacaaaaggttgcacctggattttttttcttcaaaattcacagaaatgttcaaaagatatacactgaagtcagccagagtcacccattagtaaatagttggcaccaattatttgcaacctactagcataataacgttcacattttcatgccaagacaaatcaactctccacttggccatcactatcatgaccctgtcaatatgctctttccaagcctagaaaaactttaccttcaccctctcctgataatcttgatcttgaaaatattaaggtaaaacaaaacaagaaaaaaaacctcatcctctcgtagaggaaaataaaaaaggaacaaaacaacaagagagggacaccgaagtttgcgtctgaaaatgccccacggatgaacggacggatgtgaccagagcagttgaaggcctgtgtgaggcacacgcaaaagcaaatcttgaggagaaaatgatctgatcggatcagatatttacaacttttgcatcgagaggaaagccctaatcctatctcctttgttttatctcttgtcctgccttccaaattccaatcagtcgccgtctcctagtccaagaatcgagagcgccggaaagagaccgtaaataatactatgatgcaaagactttgcatgccgagataaggttcctggtgtttgtggtgctggaacttgcaagtgattcctctgcagttgaagctgcagttataagctcacgcaaggagggctcgtggtgtgctcgaatcaatatgtgtttggctgaagggacacgatgggtcaggatagagcgaacccatatttcagaatgtttggtttgatgaaagtcaggtcaagtcaacaccattggagtcatgacctgataattctatgctagtagtacacaccttgaacaactcggagcaggggcggatccagcatgggggcggcggggtctcgagtcctcacgaagaccccacattttaccatacgtagataggagtggggactataactttatctataactttatctagtttgcttagaccccaccgctatttaaccgccaccgacttggaggagtaagaagagattatcggctgtcgaatcgtgctttgagattagtgcgaatatccagaaggtggggggcctcaagaggcagctctcaactttggcaaagcaaagcagtgactgtgagcccagtgacagtgtcaaaaggaaaattaattagaggttagcctagctatctacgtggcttaattaaaacgaccggttgctttcggtggctactggctagccgtgtggccggcacgggacaggggaagcagccacaggattacgcttccctacatgggaccgcgccaacagctctaatctataaaattagtagtagatgtgaattcttggggtatgattatttggattcacaacttgcaaccttttttgtttcggtttcttgctctcaagtcgagcagcaggtaggggtgtgattgagactctgtgcctaccaaccatacaagaaggcatttttagttagctaggattttcatctgatcagggaactaatgctttttttgagagagagggaactaatgcttgactagtaaaacctttcttctactaactctgtcttaaaatatagcaaattagacataacatgtaacacgaatctgtacaagctccttattcgtcgtagaattttgaatctgtacaagctccttattcgtcgcataatttttcacgatctcgcagatatatgtatttttttatcatgatttacgctaagaaatggtaatgatgaaaaactgtaacatggcgaaaatatttttagggacaaatatgtaatgacaataaaattaaatactagttctaaatatttgtaatcagtagccaaactctaagatcatgcagattactagtaggtcattaggtacagaaggaatgatttttttctttttgtacctcgatgtttcgttggacgtcgagcctcagcacagccatggtcggaccgatcttatctgcaaacgcccatgtaggagtatcaccagagaacagtaagaacaagcaaaagcaacaacgacaaagcacgcaggtcaccatgtgttcaaatgaagaaacgggatgcgatacagattactggcaggtgatggcagatagaggagtaaaccatgcaatggcatgtaaaaaaggaaaaaaaatggaagaattggagaaggaaggatgaattatttttgaaatttgaaccaagaacaaggttgaaagag

SEQ ID NO: 74671 - DNA, 2718 bp, Oryza sativa
  unsure (1)..(2718): unsure at all n locations
tataggtagtcattaaaaaaggaataactctatttcgcctccctaaactcatgcccctggttgaaatacatccctcagtcgtaaaaccgggtataactcatgccccaacttccaaaaccgtagcaaatagactccccaagcggtttaaggggcggtttcgtcctacatggcacttacgtggcgagttgacttggtctttataccacgtggggcttacgtggcactaaaataacaacaaacctaaatgggacccacatgtcagtgagtaaaacaataaaaataaatttcagactcacgtgtcatttacattgtcacctcctcttaaacctctctctctctcatgtggatgttggatggcagtgacaggcaaaccgtgtcggaagtggatggcggtggcggcaagacgtagcacggcggagggcgaggactacggcggaagctgccgagtttgacggctaggtcaacaaggtcggcggatgaactctccactgcaggcggcgcgcgagcgtggtagcgtcaatcttggtgaaggggatgactccccacgccggctcagcagtcagcatcctctcctcctcgccggttccccacgccgccgccgncttctncccttcgctctccttccctaacgccgacctcgtcgtctgcctccgcctcgacccctgccccgacgacaatgcaaatttcgacgccactgagtatcaccgccgctatcccgaactttttctttgtttataggatatgaaagatgtaaaaaaggcttaagaatattttaaatctacaagtcacatggttggttcttgtgaagaaaatatcaaaaaaataacacaaaataaaaaagttgcacatctctcctctacactagagaggagaggagaggaaaagaatggggttggggccacattggtgcactccccctgccacctcggcgccgacccgccacggtggtaggaggacggcaccagagaggctggcactgtcccgttggatgactggcgccagtgattctggtgctccaaaaaggatcatttctgggataagtttttctaggggtctatttgtaaaataagttttttaaaagaaccaaattgtaaaaaattagaataaataacctgtaaagaagaatagatttttcttttgtcaaacaccacatcattcctacaaaaccttaatggccaacaaatagttgttgcccctaacaggataagtgacttaaggcttttcctaattccccgtagcaaattaccaaacatgttggatacaccacgaggcgggaaaagccctgtagccacttgtatagtgcaccacacaaaacaggcaaatttgcattcatgaaacaaatgtaaaattgtctatctttgtgacaaaaggaacaattcttaggaagctatatcaaatggacccttaggtgtttgtacaattcaatgaaatcaatccatttcaaatgtttttctttctctaaacaagattttcttttcttcatagggataattttttttccatctaagaatgacgcttttttactagacgtgttaagatttcttctaaatttgttaggcataccctcaattactacaccagtccatgtgactctagctacaaacactagttgaacctacaatgcattgagttaaacatccgtaattttgacattttaacccttttgataaacgtattctataagtaaacctggacaaaaaatataactaaaaataggccttcacctcagcatcacgggccttggcattgaggcccaacatcataacgccagacccattggctgtcacgcccagaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaaacctccacaccatcagcctcattgtagaactcttcctctgatgaatgattgcaaggtgagtatatgacatactcagcaagccacgcagcaaatatgtaagtgcacaggataacaaaggatggcataatagggttgcatttgcaaaagcagtatttagcaaacatttgagaatttaacaaaacagttgagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtaacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatac

SEQ ID NO: 74672 - DNA, 17694 bp, Oryza sativa
  unsure (1)..(17694): unsure at all n locations
tttgtgtacgagactatttagggggattgacagtttgacatagtgttttggttactgaaaatcaacatcttattgtacattttcaggattctcaacaatcgggcatctgccacgaagtcaaaggagaaaaagatgaagcacgtaggggagcttcaacgcaaattgcaggtgctgcagtcggaaactactacattaggtgcacaagtgacagtgatgcaggtatgttttcaaaacaagtaatcatttgattaggagttttcacaaccttagttactgttggtgttgtttgtagaggaacaacaatgagcttgtatcacagaacaatgaactgaaaactaggttgcaagcaatggatcagctagcacagttgggagacggtaactttccttccttgtttttcagcatttatttgttcattttttttcaaagtagtaatcttgcatctgcaaagcatgttgtatcgagtatatttcaagaagaagaatgtctttctttagaaactacattcatcgggcatcgcgatagtaatatatagcatctacaactaaaatacatagtttgaaatttaaaaaattgtgcatatatttgtacaactgtataacaaaatgtcttttattgctgaatggccgtgatttgagaattattgtttcttataacaaatgttgcttaccatacatcaagaacatgattcggatactataagaggaaaacagttcgcacgatttaatatgtatgagagaaggtaacatgtcaaagaaaaactttacagttgttttatatatggtaatgtctataatcaaaactaaaattgaaagttaaaatagaaacaacaaacacttcagcaacccaaaatattgtattatgcattttattaataatggccgttatttagagtgaaagaaaaataacagggttggaataaacctccacttactcaaaatagatggatagacgtcaggcaacttattcctagcatgccatcaaatttatttccttaacactattacctaaatcgtttaaccttcacaataaatgttttttgtcaaggaaaggagagaacaaccttgaatctatagaatttggctatctattagcagcaatgaatccctacatactaggtacaaaacacccaaggtttcttaaggagtttatatcagatctaacttgtagttcctatgatataaaacaacagttcgatcataacttatatgtcaaccattgtatgaaatgtattaaaaaaatctaatcacatttgggctaaatgatgtaccaaaagtatcaaattggtggatgaaaatggcgttgaaaaaaaagagaagtgaatgtgctacttttattatttatcaaccctcccaaatcactgtgaaacatgatacgactctgtcgacggaaagcattcagatatcttttgagtactgatcctatgttggacatttgtcaatcaactatgtcagcagaaagcattcagatatcttgtgagtactgttcctatgttggacatttgtcaatcaatagtgaacgacatatctgctaatagactcttaagctcgttagaagttagcaggatttcatatactagatgatgccctgcgtattgctgtggaaacttttataatctagttttccatagataagagctaaacattagccttgacatgtgtgagcataaacaaagcttattataatggttgtaggctttgtcagcttacgctctcaccaatatttcaagtcaaagcacttcaaaataaaactaaaagtgtacaaaacaacattattacaaatgaatctataagcgcaaagggcatggttgaagattctattcaactttaccgcttggacactgagctagaacaaattaagagagagagatgaacctgacagttcaatacaacctaatatgggtaagtaaaaagtaagaaataaaacacaacaattatagagaatccacgccaaaatagtcaaagaatacaaactgaaaaaaaatctgctgagaaactgaagaaagataatgataaaatgataatatatcaatcagtaatataatttacaatggaacaattagcatagcactacctagcatggagtacagattagtgaaaatgtgggacaaatcttttgcacctacctattacggatttggtactgaatttgaggaatgcatccaagatttggtattgaattgtggtttccatcataaaaaataaaatgggtttatatattgtctccacaaatgggagatgggccaagagatgatcgtcactggcaatggaagatgtatattataagtatttcttgtaaaggttatagatgtcatgattaattaccatgaaagtaaataggtaagataaaacggctagctagttgattaccatcttgtcagctacatgaatcctatcttactataaagtaatcccccactaactccttaagcttaatattcaaagatgccacatcatcatccactaataagatgccacatcatcatccactaacaatcatcacatttaaacatcatgcaaacatgctatatctttatagtttttataatttaagagcttttcaaatacaaatatgttaaattatcatccaacataattcacataatgtttcaatgtatatcttttatgatatcctatatacttatacagttcatcctcacttagttagtgcttaaatgattaatctatggtccaaattatatttctctttttttcctctaattaagtcatatcacatcaattgtttttagcctttagatgattaatctacggtccaaactatctttctactttttttcttccataaagtcataccaccttactttgaatcaccattctacatactatttaaatttaaattatcataaaccacattaatttacttaatctgatattatctagctatcttacatgttattttttttgttatcatactaaattctcgcagcaatgcacggggtttcacctagtaattagagaataataaaccagcaagcatgtgccttttgatgcgctacactctagctgcctggaggtgagggatggcaatatgggttgggcaccgttcttcttgtattgcattactcaatttgtagggattggaaacaaatctgggacaaccaatgttaatctagtggcttaaagtaattcagatgatgttgctgcaacagggttgagagaattagtattaattgttgttagtggggatcaactatatagagttactagatgaattcccgtgcattgttgtgggatggttgtgcatacagtaatgactttgaaaagatgtcactacaaaaataatgaaagaaaaaaaaatctgatgcttagtatttagaaataaaacaacatttactttgaggtgacttgaactattaaaagaatcaaaacactatttataatatttagaacatgaactgcttacggtagttttactttttctttgttttttaaaatggatggttaggacaaaatctgttgatgattacttatgcatatgttttattataaattactttcggttgtttcattcatttttccatgacttcgtagccgtagctcaaacgatcatggatatattgctttatttattgtttcatattgttcttgcctagttggtcacgtcgtagattaaaatagatctgtattctatgatttggtacacaatttccattgatttgcaatgtgctgtctcattgcacttgcctcattatttactcaaggattgcctgtcccagatagttctgtgcacactatggctccagttctgctaactttgatactcacatattaggctccctcctatttgtggggtagttgggtggaggaagtagtactccaaaatcctttatttatatttatggacaaatcttgaacccaaaatcccttaaatttttagagggagggactagttttttccttggggcctatagcctctagttgaacgcaagacgatagcaagagatatatggagagaacaagacaaaagtaggatatggttgagtgccctcttgttgatcgagatcgtctcgcagggccttcgattattgcggattgcagacacatgttttcaaactagtaaacggtgcatttattttaaaaaaaaaactttatatatgaaagttacattaggaaataaaacaaatccattctttttgagtttgaaatagttaacacctaattagtcatgcactgatggagtgccttatctggtaaacaagcctggtgtaaacttgataataatagagaaaggcatctacgctttagaattgtttgggctctactttggtgtagaatggtgggcaagcccttttctagtattattacttatttgcagttaatactcactctgtcctcagttacttgtcactgttcaccatcactatttcaattttaatcagtaataacttttaaacaactaatttattgttaatgaaaattatatggttaacggtacaacacacattgctaatataatatggtggtatacttttatgtttatccttttctttgacaaatatttgaaaccagagaaagtacaacactaggccacctttctagcacacgtgctaaaaatataaacttcaaagtgtactagacaaatgattaaatgaaattatgtcgagcagccttaatgggaattttgtttgaagaaacactattatgtatgtctccaaatcagccatgaatattattcagggcgaacctttaggccctgctgccatgcattttatgtcagcatttacatcagtaaatctggtccataacattttttttgtctacttttcttaatatttgttgtctacatttctttgtccagctctgacttcaagattggctgctgaggcccagcacctaagagctgttgttagtgagatcagtgatccaaatctgccaagtggttcacaccaacaactgagctctgacatcgaccaactgcagcagctgcttacacagaggcagacatcacaaatccagcataatcagccacaataaactgtggaacttttagggtgatttctcataagagacttttgaaagggttattgcatattatattttgctaaatgatgggtaataactttttattaagataatggaacaaaatccgacctttgctcaatgagctacaaccaattattacataaaattgctcaaaagcaatcacgcaccaaagagttcacaaaaacacaccaaatttaacaaaacgtaagaacaactaataggcatcaacacaaaataaagaacccacaatttattgaatcctatttgtaaacctccaccaaagatagcgaaaagctgcatttccgttgactcaagtttatgacatgcattatttattagctagcttgatgtcatcacacctttgtagttacttttctttgttgcacatcattttttagacaaaaatgtaattgcaattatactagtgaactaagtatacacaacttctgaaagacaggcataatcacggtttcggatcagtcatttccaatttgcatcctttcacaagtgtaggggcactaaggtattgttaaaaacttagacgaaactttttcttcacgtctgactaatgaaagtacatctaggcccctaattattttgggttaattggattcatgccattgcaaatatgccgattcagataaatacaattataattcgtctattcgtatccatgacattcgaaatcgcactaaattgaaaccatgtcatcgctgtcacgttttctgtatcaaaatactcctagacatatgacccacatgttagttccatcttcttcctccatcctcccctcttctttcttccaaatctctctcttcctcgtcattgctggagcaggaggtagagcagtggtgtgttacgatccctcttgacctccatcaatcaacagcaaggagaagggaaatactccaattccaacacaagatatcaagtatttgagatacaacttgaggaagggattgaatcatagacacgggaatcaacaatctagaatgggaagaagaagcaagagattggggaatcagagaattggagcttgaggtaggagagcatttgggaagaaaggagacaaggcatttgcctgttcattcatatgttcatccatgatccaaagaactgcagtgtggcttggttttatactccttgctgtttggttgggcctagagccggcccagcccatgtacatgacattctcccctcctcgaaaatcggcttgtccccaagccgatatagcggttctgccgggatcccatggaacatataaatcttcgatgcaggtagcattctcatcactagtttttcagaatattcttgccttcatgtagtttaagtagcaatttgtccagattttggtgaaatatgaagctccataccactgtgctcttgtgcttgagctgaaatacaaccatgagtttacgtacttgctgagccccttcactgtccaatctcttgctccagaaatcagcattgagatgtagctggatcccatggtaacttgaagcataaccccaataaaattgagatgcataaccattttaacaatgcacatttgcttatccatatttgctgatgtcattgagccttctgagctgatgcagttcagtttcccaactgatgcaattcccccaggatcccatggccttgacatagcatattcttgaacttgggcctcatgaaaagcagtagcttgcatgaagtaaagtatggctactagcagtttgatagtctcaagatcccaaagctatgtcatcttcatctctgttattataatctgctgaattgtagatgatactttgaaatccaagtgacgtagatttaaggaataacctatggagaaagtgaactggaataggctctgatcttgacagcacttgcacaaatcatgaacttgatttagttcttgatctccccatcttccaagagcaggccaagagcgtagtttaattagctttgtcattgaagccatgatctgcagcaatggttccaggtcagccctcaaactaactgggaagacaatttgcagtggtcgtagttgtggttgctgcatgtccttcctaacatgtaaaccatccaagtgatgcggatgaaaaataaattgccagtgcttttcagtatgcatggtcaacataagctgctgcatgaaccaatactccataatgacaaataaatcaagaactgcatttgatttcctctgaacactaagtccttgcaaaccaaattctcctggatcccaaattattcccaccaacagaatatattgcagatgaagtgtttcagccaaataagattgcatgtgaagctcccgaagatttactgagcatcccctcacatcaaagttgctcttggcaatcaattttcccatataagtcaaccattgaacattttgcaaactatcccaaggtccaaacaaaaacagccattgaaccttactcgatgtcctaccgagtgagaaaaatgctccaacatcagttttatctcctgcttcaaaaagtgctgaccgaggattcttcttgccttgtttccgtagcaattgcccctgctcctgaacaatagtcacaccaatgcgaagagaaagatcaggtagtgaccatcgttgtaggagatacatcacgtctccgctactttcattcaattgtggattaggccatggttgtggctggtgctccactcgatcacctttgcaattggctttgagaaggtggccaattccatagaaacttcactaccacgccttcactgccttgacttagctgtggatcaggccatggtaagggccgagaaccgaaggtcatctcagcttggttccatggaattactgctctccaaggtggtactggtggtgagctagctgtgtattctgagctccggtcaaggcaactatagcaagtcaagtaaacgacagaaatagcttgatggccaaaccatggattgttgaaggatgtttgcagtaatgtgaacttggaattcacttcagtgagctcaactaaatcctcggtggctatgtcatcatcatcatcattgatcatttgttcattgcctttcgtcaaacacttggtaggtgtccccatacacgactcattagtatcaaccaagctaattgaattggcctcctttctgacctccatgtgttgggaactaattcagtgttggtgctcgtaactgccaccactctggtgatatcaacgcttgcggttgactcaaccttgatgtcgcagcatgtcacgagcatgttgttgagcatggcaatcatcttggcacacaactcttggaatgtctcctctggtttcatctcagatttgtccatgtcggcctcatcctccttagtcgcggtgagggaaaccggtggcgccgctgctgctaatgcggctgagggcatagattgactcatggtggccgggaacacatgttccaatgtggtaggagtgctctcggcatcggacttggtgatggcacagcttggtaccagcatcgaacacttggtgggtgtcagcactgcaccatccttggaacaaggctgcacatgctgagcctcgagtaggcaccctccatcatagatgtggtggccatgggtggccccccgagccttctccgcaccacctctcgcccggaaccaaacaagagcctccactcgccatgcgtcggccaccagtatatgcaattcctccgctccatagatgtcataaacctggtgcaatacctcattggtcactgggtagatgatgtggctcacttggacatgaagagcagcacctgcaccagttcccaaccagctcggcatttcatcaaacacctagcaggtgcctctagtgcaactacctccaatgcttggattcagtatctggaagtcgctgctgcaaccgtgtgtcgtccaccttgtctcctggcatggaatcccacgaaccgacggctctgataccatattgttacgatccctcttgacctccatcaatcaatagcaaagagaagggaaatactccaattccaacacaagatatcaagtatttgagatacaacttgaggaaggaatagaatcatagacacgggaatcagcaatctagaatgggaagaagaagccagagattggggaattagagaattggagcttgaggtaggagagcatttgggaagaaaggagacaaggcattttcgtgttcattcatatgttcatccatgatccaaagaactacagtgtggcttggttttatcctccttgctgtttggttgggcctagagccggcccagcccatgtacatgacagggcgtcaccgctggagctgctgcggctgctggacatcccatgggtggactcctgagcgagtgccaaatcctgctgttcccgtcgaccatggcatacatgcccaccagcttcaccatcctagcacaccaggcgtggcacacactcacgctgggagcttgggactaggcaccaagtagtccaaggcggtgctcttatgttttgagtccgagggaacgaagaccgccgtcgactagctctggccggctataatcccgctcggggacgtcaacaagaagctcatccgggggctcaccggctggcagcgagatggcccggttcaagttcaggatggtctgcctcatcatctccatctccacaagttcagcgagatggccctggtcgtagtagctcactaatccaactcttcaagtgctcttgatagtttcatcagtgcaggtgttccactttgtccacaaaagaatctgcatagtccgattttttgtggtccaattggtttattccagtgtcagtgttccactttgtcccgctagaaggtgttcttacatatctactgagcccaggaggaggaaggtagagagagagagagagaagaaattggggaagaagatagaaaatgtgacggtgaattggtgatgacatggttctaattttgttcatattcggatggcatgactacaaatagatgaattatagtagtatttgtctgaattggtgtatttgcaatggcatggatccaaaataacccaattattttgatggttaatgataatgttattagtgaggactaacattttaattgagaatatgtgaaggaattttagtcctctaagagttgatgttcaaggcaatagccattcgtgtagcaaaaagatgaaaaaggtaaagattcaaatggtaaaatgttttttttcttgcttgtgtcgatagggaagtcgtacaattagatggcatgttgtctcctaggaatgagtttggtgctcaaaattgttgatgaagtgttttttattcttggactttacattctcccaatatttggaatttctaagagtggtttttgaaatttctagagtaaattttggaaaactgcaactatagtaataaaactatcagtttgctgcagcattaacgacctatttcagtttgttgcaaagattgcgtgggaaattatcacaaaagtgcaacttttacgtggcctaagcatactattgtcacctacatgtcgtttagtagcataagatgtaaaagttgtagttctatgataatttcccacgctatcgttgcagcaaggtgaaatatgttgctaatattgcaacaaactgatagttttttccctatagttgcagttttctgaaatttactcagatttctaaaaaggttacgccttgaaaaatgctcgttggtgattttcgcaagttccaaatactttttggcattctcgaaacggtcatggctagccaaaatgctctcggtgattttcgaattttccaaaaatattttttcaaaatttttggaaatgtgaaaaagctctctagtgattttcggaaattcaaaaaaagtgtatttcaaaaattttgaaaatttgattttgctctttggtgtttttttggattttccaaaaatggtttccagatttctgaaatggtaaaatctgtgaaaaagctctctgttgatttttggaatttccaaaattctattttgccgagtttctggaaatttatactgttcggaatttccgaaaatgcatttcaaattttccaaaaggggaatctttgctcccatcagcaaatatgtgggtgtgcctataaatagtcccccttcacccccaagctagggttgctgctcttattgcacactttgagtcgttggcttgctttgacttgagatttactttaaaccttgctttctcacttcttcctctccactgatcttcaatcttagatttcgtgtgtgtgtgagagagagagaaagagtgagtgtttgatttgagtttgtgtgagtgcttgatgttgactataaaaatttattgagcatttgattcatccccaagagatcattgcttcgtttgttactcttggtggttaaggacacctaaacgggttgggatcaacctcgaggcactgattcatttgtggtgtgccaaggaattttgtgaaggtcgaatctcactttcaaaagggacgatataccactaatgaaagaattgtgcatttgtgcaaccttgaggatagggttgaaaaaggacccggctctttgtgagctccacaacggtgagtagaatcctctcacgaattcgaacttcgggaacacattaacttgcaagaatcccggtgatatccctctcttactcctctagctttgttattttgtgctgctagtagtttagatggtgcattccttccatacttgtgcctagctagatctagtttaacttgtgtatatcgctttatctatgattttcagaattttcataacttccgaaaagtattgctttcgtttttacttaaaaattttaattgtctattcaccccctctaggtcgaattgaccctttcaaccaactacaaatctaagtggcattacacatttattggcatagtagtcttgtttagggctaacaaggcaagcttcaacaatctcaagtgccatcttgcatgcaatccatgccatcgcttacaagatcatggcctaaataaagcacatgccttgaaagaaagacgcgatgggaataacctgttggttttatcacacatgcctttccatttctgcaaggcaccatacaaaatgaaaaaaagaattttgccatttgattgatgccttctctcactagctttcggacctaacatccatacactgactagaagcctcctccaaaccctagtccccgccgcttcccctaggcttgtgcccaacatggaggatggcacccactatagttctcacagccggaagggtgcattgatgcgcgccggcccccatggtttgtgccctagtccctaggcttgtgtccaacatgaaatcctatcttactgtaaagttatagcccactaattctaaagttcaacatgcaagcatgccacctcatcatccactagcaataattacatacaaaacttacgtaagcatgaaacatccaaaaaggctaacgggcaatcgatcgcccctagtgatcatccccccctcctccacatagtttcctttttaggcaccacattactttcctattttagtaaatttatgcacctaaagtttgtacacttccagtttacacatctaaattttatacacataaagtttagagacccaaagtttataagtcaaaagtttatatatccgattcaatttgaatttgaattcaaatattttttacatatagtatttctatacatctaaagtttatacacctgaagtttagagacccaaagtttataagtcaaaagtttatatacccgattcaaatttaaatttaaattcaaatatttttatatatagtatttctatacatctaaaatttatacacctaaagtttaaagacccaaaatttataagtcaaaagtttgcatacctgattcaaatttgaatttgaattcaaatattagtttatagatccaaagtttataagtcaaaagtttacatacccgtttcaaatttgaacttgaattcaaatattttatatatatgtatttccatacataaatttttctaactttattttcttatttttttaaaaaaatttatggtgtagtaggaagagaagaaggggaggaggaagggggagaggagcgtatcgggggatgggggcgatcgctgggcgattacccgcccattagccacacatcatctataattcattggattctacaaatcaacatccaatcatcttccttcacattatttttcataatatttttaacatatatatccattatttttataatacttaacatatattcatccatataatcaaagtgcgagatatcatatttcatctacaatctcatacagagtctaccaaatgtatttctctatgaacatagtttgacaaatcagttttatttgttgttaataactaatataattttaacttaggaatttccccagcacatcgtgggcaattcctagtgattatagaaacatcaaagcgtggggaattcctagtgactatagaaacatcaaccaaattaagctcctttaacttaattttctttgatgtgaggcaataacatttgagcctctctaccaagtggcaagtctcagtaagtccgggtgtgtacttacccacgataacactacgtagtccatccgtcttataaaaaactaatctactaccggatgtgatatatcctcgtactatgaatctggacatacatctgtccagattcatcgtactccctccgttttgagtttttgtttgcaacgtttgaccacttgtcttattcaaattttttaaattattatttattttatttatgacttactttattatctacagtactttaagcacaacttttcatttttcatatttgcaaaaaaaaattgaataagacgagtggtcgaacattgcaataagaactcaaaatctcttatattgtgggacggagggagtattagaatatgtcacatctagtgctcgattcgtattttatgggacggagggagtagggttgtgccaccaaaacaatttaagttaaattaatataaacccaaaacaatttgtttcgattatataccgtgtatatgcatggcaatgtatcttaagcgaatcaatttaggctgtgtttatttcacttcaaaattagaaatttggttgaaattggaacgatgcgatggaaaagttagaagtttctgtgtgtaggaaaattttgatgtgatggaaaagttgaaagtttgaagaaaaactctagaactaaacccggcgttaatgccaaaagtatgaataaattcgaattcaaaaccgtgttcagaaacttccggttccggacaaaattatttagcactgaccagctgtggaagaagattccacacaaacccacccctccctctccccttccctcctccttcctaccccgccgccggtgcttgtcgccgccgccgccgtcagagagggcgaggagggcggctcgaggaggagcagcagcagcagcagcaggaggaggatggggttcatctcgttcgtcgggagggtgctcttcgcctccatcttcctcctctccgcctaccaagagtaagcacgcgcggcaccatcagatctctctccctccttgtcgctggctgaccggcttctttttgttcctcgccgatttctactagtataggtcgtgcccgtttcgtttggattggttggtaggatcgaagagtcgtcttgaggcaagatccgtgcgttcttggatctttgatgtgacagatctgagagagtgggtaggtgttgttgattagcggcatatcgtcgtgcgagtaaaggcatgggattccattccactgcaaaaggagaggggggattggggatcagatcgcacgcggcgtgaatcttgaatccctgcatgatgatgcgcatatgcatcatcagtgggagcatgcatgttctttctttcggatgcaaatacagtagcatgtttgacagtttggaacactagtttgcagttcctctgatcccatatggtccaaatactccagtgtgttcatcatctgtgctcatcaattgggtatgtgacgtccacattatgagctgatttgatatctgtttgggttggccaagattgtggtgctagcagcagcagcagcagcactgtgctattggtagactgacccgtactcccaaccgattaccaaatccatcttcgtctgataacttaggtgtggcatgagtcgagtttccaacagtttgtgccgctagtggtgaagctctctcccaaccaattccaagtttatgactggtcacaatgctgagttaacatgactgttttgaacatcttacatttggtgatcttttaggttggggcctgacatttttattatctcagggtataaatatggttcaccggagaagcagcgatttggagatcacttagtgtaactgattttcgcgttagcttatgagttacattggtcagggttctgtaaactgtctactggtacaatgccatatgtaaggaacaaatgtcttgccagttattactgtatataattggtggctttgatgcataaccagtatgagctgcatggattaatgaataacacataccatttttagtataggacattgccgtggtcatgtttgccaatgttgtgacttgtgagtaataatcgaccttgtccaatatgtaacttttatttttcttgtttaaggttatgtggatcaacaccatttcaatgaacaagggtaactaaaacttctgttgaatttttcctctctttttcattagttagtattgtgtgcatgcttttttgtcccctttgctccatagcttgccaaaacctttctacttgcttgttacagtgacgttacagcagatatcactatttttttccacattatttgaaccattgaatgtatatgcttgaatctgctatcaagtactaatacaagttttctgaaggttaagataaattttgttatcataagtaggatttgttattccatatatgtctgctctacttgtctccgtggcaaaaaggacagtcatacttctcttgtcaacccccctgaattgttctccaaaaaaaactccctcttaattggtagccaacgcccaacgcttacaagtattagttcttctgtggcttgtgactcagaatttagcgcaggaattggcaatacaagtcctttggtagcctcccctgtttttgagttggttgtaaaaagtacttctgaaactctttttagtggttaaataattctttttcttctttccatgcaccttttatactgttgagaatcttgaatacaattgttcatacctgcaggtttagtgaatttgggactgatggtggaccagcagcaaaggccttgaagccaaaattcaatctatttacgcagcaagtgtccaagagcttaggaatggcagtgccacatattgatgtatgaatatttatttgatttggctgccccattctacctaatattgtttcatttacttataccattctacctctttttctacagataaagactgtcattgctgctaccatgtttcttaaaggctttggtggtcttctgttcatcatcagcagctcatttggagcattcctacnnnnnnnnnnnnnnnnnnnnnnnnnnnnnnnncacctaatgtgttttctttatgcattctgcaccatgcctacccaaagtaaaatattatgtgtatttactattgtatgatatatgtagttcttattgttttaccatataaattggcaattttagctttatttctgctttggcacagcattttgatacattttaacgagattttgtccttttaaagtcatagcatctggaaatggaaaactaacactattttcctaagagctcagtgtgcatctcattgtcagtgtagtatatttcacttgactggtgcatataagatgcactttggagtttggagtttgacatgtgattcaccatagtccaaaggccttcatgtttttttactctggaagtaaacaaatgttctgtaatcccatgaaaaacattaacccattcaaaatatatgtaattcagatctatatatgtcacagcaacactatggatctaagtattttaaggatcctgggttaaaattattgtgtaaatgtgtgctttgtctagtgtaaccccatagtatttctttccctttctaactattcttcacattctttgtcggagattggaatactgaatatcttgctcatttgtgcagctcctgtacttagcagttataacacctgttgtgtacgacttctacaactatgaaatggagtcttcacaatttgttcagcttttcgtcaagttctcacaggtttgttagcccaccacctcacttactaaagtttttatttcaaaataattcagccgttcttgttaattgttacaatccccgcatatttttcttgtctattcagaatttggcactttttggtgccctgcttttcttcttgggaatgaagaactctattcctagaagacattccaagaggagggccgggaagaccaagacaaactgaaaccagccactgtagtaggggaagctatttgtgctccttatgtttgcatactttacaaagtacatgtctcaattttcctcttgatactccatagaaattgtgaattggggacttaacagaacctagtatgtaggatacctaagtatgtctttatcagttctgttatcggtatatcccggtgtgtttcttctgtcatgaaagtaccattttgctaccgaaattggttgtctatggaagatcaaatagattcata

SEQ ID NO: 74673 - DNA, 2622 bp, Oryza sativa
  unsure (1)..(2622): unsure at all n locations
gtatctccgaccacccgcgnttngccgcctcctcctcttcctcctctcgatctctcccgtcctcctcctcctccttcggctcgtctccttcgcccgcgtccttcgctcctacggccttcgccgccgcgtctcctcctccttcgctttcgccgcatggcccgtcgtccatggcgctcgccgtcgccgccgccgcttcgctctcatctctccccgtctccgtctccaccaccatggattgatacctcagaaagtcttcggtcttcgtcggagtcaccaatcacatggcgattgcgagcacgcaattattgtcgttgtgatccttcgctgtgtgtgttcttgtcctgtgtcagggagagtgtgaagtcaaaatgctcaaacaccgtgccgcttctgtaggcatagaagagagatttatgaatatatactaagggcagaaaagaataaaaaaaaagcttcagcggagcttaagattctaagaaagaatttaaaaaaactggtttttcctgcttttggcttttatctttttttttattctacaactacatcttctcataatctaaatcaaaagttgtttagaaaacttctgattctaaaaaaaagctgtaccaactaaaatcttctccaaacatgcccttggattggttgggcacgttgcacgttagttaacccgcctttgttcgctctggggaacgagaaaaggcactgacaagtggtaaaaatttacgagtactagcagtacaatggtccacggttatcgaactggtgattgagtggtgaacatggtaattaaccaagctttgccgtcagcgtgcgttaaaacaaacaacggcacgtccagctcactgaatttctatcgagaaccaatccgcatgtgcataatatttcatctactgagtatatatgtactttgaaaagatatttactaccctcttactaacaaggatgtcaaacatttaattcaattatagtgggggtaataataaaaatcaacatccaatcacattgtaccacgtcagttttgtaggatgtttgggaacaaaattttgtatctgtatcatttttctcccaatattcaccatgcaatattcaccgcgtaaccgtatggttaccacagtaactgtgcttcccacacggatgcgattccttcaccggtcaaattattttaagtttaaccatggttaccaagcttacctcgggaaagggtaaccacatgccacatattgatgcccactgcgcaaagtttttcatgagatttatgtttatatacatattttaaatcatgtctcgagtcaaaactaaaaccaaagtgggtgtatttcttctacagtagtcctgcacttccaacttgtttgcatgttacagtttgatatgcaaaacttctgcaagactagtttatgattgtgatattaatcagtatatggagcagtttttattatcctgatattgatagccctcattattactctaaagaaatatagggagagggcgtcacgtcctcttatcatactcgacgcatgaaagggatcacgccaaggagaagacaccagaagacaatatccctggccgtcacacaccagttcagtcagcaatgacgaaataaatggccatgtcactcctatcttttaagttccaatcggccgccaaaacaggtacatgccccaattctcacagcagtttctgccccccacaaaaaagaagtgatcagctgctacaccatcttgaccagatgccagatgcagtcccagatcctcagaaaccatcggtacaccaccaaacagcttctgcagtccaccacaggtaaacaaccaaggtgcaaatgtaaaatgttacgatcgccagacatgagaagctcgcactaagtaaatggcaaattggccctggctgcatgtgattgccactttgcctgacgaccttggaagagagatactccttggacatatgcaaaacaatcctgatctttaagtagccttgatactgattctgatttcggtctggtggtccgaaagaaagtatagataatttcataaattgtcccccaaaaaaagtgtcatggactcatggtgtcaagattccccaacatgatgccgttggaaaccaaagataaactatccaatggaatccacaaagctgtgggatcagctaattccagacagggcaacagcaaaactgatgctcgtttggtgttcacagtttgtgctttaaccacttagctcatgcagcagcaatacagcagcgtgatttccagtaaacagatcactcagctcgttgacatttggttctccctaatcgcttgtagtggggtactgattaaatccgacctggctctactttaccaaaaggaattccaaaatatcctccaacaggcaacagtagcaaaacattgattaaagaagtgcaaaagaatgaatgatgcgacaaacaaattgaatcatatgcagacggcaaactcaaaattaaaacatctttatgaaggctagtacacaaccactcgtgcaatcccctttttaaagagagaaagaactgagtcaagtttaagcaacctctgaaacatcacacgatgataatctcttctgttacatagaacttttttaggcttttcattgtctatgacatcttagcaag

SEQ ID NO: 74674 - DNA, 7784 bp, Oryza sativa
tgagtcccagctcgtcccaagccaacccaggccaaccattccacattttagttgttgagcaaattttaagaattaaaacactaacttgggtacattgctttgcttgcccataacagagggcgcggctattcgaatagattatactctgatcagaggtgtacatctttacccacaagacacatcttcctcacatgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgatcgaccatcgtgaactatcattaagccatcatgaaataatagtaaatcattagttatcccataagtgtactaatgtttctaagcagggctaagcaattatatctaatatctagttgaaccaatataattaaagctcaactagtcaaattaatataccccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcagaaaagagcaaaatcaccaaaacagcacatgaacaagcatgaacagtacatgtggatatttttaatgtgtagatcttaattttagaaaaatttagagacttgaaccaactaaatcggagctaagatgaattagttatgaatttttaaagattaaatcggattaaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcgggtccacggcggttcacggcggacggccttgatgacgccagcaatgacgtcaccgacggcggcggcggctcggcgaggcagacggctcgggcggcgcacgctcaccggcgaacggcggcaccacggcaccaacggagggcaccagcacgtagaggacaacacggcgaacacaccggtgaccaaaacggcggcggagaaggaacggacgacgacggcgacgagaaggaagcggcggctaccttcgggttgtcgacggcgacgaagctccggcgggttccgacggctgcgaaggggcggacggggacggcggcgacttggcgatgacgacggcggtcttcccgagcgacggcgacggctggaacgacggcggcgcacggctgaagcggcggcggcgaaggcaaagctagggcacacggcgctagggctactccggcgacgagaggcgaaggcgagggtggcggcgagtagaggagacaccgggggtccttttaaaggggctcggaggcgacggcggaggcccaaggcgacgacaacgacgaaggaaacgctcggcttggagagaggaaaaccgatccgaaacgaactcgattccacgacttccaaaacgatttagccaaagattccaaaggagaaaaggtagaggagatcccggagatcatttcccctctattgattcggccggagaaggaaaggaacggccagatttggaaaggaaacggcggcggcgcgaaactagggtttcggcggcggcggccgaaggaggacgatgggtccgacaggtgggacccacctgtcagcgaccgaacgcgcgcgcgcggcggctgcggactgggccggctgggccgaggagagagaagagaggttttgggccgactttcggcccaaagccaaaagagactttttaaaacctttttcaatttaaattattccttaaatgcaattctatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacattggcgctgaggccgtgaaatacaatatgaaaagagtaatagatctaaatgcatatgatttcttgtgtgttgtagtggtgagtggtgttttgatggtttctggagatcgccaaactacatggcgctaggatgttgggcctcagcgtgacccatgacgctgaggtaaaggactacttttggttatattttttttctggttcatttataaaataagttcttcgaaagagtcaaaatgtcaaaatttcaagttaaatatactggattacagctctttcaaaagtgtttttcttttcttttttgcttttgaattgtggggttgtaatgtttgttgggtcatgatgagcacaaacctgcacgtaagtgtacagaggtccacaacgttaaatatcagcaagcgtggcacaattttctgcaatatttatagtacgatagtaatattatttaatcctcttttgaattatttaaatgatgcctccaactacctgcctgcaaatcagctcagatccaacgaaatggtgctactttccaccctttttctttgggggcgacgaatccatccatctaccctataggcccctccattccgtgaatatttttttaaaacttcttttggaccgcacaaaaaaaatcgcataatatgacaaattttacatgaatttcatcagaataaataaaactcataaaatcgaaatatcctagctggaattttatacccaattgaaattgtccataggattatgctcctcaacttgtcactgtcaactgaaattccaaatcattctgttcccatttcaaaaataaaaaggtaaaaatcaaacgcatccaaacaaacgtgatatttatatttgcatcaaaaaaaaaaaagctctctctctctctctctcgctctctccacatcggtcgtgcggtcgtgccgccatcaccatcgcccctccccctcttcctcctctcttctttttccctccctttcgcttcgcttcctctcctcctctccaccattggcgacctcgcaaaccctagcgcggcgagcggggggaagatgagatgggacgcagcggaggcggaggaggtgctggagcggatctgggacctgcacgaccgcctcagcgacgccatcctcgccgtctcccgcgcgcacttcctcctcccgccgcctccgcctcctccgcctccgccgccgtctcagccgtcggcgccgcccgcgcgcgaggggaggaacgggtacgtgttcgtgaaggggttgaaggggggtggaggaggagaaggaggcggggtgggggatggtgtgggcgtgggctcgccgaaggccgcgccgccggaggcgatgccggaggcgaggagcctgcacgccatacggacggcgctcgaggacctcgaggagcacctcgagttccttcatgtgagattgcgctcgcctcctccccttcctctgttcttctagggtttttttttgctctggattggttacctggaggaccatgtatgagttgttgcaatgaatgggggagtgggggaatggatcctcgtcaggctgggggagagtgcgttgttcacgtgattgcggctatcatttagcttcgttttcattgcgcggcctgtagactgtaatttgagatggggctaatgatttcaatttcttcatgggagctagcttctgttgctatccacctggcgcttcgtttgatgtttcgattggatgttgattgcatcatgctgttcgcatggtaggatcattgagttgctgctcatgagttatgctgaattatgtggtttgttaatatcatgtcatgggtgctggattttggcctttttctttgggtgtttggttgtgcatatgcttttgactataaatttgctaattaaggcgcaaatagattggaaatgaaggcatgtggatgttaaaaaagtgatagtccacatggctttattctcttttttggtggttttttagttgatgcttgctatttgtctaggcaagaaaaaacatcatttgttctgtagtcatttgtcactggataaaagttcatagcataaaaccatgattaatatgatacttgaagatattatttggtctataatcattcatcactggttaaaagttcagcataacattggccaaggtatgtaagagaggctaattttgctgtagtaccttaccagaatgaaacagagtgaagtagctcttgctttgtcatgttccattttagttagttctgagcataatttggttactgtccttttatgagtggtgggttggaaacctgtgcatacatataggcaatgcacagttccctgtgtgtttagctaattcagttctatctttcctacttaatggtatggttatgaagcttgtgtttcttagtcgttaatattgttcttcctccacagaccgttcaatcacaacagcgggcagagcaggatgctgcaattgctagattggaacagagccgactagtccttgccatgaggctagctgaacatcaggggaagaagtatagagtcattgatgaggccttggcgtttgtaggcgaagttggtgacaagagtcgattcatctcaccggaagatgttcgtgcaactcataaccagtcaggggaggatgtaatggacagtgggagcaacggttcaagtattatggggaatgtgttatcttgtagtctatctttggccaagaactcatttcgagtggacaaaatcggtagtgctctgggtaacgctgcagcgtttgctgtaagtatgtttgctttcttgcagctgcatcaagttgcctttggaagcaaatctccagcaatggattacaggaggcacagttaccattctgggagctcactacagagtggcaaaggaaagcaactcgaagtgtacctagccagaggttgaggaatcatcaagtcacttgctgttgcctgtacagaagttttgaccaaataccagttttcaccggttttgttagggcactaatcattctttatgacgaaatggactatgtttcaggctactaggatactaattgttaattcgtttggacgtgttggactacgttccaattaatagacgtcatacctctaaacctgtaaatggatttttcattagagatggatggaatgcttgtaagtctgtattctgtcagccgattggaattgctgtgttaggtttgttgtgtcctcatgagttatgaggattgaggagtgttgaaaggacaactgtttgttgtgccctcatgagttatgaggattgaggggtgttgaagcattcaaggattcaaggttctttgcttaactgagaagtccagttttttcttttcttttcttgattattgactattttcgacatcggctaccttacaagtacatgtgatgcttcatgcttgtgttcttttaaggcagtgcacttgagggtataactttcctgtgtcatgtgcttgtgcttggtgattcctacatcctcctggcatttatctgtcaagtctggatcatatctggtgccgaagcttctttggttaggtccatacttcgccttggccactcctttacctcagtttactgcttttgctttgttggtttgccggctctttgcacactgctgtctcatgctgcaaagattgttaatgttgagtacctgtgattacatggaagccttttcttcaatacgtactaagcattagctttattcagccatatgggtactagaaatatatatttagtacatctgtacataagcctcacgggaattctgcataatctggtatgctcttactggacgactttatcagtggtatcaacgttaaaaaccatatttaacttgaataatatggttgctttggctaatcatagtatcactcatgccccttttcagggcatttcactcccatgttggagaaaagaaaaaagaaaaaggcgagattctatgcttatggttccgtggtttgttctttcgaaatttggcatccataaaggaaaaaaaaaaagagaagacaaacgctaacagtgagggaataaaggattaaaaaagtgaataaatgattaaagatgttcacttcttactaatcatgctcgacaagacaacctcttttggctgggaaacaagaaggaaaaagagggcacagaaacgatctcagcgtcgccgattaatattttatcctccgttaaacactgatatggaggagatgttgttctttttcctgcaaaacatttgtagtagatgttgtaaatcaggtcttggttgctattccagtcaatttcatcatactttattcgttcctagttacatgccaatataatctttcggaacatgtgagaattgttgagagaaaaatacccgaatgccggctacatcttgggccacttctggctgccattgattgcatgctctagacatcgcactgctttggggggaaaagtacaccgaaggtccctcaacttgtcatcgggacacaaaaacgtcctcgaaccgcaaaaccagatatacgaggtcccttaactatacaaaaccgttcacccgaggtccctaggtggtttttaccccggttttgtcctacgtggctgctaagtcagcgtgggacccatgtgggccccacctgtcagcgtaaccca

SEQ ID NO: 74675 - DNA, 753 bp, Oryza sativa
tggacaagaatacgtgattcagtcggtgacaggttcttggcggctcgttttgcgtgttggagatggagatttggagtggatgtccctttttacagacctagattagctatgataatgaggtagcagtcagcagtgaactcaacttgcctgctttgcaggagtattcgtcttcctccttttgaaacttgaaaagtgaaaaaactataatttctgaggaattctcgtgttccacagttaggcaattcataaatgtcatgtatgctagtatacacccttaaacagtgtactcaccccgtttcataacttttgacgttttagataagactgagaatcaataaattttaaactatttagattgaaaacactataacacgatgtatatattaatcttacaacttattttttatatgttataatagaaaaatcatagtcgaagataattttttaagaccgtgtcattttctaaaatattaagaattatagaaccgtatggtacatttatgtttaccaagcagtgataaggtatttatgtattttacaactttgatctctgaatatttgcgtgtaggagatggggatttgtggtggacgtccctttttactgacctatattagctatgataattacgtatagtaagcagtaaactcaacttgtctgctttatagtaatgttcgttgtcctccctttgaaacttgaaaactgaaaaccatgaaatttctgcgaaattcttgtgctctagttaggcactcatc

SEQ ID NO: 74676 - DNA, 600 bp, Oryza sativa
catacacagagcgcatacaacccttagaaatgtccaaatcaaatttacctaagaccttaattccttatggatgttctgtccattcaaaacagctggagcaatcatatgatgttttaaggttgcaaaattttgtttgccaactgatcatgtgggtaatatagcatgtacctatgaaatgctagcatagactagtactctttccatgcaaagaggtatagcattgttgaaaatgtcctctaaaatgtgctaattttgttcaccatatggtcatgccatttgatatatactgttgaatgttttaatatgagataacttccgttgtctttgattaaacatcagctgccattgtggtcagttctattccttagttccattagtgtttcttgacatattaaccacacaacaatgacatattatctattatatgagtatagtgtttcagaaaattatattagtttgtggacttggtctgcaatgcaggctgatgtttgatgaaatgatctatgatatgttatcctccaattattctttgaagtttggttgtgataaaatgaatctttatttcatgtcatgaattcctatcaagtgaagttcaatttt

SEQ ID NO: 74677 - DNA, 5839 bp, Oryza sativa
ggcagtggcacagctatgctcagagcggtcgcgagatggggagagatggagatttgcctcgtgggtggcggccggcgggggagcccgcgcgctgctcctccgccgccgcgtcgcccgtcgccaacgccttgcgggtgccatggaggtgggctgcttgcgcgcggcgtccggcaggaggagcaggagcacggcagcgaccaccaccacgcggcggcgacggcggaggtggggccaggaggtggctagcgcagcggcgatgggtgcggaggtggacaagccgacattattcccgatgacaaggcagacaagctatcgctgccgaggttagaatggagtttcgcctggcggccaccgtgccgtcgccggtgctcacgggcgcgtccgactccatcgacagcctcgacttcgaccccaccggccaccacatcgccatcggcggcatcgcccgaaagatccggatttacagggtcgccgagccatctagccccgtcggctgcatctacatcccggcaaagctgagtagcgtgcggtggcggccggggcggcggcgaggtagtggcgcacgtgggttgcagcgactaagacggcgtcgtgacggagtacgatgtggagcgcggcgtgccggtgtgggagcgcgacgagcacgaggggcggcaggtgtgggcgacggcgcgacatcgtcccgtcctcttcgcgctcccccctagctaccgccgcagccgccatacccttctccccccgggctccggccgccgtcgcgctgccgccgccctcctctctcccgcctcgcctgccgacctctgcaccgccgctttgcctcgccgagaagccgcccagaaagagggaaggtgatgatgtggcttcctgacatgtggggcccacgtgggtcccacgctgactcagcagccacgtaggacaaaaccggggtcaaaaccacctaaggacgtcgggtgaacggttttgtatagttaagggacctcgcgtatctggttttgcggttcgaggacgttttttatcccgatgacaagtcgagggaccttcggtgtacttttcccctgctttgtgctgttgatttggcccaactggggcccactcttggctaggttttttctgcttttttaacatatctgtattaataactataaatattcgacatttaggacaagattaaattaatattttaaaactttaaacactaataacttgtcaaatgcttttgttttttcaaaaaaggtatgcatacttttgctttcaacttattcaatttattctaatataaaatttatggtaaaaaaaattaatagttagactgaatcttgtcttcaaatataaaatatttatgaccggatgaagtaattgataacttttctctcatttatttatatgaatttagatgaccgtgtgtgttgtgactgatgtaaaaaacctgtagtaccagatgaccttttttttttttttgaaagtaggctaaaggattgcctagctcattaataaaggagagaagtttatagaagttatttacagaaatgttccaggtaaccaaagaaatggcaacacacgcttgaattacaaattgtcatatagtcaccaatccatggatatgcttgggcaagcacaatctgtgatacagttcacatttgagaaaacatatgctctgaatatagcacatcatccttttgctaccagtcaactaacatgggctgttaatactttggtagctagctgtttacagaaatgttcagtgtaagtgtgtaacaaaaaaaaaaacaagaagaaacgatacacgcttcaattacacattgtcatatatagtcaccaaaccaatgcatatactcatattcagtgatattgttcacatatgagatatcagataacatatggtctgaacatagcatcaatttttttgctagtattcaccagtcaaccgatgctttggttttcaatccaatggtatcgtgattcttcccctcttctagccagcagcctcgaggccaggttcgccgggttcagtaatggcaagctcgggcccgccggatcaacgacggcgagctaccacggcggcggagacggctctgttcccaaccttgacgcctcttgctcgcccatccggtgtcgcaatgacatgatactccgttgagaatcatgatttcctccggacaattacatgcatgactggatcatctgcatagacctatacgcatacatggcaccatgagacagattacaaagtgtcctcaaacaagattgtcgagtcaccaggattgttattattattatttttttttgtgcttgatcttcagtaggaacaagaagggggaacggagaaccaactgaccgtgcagatcagcagatggtacatggaggattccttctcggctctgttaatagtatataaagatatgaactgtttttccgttgcaagttggatgggaaccacttttgtcttggaagcaagtacctggggaaagtatgcatcagattgcaacaactgttctgtagattgaactgaaggaaagcagatttagctaatgcaaagatctccaaaatatgcaggatgtaaaacgttttctagaggagatttctacctggcgatcgattgcgaggggcgatcagactcggatcccctccctccacctagtttccttttttggcatcgtattactttcctattttagtaaatttatacacctaaagtttacacatataaagtttagagacccaaagtttataaatcaaaagtttatatatccgactcaaatttgaatttgaattcaaatattttttatatatagtatttctatacatataaagtttatacacctaaagtttatagacccaaagtttataagtcaaaagtttatatactcgattcaaatttgaatttgaaatatatccgatttaaatttgaatttaaattcaaatatttttttatatataatatttctatacatctaaagtttatacacctaaaatttatagactcaaagcttataagtcaaaagtttatatacccgattcaaatttgaatttgaattcaaatattagtttatagacccaaagtttataagtcaaaagtttacatacccgttttaattttaaatttgaattcataaggtgtagtaggaagagaagaacaggagaagcaagggggaaaaggagggagtgatgtagcatatagggaaggggcgggcgggtgatcgttcctagccttacccttttctagatggtaaactctgcaggattgtactgagccgacgccagtatatttggataagcagataatgctcggcagtcagtacaagatggaggggttgataccccagaataaattctttttccctaacataaattgggtgatagtataagtgatcaagagcccatgaaaaaataaccacgtcagtatcctgtccaatatgttttaccttaactggtattttttctttcgcgaacgctccttactggttctgaatatactaacctttttcaatgtgaggttagttctttttccattccgttaccttggcattcctgtataccatagaagacttcgtaattcagagtggaaggaagtgattaaacggcttgataaacggttggcaagttggaaaggcaaatttttatcacttatagggcgactaacactaatcaattcagtgcttactagcctaccaatgtatatgatgtcctttttggaaatacctaaaggagtgatcaacaagattgattatttccgatcaaggttcttttggcaaggggatggacacaaaaggaaatatagactagcaaggtaggacatcatatgtcatcctaaagaccaagggggttgggaattcaaaatcttgaaattaagaacacaactttctttagcaactggttgtataaactactcactacaaatgctaaggaacaaatatttggggtcacagcctttgtctcaagctcagtggaaagcaggagactcacactttttgtcacgccccggactagccccgaacggaactagctcgtgacgctccaaattaacctgttgaccgataccagtcccaggaaacagtgctggtatcacaggaagacagaatatcacagcaacagaggtctctttattatagagtaggattacagtcatgttgggctgcggacagatcccgagctcacaactgcattacaaaaggaaagcggaagccagggattggaccaatcatcacaggcgcgacttgggaactaggccgaaacccttaaaactcatcgaagccgacttgctcctggaagaactcctcgtcagcaggatccacttcatcttcttcagcaactggggggggattatttatatagagcaagggtgagtacaggagtactcagcaagccaggggaaataagtatttaatacaggcttcaaggaaaggctgttgttttcgtaattgattttgtttgaactcttttctaaaaagactaagtgagtgcttctcaaacgacacggatgagacagtgcgtctcgtccggtcggagtatgtgcaatgtatcaatctttagatcttgaaccagggttggcatccggccaacagcttttcaaacggccacccgggccaacaacttttcaaacggccacccgggccaacaacttttcaaacggccacccgggcctagctgaccccatcagctgcagatttttcaaacatcgaactccttttcacaacagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcatccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctcttggcatcaaggctcccctgataagctagttactcagccaggggtgtcccattccacccatgtggtcatacttgtcttatgtttggatgaaattccaaggattcggtccttaagtgcgagagcgggaaaccgtactcccggtacgttccccggtccgcggttttgaaaattcatttagttcgcaagcaccgacccaggtgtcgggttttccaagtcttttgtaaaactccagttttacccaagttgttactcagattttaagtttgaaggcgaccgtcgatactcgcacggagtgcacgaatatcgaggtgcagctgggtggttacaaggggacatagcatggcaattaacaatggaaggatcaaatgcaacaagttaggtaagtccgccaatctgtcttgcagatgggataaaagatttagtgcgatcctatcaatgcataatattttgcaggcaatataattaaatttcaaatataggctcaagatgttcaaaggtggcttgccttgctcgagatccggagcttgatcctcgaaatcctcgcactgcgggtcttcgggctccgaaactacacgcaaaacgggacaactcaacaaacagtgaagataaggccctattattgacctctaagcgtgccattaggtagatctcgggatttgaggaatttaggaagttgaacggagtcaaacggatgctcggttgaaaagatatggaatttctaagattattggatttttggtctaaaggaaaaaggatttaatcctttttgaaaaagaaaagaaaagaaagaacagagggatggaaat

SEQ ID NO: 74678 - DNA, 11070 bp, Oryza sativa
aaccaatatggtgggttttttctgtcacattcctttagccattgagcctcaccaaattgatcttgagcaagccttgtttattgtgaaaatgctctactcaggccgaccggtgcggggggagccggatcagacgctccccccgcgcaccctacccccacgtgcgcatctgctagactcacatatttctcccttcccttttacacaaaagatgtttcatctagtatatttacaacattatttataaatctaatgttgcagtgaattaaaatattcttttgcaacaaaaaacccatatattttggaaactctctattaagggaatttggtttattttttgttccatcaaaaatgtttcacctagtgtacttacaatgtttcactatatatagatctaatgttgcaatgaacgaaacattccattgcaataaaaaacccacatattttggaaaccccctattaagggaatttggtttattttttgttccaccgagaaatgtttcacatagtgtactcacaatgtttcactatgtatagatctaatgttgcagtgaactgaaatattctttcgctatttgttgaaacattgttttaatatagggtgaaacaacacccgatttaaacgagtgaaacattttcgatctacttagtgaaacaattccgatatacctggtggaatatcgtgcaatatttaaaaataattcaataataagctaattttttttcatcggaatatatccatgtgtggtcttattttgaagatttaattgcaacgaatttaatggtacaatcggatcatgatttggataagtaatttaagagataaatcagtttaaattaattttgcacgtaaatcgagcgctaacgtcatgctgacgtcagcgcccgattttacccctccggatcgggcgcccgaccgggagtcatcatctcctgtttgtttattggcttcaactttggataatatggcaatatacattggctttattccgttactcatatttgcttgtaatttaagtgattcaaattgagattgacccaaccttgtttgttggttgtcatggattacattggtctttcttttgtccaatacatggaaaatacatatgcactatagattgggggcctcaccaaattgagttttgagtgaatcatgtttgtgagctttcttataaagagattgcaatgatattttcttttcccaaaatgcagggatgagccggaggactcacatgcacactatatgcatgcatccgtgaatgtgtcctcaaacagtcaaacagatgaggagccatcgttaaatccataacctcactaaaattttattcaaaacaaactcacatggtaaaatattgggcttgtttttcaagcctggtaatggaaaagttgcctgatatatataggaataagttcactttgactcccttgaaagtgatccgaatctaatccgtgaccctcaaccgtaaaatcgtataggatgtctcccgaactattaaaatcgatgcaatttgactcccttggtggttttggaggacggttttgctgatgtggcgtctatgtggcggtgttgacctggtcttcatccaacatgatattgacgtggtacttatgtggtaatagaattaaaataatatgtgggacccatttatcatttaaaaataataattgtgggacccatgtggggcccacatgtcattatctatctcttttccttcttcgtcctccctctctctcttctctcggtctctctctgttctctttatctcccccttctcttcgtctaagcaccggcgaaggaggcggacttcgtctgagcaccggcgaaggaggcagacgaggggttgagggccgagctgttgcgggagattatcgaggactggggcatcatagcatgtaatttcatagaaagaataaaaaagatgcgaatattagggaatgacctaatatcaaataattagaaggaatgagacttcaaacccaggtcgtctagtccaccaccttatgaagctagccggaagacccctgtgtatttctcgtaatttcatagaaagaataattttccatatttcattgtcaagaaccgacgcaagaaattcagctcactccaaaaggggatataattcttcttgtgccgtaaatgtagatttctacagaatgaagggacaattacaggggatgaggaagagttagtccttacaggcatgcaagctagagtggtgctgatgagccccgtgatggggtcggtggcgagggcgagcacagcaggcaaggcgatggtgaggatgtccatgccaatctcatcaaccatgaaccacccgcgcccgagcacctcctttcctccgtccttcccctcgggcttgtcctcccgccgccaggtctccttctccttctcgtcgtctaccacgtcctccaccgccggcttcgcacggcaccgcgcaggcctccaccgaggaactacactatggcagtgatggtgggcgaaggggaaggagagatggttgagcgctggagaagtggttaggacaaacgcggcggcgacagacctcatcggccgcgaggtcgccgtcatgccacgcgagcgtgtgactgtggactgtggttgagcaccgccttctgcttggccgacgccgctccggccctcgcctgccaccgccgctgctgctccggccatcacccgccgccgccaccgctccgtctcccccctgctcgccgattgcgccacgagaaagaaggagagaagggagagagatggaggaagaagagagagagagggaggatgacatgtgggctccataatttattttatgtgtgaatcatagttttttttaattctaatgccacgttggatgaaagactaggtcaacattatcatgtcagcgtcacatcaacaaaaaccatcctctaaaacttcctttcacgtcctccgtctagcccctcgacctacggccagtccttttacgtgctactgcacagcgccggcggcacgggacgacgacgaccagtcgaccacgatgcggggatactgcaggtgctctcgcctctgacagcaacgggaacgtccacagcgggcagctcgcgccgcaacaggttgtcgatacgggtggcaaggaggaggaggatgcaggtgacagcggtggcagggagggattgcgtgaagcggatcatgggactccccgacgcgtccccgtcgaggagcgggccaaggtgctcaaccccctacagcgtgacgacagtacgcttaccgtgtcggactaaatcagaaacaccatttttttcacttcatatgtggattttaattgagctatatatgtgcagttcgtgagttctcatctgaaaatattttctggaagttcttgcatttgttcatcacaccagttcagccggcgtgtgtgatttgtttctctagtttttgcgttttttcttcacagcagttcagccctctccgtgctcgccaaagccaaggactcctccacgatcgcgctccaggggttgctgcctggaacgttcgtgccggtttcctattgtagcacaaagaagtggagttcacactactacgaaatcggtttttccatgacggggaaaatcaatttttacaagcgaaaagacgagccaccagcaaccaaaggccagagcgggcctcatccacttgtgaaaattgaatttcgcaggtggcgtattaagaaatctgctagcaaaaatcgaattttgcaggcgtcgtcctaagaaatccgccagcaaaaatggatttttttttgctgacggcacctttaggtcaaccgcgagtgaagagatttttcaaaaaaaaaatccacatattcatcatgattttcaaaacaaaaacacctcaacatcattttgaaaaaaaaaaaactcatcaacatctagattcccattaacatattcatcaatagatcagcggattcacatcaacaaattcaacaaatcaacagattcacatcaacaaattaacatcaacaaatccattacagtgaagcaaatcgattttcacagcatgcatctcgtcgccatccaccgtcgaggggcaccagcactagatctggcggacacaaagtcatcctgccggtgcagtcgccgtcgagccgaagagaggcggagggaggtgggaggccggaggcgcagagaggagagagccgcgcgccatcgctaccgagccccttgctgccaccacgcaccgtcatcactgagccccgccacgtgccatccaccaccgccaagctctgtcaccgtcgatccccttgccgctgccgagccccctcccctgcgctgccgctgacggtaaagcgggttggacgtgagctccatagcccgcccacagcctcgcctgctgccgcgagcctccccgcccccagtttcgcccgccggcgcgagcctccacgcctccgtacctccccgccgccagatccgccacgtgcgagccttcccgcagcctcgcctgacttctgctggcccgcccaccgtcgcgagcctccatgccacccacgtgccttcgcgccaccggatcgccacgcgtgagcctcctcgccgcctgatccgccgccgcagctccacttgccgccgccgccaaccacgattgagggagaggtgggagtggaggggagaggagaaatggatctaagagagaggttgagggagagatgcggtggagagatggatccggggcatatttatcctcccactaacagtttttttaaaaaaggcctcccacttggacttagtccccacgcccccacgatcttttttacggcggctgttcttataccccgccattaaaaatagagatattttcgctggtggttgtttaaatgggccgctagcgaaaatagctatatttttgctagcggtccacttaacctggccaccagcgaagatccatttttgctggcggtccgtagccaccgatcccccgttatattttcgttggcggtttcgacgtataaccgacagagaaaaaaaatgggtgatgccataaaaaattgattttgtagtagtagcgagcgaacctaagaatagatgaggaagaagaaaaaaaagggaagtttgagattgacaggtgggacccacgctgattccgtttttaaaacccagacatcaaggatgaggggtcaaaagtgaacttattcctcgacctgatcccactagagtccgtccagcctattgaatttcaactcgtttgttcaagtctcaaaaagaaggaaccatcttgtggcccaactcgtggaggatatattagtcgaaatcatatgcgtctcttcgtcccgcccacgccgccaacacacacgacaaccgcttccttggcacgcatccccccgctccccaagatccccatcttctccagcgatgccgaagccgaacccccgcaccgcctcttcctctgccgccgccgccgcgtcctccccggacaccgtacgcaaggagcgcgaggagaacacggtgcccgccgtgtacgacgccagcgccgacatcgaagatgactaccgcttgttcttggagaacttgcttgtctacgagaacgaggactttgtgctggagtacgagggcaaggtggtcaggtatggaggagacgaagccgtttctgctggtggtggcagtagaggggaggatccggtgatggagaaggagaaagagaaggagaaggaggtggacgttgtggtgatctcctcctcctctgacgacgagtctaccaagattatttcggagcctaatccgcttgacagaggcgtgtttcagtgaaaggttaatacatcgttccacttcaccaatctcttttttttttctttggttagttttgctgcatttctaacacaaattagtgttgttggcagatgaaaaaggtagtggacaaggaaaagatggatgagaagaatgaggctgctgcccctcttgttaaggggaaaggtgttggaaaggttagttctcatgaccccggttgtgcttgtttcaaagggctgatgtgagatgtggaagagaaacatgtgtgatgtgtatgccgtgtgcgcgtgcaggtgatcggaatggaagtagaagatgagcagcttgtgctggctttgccgaaaccgggcacgacgactagcttgacaaacccaagcaaacgccatgaaaccgagcctcatactacttctgtgagaatttcttgcacatgctgcttttacctgttcatgttgttgtcgattagaataaggatcgacatctgtcacatgtggttgttattggtgcctagtgtcgtagatatgtcaaatctgctttgtagttctttcagctcgtctaaagggtgtaaatgtctaggattcctatttggcgcggcacagagtccagtagtccggaggcagaggagttcgatttctctcttcttgttccttcgctcactcattcccttatctttcctccattcccgatcgacaactttgatagagctgctaatcgtcgcccattgatcttccggccacaatcctcatccctgtcgctgtctacgttcccagctgccctctattccccaatccccctctccatccgcgtgccctagctcctcaaccatagccatggggactccactatcaatgccgccgccatgcgtcgcagaggagtagcagtagcaggcaccaacgacatggtcatagctgcggtcgtgaccgggaagatggcgaccttgaggaagaagagcaattttgactatgacatgaaagttttatggatttttcaattgaaagttttgtggtttttcgatgaaagtattcattttatcgcaagtttttgtgatttttgagatgaaagttcctgattcgaactgaaagttttgtgattttgagatgaatgttttcatatcattgaaaagaatggtttttgattttcaagatcaaagtttgaggaagactataagttacagttaaatcattggtgcaagaagcggcagatgtcgaatgaagcaaaagcaaaaccagcagctaggagagcaggcatggctgtgcgcaacttccgttgctagcgcagctgcgccaactagcaacccccttcaatgttttctacaggatgactaaaaataatatctgaatccacgctagttgtaaagaaatggaaattgttataacattgttaaagatagaaacactttggctatgtttggataatgggtttgggatataatttcccactcctcaaagagtaagtttcaattctagccatccattcttctcactccatttcattctatccctccattcatttctatttcccaatcccacctctcctaacccattatccaaacatatcctttcaccattggtcatctactttgggcatgcgtaatcaaactttgccttacttgtccatgcaattccttgtaaacaagatagtggaatagcttgcacttgaaaactagtaaactattttccattatgaatttcgattgtttttagttaatacagatcacgtcccattcctttcccctctaccactcatttctctccaccaccttatccatatcctctccaccatccttctctctctcatgcatccttctctctctcacgcgaagctcagaggaggagtggctggggtaggggcagcggcggcggtggctctaacgagctgcggcatcggtggcggctccgaggaggagcggcgtcggcggcggctcgagcggaggggaggtgcatctgcggtggcgcgggtggaggaaatgtgcgtctgcggcggcataggcagaggggaggggcgtcggtgtggagattatggatatcccatatctacatggcgacgatatttggactggatataggataccgaatatatatagaatatcttatttgtatctcgggtttgtttcttaacttgtacatcaaggaaacaccttgagacttagtcggttacgactgtattttacctgtatttgtatattccgttagggatatagattatcttttgtaacccggactccttcctatatataaggggggtccgggcgcctctaggggcagagatgttgattttctccaaatcatacaatcaataacacactcggcggattcatccccggacaggagtagggtattacttcttttataagaaggcctgaacctgtataaatcctttgtctccaaacccatacactttcctagcttgatagccaccccttttattattgccgaaatctagtttcgacagttggcgcgccaggtaggggtagcgtcaagcttttcgccgatcagtgcaatgggtttcgtctccggcatcgacgacctcgtcttcccacccgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagctacttcaagaccatctcaatcgagtcggcttcaaaccactcgggcgagatcgcatcttctccaacgacaccagatcaagatgatggggcttacccaccagtcctgatgaagctccccgacgatttagcggccgtctccaccacgacagcgtcttcatcccgtaggcctaggcggaagtcgacttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggaccgcgaaggaggctgaggatcgacgtcagcgagctttgaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcagtccgaccacgtcgtcaacatcttgaaccagacgaagaccatgattgcggcttcggtcccagttaactccgaaagcgtccacacgccgactggtagccgagtcccccacttccgatctcatgactaccgtcatccaagcctcagcatcaccggcgcaggatctaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgatctgcgtcgagtggattggccagccggcttcaagccgactggaatagagaagtacgacggtaccactaatccagaatcgtggcttaccgtctacggtctcgcaatccgcgcagcaggaggagacaacaaggccatggcgaactatttaccagtggccttagcagattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaacgcaacaagatctccgacatcaccgacgacgttatcatcgccgcgttcaccaaagggattcgccacgaagaattggtcggcaagttcgggcgcaagcctcccaggacagtcaagctcatgtttgaaaaagccaacgagtacgccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcaaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgatggtcagagattgcaattaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagttaaaaccaagcaatgctccttttcacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggag

SEQ ID NO: 74679 - DNA, 740 bp, Oryza sativa
ctccctatccaaacctttgcaacagatggctgacaatgagaaaggcaataaggtcagaagtcaggacattggtacctcaagctctcgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgcctctacatgcgttcattgtgaggaagaccatccacccgataggtgtccaacgagcaggatcactt

SEQ ID NO: 74680 - DNA, 3627 bp, Oryza sativa
tcctgcacccccttgggcgagccgctgccctcgtacttctggattgccttgcacccggacagcagctccagcagcacgacgccgaagctgtacacgtcgctcttgtccgtcaggtgctgcagcctgtagtactccgggtccatgtaccccaccgtccccgccgtcacgcaccgctcctcgtcgtctccgtcgccggcattgcctccgtcgccggcggcggcattgtcaccgtccagggtgttgaggagggagaggccgaagtcggagaccttggcggtccagcaggagtcgaggaggatgttggaggacttgatgtcgcggtggatgatgggcgggacggcgtaggtgtgcatgtactcgatgccgcgggcggcgccgagcgcgaggcggaggcgggacggccaggaggcgagcggcggggagagcggcgccgccgccgacgccgcacgcctgtggaggtggtcgtggagggtgccgttgggcatgaactcgtagacgaggatgcgctcgccgccgtcggcgcagaagccgaggaggcggaccaggttcttgtggttgacgcgggagaggagcgcgagctcggagacgaatgccgcctcgtggtcgacgcgccgcgccgcggcggcggaggaggaggaagggccccccgtgtcgcggcgctcggcgcgcttgatggcgacctcgcggccgtcggggagggacgcgcggtacaccgcgccgaagctgccggagccgatgcgcttcgccggcgagaagcagtcggtggcggcgcggagcgccaccagcgggaactgctcgaccgtcgtgttcgggcccttggagagcagcgcgctgagccgccgctccacgcgcggcgccgtgcccgtcggctcggcgtggatgcgcccggagaccggcgagctgctgccacggtgccggcgcaggtagtaaaccgccgcgagcgcggcgaggagcgccacgagcgccgatccagctccggcgctgatcaacgctatcgccagattgctcgggcgacgcttccccttcgattgagagctcgacgacgacgacgagttggacgtcggggacagcgccatcggaggaggggtgtagccgcaggggtaacaaacggacacgtctccgccgcctcccccgccgctgccggcgcagagctgcgcggagcccgaccagacgccgcacgagcacgacttcgacggcgcgcacggacccgggagcaccttgtcgaacaccttcctcaccccgcccgcgacgcctgcgccccagcactgcagcgagtagtcggacatgagcaccccgcacaccaccttccccttcgcctccagcgcgacgaactgctgccccgccagcgccggcggcggcgacgcctccccctcgggccagcacgagaccgtccagttcccccacagcacgcacgtgaccgcgtcgcccaccgccaccgtcgacaccgcgcggctgatcctcggcggcgacgcggccgccaccgccgccgcctccccccagcaacccaccaccccgccatcatccacgccgcacgcgtgcctctcgccggcggcgagcagcatgaacctcctccccgcgggctccctccccaccacctcccctccaccatagcacctcacctccccgctccccaccaccaacccgcacacgaacccgccacccaccgccaccgccgagaaccccaccctcgccggcgcgccctccccccacgggcacctccagcactgcatcctctccccgacgagcccgcacacggactccccgccgccggacaccgccgagagcacccgccccctgtacacccgcttcgacccatccccggcctcgttcagatcccaccaccgcatcgacattggcggcgacgacgtcggcgcagccgagcacaggtacccgtccccggcgaccaccgccgagtacggcgagcacgtcccgtccccgccatacgcgtacacgtgcggcgccgccgccgacctgttcgacacgctggcgcacgagatcctgtaccccgccgccgcgccccccgccgccggcacgagcccgcacgcgagatgctgcttggaggggttggagctggagttggagacggcggcgatggcgatggtggggagggggaaggaggaggaggcgaggaggaggggcggcgagaggaggagggctaggaggaggaggaggaggtgaggtggagacattgggttggaggagaggaggaggaggaggagtttgtggagacgaccattgttggcgcgagttggggaggaggaggaagaagatggagaaggggaaatgggggagggagggaaagggtggaggtttaaaggttggtgtctatgtttttctttctcctcttcatcactttttgttagatttttttttattttttttgttgttgtttgagaaaaagtaatgggaaagatttgggtgttttttgtttttcttctttttggctaacttggttgttgggtagtatggaaatatgaatgcactattggtatttctctctctctctcttgttgagtgattttttttttgagaactttgttgagtgatttgatgtgtgtcaatagcttgtcaagaggaaataggtggcttgttaattagttatggtgttgcattttggaggaccacgttgtgattagtaatgggattctttcttttttttcttttgtgcatatgaattttaagcaagctgtagtacatttcatcagaatcctctcttttgacatatagccactatcctttctgttgtgatgatagtacaatggtggttgtgacttagtgacaagtatcttccaatggggtcgcaatctatgttcgaagaaaaattctaggtccgccaccataatcggagatcttaatatgaactttttgttaagttcattttttttatgcacgatcttcacaaggtcatataagcagatgatcatttcttctgttgtatgattacaaaagggaaggatgaaattacttactgatattttccttctaatgtgtgaaagcaaaggtaatttctcatatggcattttgtgcaactcccacaatgtggccaggcctttcaaagtccagcgaagttggagaaaattattgaatcatcattgtgctcatctcactcagcagagaaaatggccaagaaactgtacttgttttcttttcttttttttcaggaagtgagatcatgggagaatactaggagcggtttccggatctagaaacacctcccctaatactttcattactcatcagaaaaatctattgtttccggatctagaaacacctcccctaacactttcattactcatcagaaaaatctatcttattgatagtggttattgtttaagtatcagatttggacgcaatcatcagagatcatcacatataaggtttcttctaggtcttctttgccttgccacaagcaagagtcccagctaagatccagattctccatccatggcatgtgtgctctgcagattgctgagacagccagctagtgactgaagagaaaaaacatttgattacaagtcaagatcatttctttaccctgcaagatggcaattaacaagccccaacactgcaattaaatacagtttaagtagctgtaatacttttctctctgtgggctcctgattccat

SEQ ID NO: 74681 - DNA, 1561 bp, Oryza sativa
aaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctacagaggtcagtttaaaatcacatgtaacagcgaagcctcagatttggcaggataatgattagacaataacaaatccagcagtaaagccatttgggaagacgtcaaagtatatcaagtaggataagttggctctcttgggaagcataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcgacacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggcaaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttccccccccttcctctcttgggccggctcggcccaactctccctccctctctttcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataaagaggggggaatcattccccgcgattccctctctctttccccccgtttttccctctctctctccctcggattcgtccggattcactcccgcaaacctcgccggcgccatcaatggcggcgagatctccgcgccggttt

SEQ ID NO: 74682 - DNA, 808 bp, Oryza sativa
gtccgttagtgtgaaccgccgcccgtgcgcccggtccaccaaaccttagccgctgacgcaataatccttttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccgaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcagctagatattagatataattgcttagccctgcttagaaacattagcacacattcgggataactaatgattcactattatttcatgatggtttaatgatagttcacgatggtcaatcgtgattagttaattaattaatgtgccaactaaaacctggtaatggtgggttgtgagcacatggttttgttggtcgtgctcatgacaattaaggaccggttcacgagtttcggttgt

SEQ ID NO: 74683 - DNA, 4354 bp, Oryza sativa
caatgctccttttcacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccttttggggcatactgctacgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagttgactgggtgcatggcggcgctcagccgatttgtttcaagacttggtgagcgggggatgcccttctttaagctactgaagaaaacagatgatttccagtggggacccgaagcacagaaggccttcgaagatttcaagaaactcctcaccgagccacccgtcttagcttcaccacacccgcaggagccgttgttgctgtatgtatcagccacctcccaggttgtgagcacagtcttggtcgttgagcgcgaggaagaaggccatgtccaaaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagtaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctatgtgctttggatacatttttcggcgtcccacaacgtcgccgagtatgaggccctccttcatggactgcggattgcaatttccctagggataaagcgtctaatagttcgaggcgattcacagctggttgtcaaccaagttatgaaagagtggtcctaccttgacgacaatatgatggcatatcgacaagaggtacgcaagttggaagacaagttcgatggactcgagctcagtcacgttcttcgacacaacaatgaagccgccgacagacttgccaactttggatccaagcgtgaggcggcaccctctgatgttttcgtcgaacacctttatacgccgacagtacctcacaaagatactactcaagttgcgggcactcatgacgcagctatggttgaagtagactggcgagagcccctcatacgatttttgacttctcaagaactcccccaagacaaagatgaagccgagcggatttcaaggcggagcaaactttatgttttgcatgaagccgagttatacaagaaaagcccttcaggaattctgcaacgctgcgtatctttagaggaagggagacaattgctaaaagacatacattctgggatatgcggaaaccatgccgctgcacgcaccattgttggcaaagcttaccggcagggttttttctggcctactgcagtgtccgacgccgacaagattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgacaaattctccaagtggattgaagctaaaccggttgtcacaatcacagcagataatgcgcgagacttcttcatcaacattgtgcatagatttggagtgcccaatcggatcatcactgataatggcacacaattcactggcggagtttttaaagacttttgtgaggactttggaattaagatttgctatgcctcagtggcacaccccatgagcaatggacaggtggagcgagccaatggcatgatacttcaagggattaaagcgcgtgtctttgaccggctaaaaccctatgccggcaaatgggtgcaacagctgccatcagtactttggtctttgcgaactacacccagtcgggccacaggccagtcaccctttttccttgtctatggggcagaagcaatgttgccgagtgaagttgaatttgaatctctgcgctttcggaatttccgtgaagaacgctacgaagaggaccgagtggatgacttgcaccgtttggaagaagtccgcgaagcagctttgattcggtcggctcgatacttacaagggttgcggcgttatcataatcgcaatgttcgatcccgtgcctttctagtcggcgacctggttttgaggaaaattcaaactacacgagatcggcacaagttatctcctttatgggaggggccatttatcatctctgaagtcacccgaccaggttcctaccgactcaagcgcgaagacggtactctcgtcgacaactcttggaacattgaacaccttcgtcgtttctatgcttaagcttatcattgtatttccctatcttgactgtcaccatcaagttttcttcttgccgttgtcagtcgggggctatcatcataataatggagtgtgattttttatcaatttaatttgcttacttggtctatcattgccttgtttgattttttctacttagtctgcgaggattgaaagtttttaatagcttctttgggttttaggctcaacaaagcttgataaaagcttttaagaaatcaaagacttggttagaactatcaagcacagcataaatacaccagtattgtacaaattgagcctccatttgctacatttacactcagtcagaatcagtcctttcatcatcagagttattattgctcggctgaaggtcgttgttgcggaattgctctacaacatcacttacaatcttgtcagccgcactttgagcattactgataagatcaagagcagcttcttcgcttgtcccgtctgcaaagccatcaatggtatcaatttcaatcctcgggtacaaggatttggtcatcgccaatgccatactagctcccatacttccagcttttttgatattcttgaaatatacatccggtgcaactctcagcttgtcaaagatttcggttgcgtcaagtgcactcggaccactgttattaaggaacatagcttggacgagtggtgtagcgacattggcgacttcgtctcttgctcctt

SEQ ID NO: 74684 - DNA, 14613 bp, Oryza sativa
gccgccgccgccctccccaccaatggatccgccaccaccgagccccccgccgccgctgtcgtcgagcccgccgccgccgccgtcgtagagcctaccgccgccgccaccgtcgcccgagccatctaccgcgccgtcgccgagccccccaccgccgccgttgccgagcccaccgccgccgtcgccgagcccgccgccgtctcccgaggaagagcgcacgagcaaagcggcggtttcacgccgtcgctcgtcccaggtaggacgagttcgtccgccagttttggccggaccgattggtcccggatctgagaggaatattcctctgtagggaccaacctatcccactacccctgaaccaaacacccctaaaaatgggttcatcccatcccatcccatcccatcccagcaaccaaacactacctaggagagcaaaccacacaccattgaaccaagtggacaagtgttactttctaaatcctgatttcttgccaaagaaaccttctcctcacaaagtcaattttctttctaatccctttgggtattctataaaaagattacatgtacaggggtactacttaggcatgagtttattaaggtttttacaaaaggccattatttgaccttgtcaatgcaaccatcatggttatgaatcctttttaacaaccatgtttaaagcaatcaaaccacattattgacaggaaatgaatcaaccttattgctacatttagaatgagaattgatgtattacactaaatggaccttgagatcaatgagaaatgacaactatttcactattcactatctacatttctaacacgtcattagcacgcagctctaaccagctgagcaagaaaggtgaagaactcacaggtaactctaaggataagatggctcgacgttttctcattcctcttgacgtcggatcttctcttccttgcaaccttcgtgctcgctatctacgtcgcctcatgcagcagctcgacaagcttctccgggctcctttgcgccgtcctcgaagttgcaggggctgtggtgctagctttgctggccatggcccacggtatccttcctctggctttgccagatgtggaggatgacgccgcaacggcggcgtcgctgcccgcacaaccaccagagctggtagcattgtctccagcaccctcacgacagtgatgctcgacacctgcaatgcactagaatgcattctggtggagtcgccgcgccacttcaagtcccatggatggacggcaagggtgcggttgtagcccgattggccgccgcaagaggtgccagatgtggtgacgttgtactgtccttagcacggatggacgagctacactcgttgcgccatatcaccatcaccttcgccggagcactcaccggcgacgccgctgtatggtccaccaccggctgaaccgccgcggagcgccgcccttctacatggcagcaggtggctctagcaaacgtgcagcccctccaccggcccctccgttccctggcctctcgaccgcaaccgcggcggcaaacgcgcgccccggcctctaccgcatcatcatgcccaggcatgtccctgccgagttgagcggcggcgacaaggccagctgtcccccgcccttgagtgagggggaggcctgagcatggggagggatgaggtccaggaggtcagggcagaccggcggcggcgtcggtggcaacccaacacggcggcggctgcgggcggtgacaatgaccagacgacagaccgtagtgtgctgccggcgataccatgctacaggctacaggctacggctgctcgctagggttggtctctatctccctctccctctccgagacaccgtgcctgccgccggcgacttgacgagtccgaccactggcgtcagttgcgccgcctgagcgggctgaggcccagctaggtagttaacagcccatccgcccttcgctgctcactaggaccgtgtaattaggctaaggccacatttagcataactttacatatccacgataaatttaaagtttatatggatttaaaattttaaatatttaaagtttatatggatttaaaattctaaatttaactaaaatggaaataaaataatttatattagtattgttaacgtaacagtaggtctatatccataaatttgtgggagctaggaatatccaacttcaaatatttatgtatctagagctttgtcgaagaggatttaaggtgtgtttgaatcactcgtttttgatccatacgttttctaagttagtaaatgtgcaatttttttttgaaaaatatagaaaaattatcttttaaaaaaataatattaacctattttttaaatttacaataattaatacttcaattaatcatactcaaggtacaaaagtgaactttttgcactgtgtaattaggctaactttataattggatccgttcattccaatctggcccggccttgaggcccatgaagcccacgaacgtattcattgtcatcgcctcattggcaagctatccatctcccaaagcgagatgcccatgccggagtaccaaaattccccagtagcagccgccgccgccgccgccgccgattcaccaacccttctcctccatcggcatgtcgcgggggggaggccggctgcccccgcgcttctctctacccagctgtacctgtacctgtacgccccccacaatcccagtcgcctcgcttccttcacattttctgggtgccaagctgctacgattagtttttgctgtgctctgtttttttttttctctctcaatgattcaatgtatgcgggaatacatcagtcatggttgaatttatggtgaaattaatggggttttgaactatttggttcgtctaatcgtccgtaggaccaagtaatttggtagaacaaatggaatctttttagagcatccccaagaacgcccgatcctgcacattactgtagagacgcgtctaattaagtggccaacttacttacggagtacatctcgatctcgatgaaagaggttgccaagttattctgtgaatattaattttgtgtattttctgttcttttcctttccaatagaaaaaaggaggtgtttttttatagatgtgaaatatgctggtaagaacatatgtacactctttcagtataagaacatataagaagtagccaaggattatttgattccaaatttccaattgcaggatcatgtggttgtagaggagataatattacttcatgatcaaacatatttaaagtcatctatttcagtaagaaaatgtttgactcaaacagattcagaggctcagagctcattgtatcataatctttcatacgtatgtaaacattatttgttgcaggcaggcatgagtgccctgaataacatgactcatatcatgctttaagcctttaacacgaagccctatatcgaagaagtatcagtctaaagaatgctattgcttcaaattacaatctgttgtttattaacaggaatgcttctatcatgcgagtgaactgatataggacgaagggtcaggaggcgttgggatttgtactgctccatcaagcatctgcatcaccttatgcattgttggccgcatcgatggctcctcctggaggcaccacagtgccacagcaacgaagcgctccaccttttttatgttgaagattgcctcgtcatcgctcgccaccagcaagtcaatcctcccacacctgtagcaatcatttgcccaataagttagtattgtctgctcctcatctgcaacttctaattccacattcttcctgcagcacacaagctcaagcaggatcactccaaagctataaacgtcgaccttagaagtaatccctatgttcttgaaccactcaggtgcaacatatcctcgagtaccccgaatgccggtgtttgtttgtgtctgattcaccggaagaagctttgctagaccaaaatctgaaatctttgctacaaaattatcatcgagaaggatattctgtggtttcatatcgcagtggatgatttgtttattacactcctcatgtaggtagaacagtcctcgtgaaaccccaagtgctacttgaacacggaggctccaatgcggatgactatcgttgaagaggaatgtattgagtgagccattgctcatgaactcatacactagcagcttttcagttccctcattgcaaaaaccaagcagtctaactaagttcctgtgaaacgtctgcccaatggtttggacttccaccaagaactccttttgtgcttcctgctgaagcttttcgattttcttgactgcgatgttagttccacactcatcttgcagctgtcctttgtagacaatacctgaggctcctgtaccaagtacctcatggaaaccaccggttgccttttccagctctctgtaagtgaaaatctttgaaggtaatccagaattactgggtagttgcgataactgggttttcttcctcgaggtgatactacaataagtaccaaaaagcagaacaaagattaggagaaagttcaccaatacagagcttccaaaaaacaatgagctcccaagaatccaatactttttgtccttcttccatttgctggagccgctgctgatcatggatggtgaattggtgctcctaggcaccttaagaagaactgtcgcctgtaaactggaatccatattcccatttgataaagggagcttctttttataacaagtgtttgagggtttattgaacacggcaacggagcagaagcaatcaatgacgcacagccttcggcattcggtctcatctatcgggctgtactgctcatagtcagatagaggccaattaatgcgatcaattggtgtcatctcatactgcaccattgctgctgtctcatctagatcacagctttgtggctcaaaatctggcctgcaacctttgtatgtcctctcattgtcgaagaacttgtacctctgtgggcatagacaatttgttgtgttcttggtgccatcaaaggtacagtaactgttgaagccgcatgcaccactgcctacctttgtttgaattgtctggcagatgttctccggaagtgcatccaccgctctccattgctcttgccataagctcctggcctgtttgctctttgggtaaatatattgccggaacacaccatctgtatcaagggttgcacggtggaagaaatcacccatagagtccactcctgcagaagtgatgtttatctgtgaaccattagtcagcgtgaagtatatccttccagtttcattgaacaccagctgtgagccattccccactgtgttactggcccagtatggatcatggtagtatgcagaaggtacagcaactagatacagcacaagattaccgtcatcttgaacatttagttgaaaccggccattggaatagtctgtggcgaggagacggctgtggagtgctgtccctagtgggagcacttgtgtgggtaggatggtatcagaagggtcaccaaaggactcccactttgttgcgccatcagtgcctaaaagcctgaaattaccggtgtcgagcattctagcatagcccacatcagtgactcgtggattccatacctcgttgccagatggatcgcgaagagagagtgctccatcagcgagcttgaggatagagccagcttggacttgtatcggtattgtatcatcttgcctattggagctagtcttggcataccagatgacggtcttgtcagcgatcttgttgaaccagacagcgagcaggtatgaggaggagtttccatctaccgccagaaaaccgaatgcaaaatcagcagtgggcgagatccatgagttgtttatcccctggggtgtcaaagaggagcctatgctgatgtttagctgagcttgggcagatttggtgcagtatagtagcaagagttgcaggatgggcaagaacaggagaggtgccattgctattgatcaaccttttgctcgtactagatgacaacaaaacttatagcccttggagagcggcatttgttagtcttgatcacttccatacttgactaaccaaaagtttctctgcgaggcaaccggttgaacctgtcaaatgcaattacaaagctgtcaatatgatagacataagagggagattggttcacatttccttatcaaaactatagaaaatgtcggctttgaatgcattgaccacctgtatggagagagaaagaaagacgtgttcagaagtctttagagaaagaaatacgtgttcagaagtctttctatgtgtttctttcctcctgaggttggtctttccaaccgcgtttcagaagaacagttttggccagcttgtatggttatggtcaagccaggtgtaatcttttcatggtaatataggagtacactgtaacattaattgatcaggttttttgacgcagtcagaacctgctttgctgatcgtaaggccattcctactgtgagattcattttgaggtttccaaaagtcacctaatctagataagctcggataggattaaacatatagacctccaaattacagtttcacatagatgattttgtttccttccttctattcataaattttttgacaatgtcccatgtggcatttaatttaatcagaataaaacctcttatgaaacctgcactaaaaatggcctaatatatgttttagccatttctaccacgcaaagtcagtgctccattcaaggggagctaggacacattgactaatgatgtctgtctgtatttaatttaatcagaatgaaactcttatgaaaccatggtagcaacatatattttgaacatttaactggtcaattggaatcagtacttcctgagtcctttccaagcttgcgttgcagaagtcttcaagtcccccaggtccacgttaggtcaagacggtttagtccctagccattctagtcttaaaacaatttagtccctcgtcagttcgaaaaaccctatttgccaccctgcgaaagaaatctaagtcaccacaccttgttctccatcctcgcagccacccaagcacactgtatgtttgtgacaggcttgaagaagacggcagcatggctatcttcttcgtttttctcctccaccccttccctctcaatgacttagggatccttggatccgaagtctctggcgccagccacagttccaatgcagtgtcgaggaggacggttgtgactttgacattggtgcggcaaggtatcatcaatcatggttttggcattactgacaactccgactttagccatggctctggcatctctggtgtgtttgtgacaaggccatgtcggtcatggctctagcatatccggcgacgataaggcattccggcatggcacggtagagatatcctctccctgtcatttgctgcattgtcatccgagcacgacagtagcaggttgcaaaggcattgcctagcttcttgtgcgatagacaaaggatatgggggcacccagatctcaccaagaacggtatgacttcgccgacaaaagttgcgctggtagctaatggcagtgcaacaagggcgtcatgccttgatctagccttgactgccatcaccttgtagctaatcctcatgacagcattttcatcaatagttaagggcttccacaccaacttgtagagcaatgtcattttagctataatttatggtattatctacaccctcatatcattcattcttcatggatcatacggattgcggaaatgtgtattggcttgactgcaacacaataattgtatggtagcatgtctagagaagattgcagactgtcacaccctgaagttttctctttttctagccttaattcaattaataaattgcctcaagaaataattcaatttaacctcgagctaaacccaaattaataaatgcaattaataattggaaatagcatggtgggatttttcttgagttccccatgtttaaatacattaagaggattattagtggaattttctgagcaaagaaaataattttaataattaaaatcaattattgaaattaaattaaaagttaacctccttttatctctcttttcggctgtgggccattttcagcccactcctccgcgcacacgctctctcctttgggtcggcccgtagccacagcccagctacagccgccgcgccccatctctccctaggtgtaaacatccctccttccaaaaccgcgtagctagcctatcccacttatacataccactccacttacacttttcattctcacatcgtgtaaaagggttatctcgagagtgatatggttgaagggacaagcccttataagttagttccactcttgctaaactagcaaggtggtactaaacatacgtatacaatgctcatgggccacacatgcctcatcctaattgggccaggatgttacatacacccccccaaggacctgatgccccgttgacacaacttacccagatagccacacatgcacattgggaaatgtccaggaacacactccccccttagcacacgtccagtgtccacatgctccatgcgccatatgcttgcacactgacccgtacatgcaacggcgagggtcagctctgataccatttagaacaaccctccctccaaaaccgtgtagcccagcccaactgacgggcaggcccacttacacatactatccaacttaaactttcatccccgtttcgtgtaaaagggttaacccaggagtgatatggttggaaggacaagcccttataagttggttccactcttgctaaactagcaaggtggtactaaacgagcgcacacaacactcataggtcacaaaggtctcatcctaattgggccaggatatcacactgggtcgccgtcaggtaggaccactgttgggcccatcttcaaccttcgcaggcaaagccagagggcgtaaccgccgccccgtgcgccccgtccacctcgcggcgcccactttgcacatgtcgccctcttccacgcccccgcaccccactctccccacgcttcgtgcttgtggagggcgtggtattcgattttcgaatcccggccacatctctctctctcctctcccacatccgctacaaaatccaccccctaccggccaagtctgagctcccaccgctatataaacgatcctcgtgatcccctcctccctttccctcttctgccgctcgttcccgtctttctcgaagtggttgtagaggttcaagtagcgcggagcaaggcaagccatgcatccctcattgaacatattatacctatattgcaaatgtctcgctttcttattttataatgtcagaattatccgttataacataagggtatatggttttattttaaattttaaattgaaaaggttaaaaaaaataataagaaactaaccactccagcttgtgtggcaacttgagagaagaggattgagattttagacatcaattctagaaattgatggtcagattaacatgggaatttgatttttagtcccaatcttttgtttgttagaggtggtaaaatttcattgagaatttagttagagactagataaatcttaaatgaaaatagatggttaagttttgtttaggtaaattaaaagaggaatttcctccgaattaccacccatgcccacgtatattttgaaacagtaaatttttaatggcatgattataattaaccctattaaaaatgtcactcaattccctatccccgtcttacgaaaaactctcgtctcccctaatcaaactgaacattttatagccacatcccacaactccccctaacctaaggaccgttcgtgcgcgttcggctattttctgcccttcctcgtatccatctgcgacattacccaccgcgcacggcggcgacacggcagtggccggccggggtactgggcttcagcggctacagcctatgggagtttctgggcgctggccgcggccgccggaccggtggtctcctgacgcgcttccacaaggtccgggtgccatatgattgttgcaattgatgttttcacccattttttttttctcaaaatattaattgcgcgtcaggtagggtagaattcgctatgtgggaatcgatttaatgccgaataaattactcttgtacaagtagaatcgcatttggttaatttggtgcgtcgtctcatctactgaggggatttagagggtcagcctaacgggattgtggaggatttgatttttctttttgttgttggcatacgatgaatcgaggtgctagttttatgttcgtggatttgtttgagtgtgtcctcttaagagagcctaacaatgcctattaactgaagatagacttttgcttttatgcagaatttatctagctaagtcaatattggtagtgaagtttattttcccttttttccctcctggaaaatgcaagtgtagttttgaagatgtggattgtggaatatgctggttgctagaacagttttttgccacattttggttgtcaataagagaagtttgtcccttgtgatgagaacaaacatatagcccttagagaatgaaatttgtagctctaaaaaaaaaagaacgaaatttgtcagtcttgatcaccttggaaatttccatactagactgaataaatccctactgttcttcgtgatactttgagtctacagatatatggcacagtgcagtttcctggtagatgtcacatgaagtaaaaacgttgaataccataagtccagaacttgtgaggctgaggctgtacttctcaaatgcaattactacctgtcacgccctaaaaatcgcctaaattaaaaatgcatattttaaattatttttagaaattattttaaaagcctacaagctaaaccctaattttctaggaaaattttcaacataaaaatgagctagataaaattttattaaatactatgcttgctcttctattttctagaattttctgggaattatttgagcaagggaagtatttttaataattgaaacaatatttcacaaattgtttttattgaaaaagttcaaaaaacccctccctaagccgttgggccaaattcggcccaacatctctcctctcccgcgcggccgagccggcccaatcggcccagccgacgccgcccgctcctctctcctgtggagaccgacaggtggaccccacctgtcgggagctccttcaacctccagccgccggccggcctagccgagctgcccgagccgcctcctttctcctctcaaatccgctccaatccggccccgattcctccgggtttttgaggggattttatcctctcgttctcctctatctttacccccaagaatcggagcaatccgttgagtattctctccgaatcgagttcgtttcgagtttatccctaaaaaccgagtttggatttttcccgagtcgattcctctcgtttggagttcgatctcttcaatccaagcttatataaagcatcccctcgtcgccctctttcgtttgccccctttcccgagctctctcgtgcctcgtagtgccgtcgccgcgttgtttttgttcgccgccgccgccggccgtcttcagtcgcgccgccgcgccgctcccgttgtcgccgccgcttgccgccgccgccgttaggtgcactgtggtgaggagaacctcggtcgcccgtccttcttcgccgccgaccaccggagtccgccgtcgtcgtcaagccgagccgccgccgccgtcctcttcgtcgccggccgtcatcgttcgtcggtagacgttgtggtgagtaccgttgggttcgcctcgtcgtcctctacgcgtaggtgtcctccgatcgctcggcccaggtccctagctccggcgagcttgcaaccctaatcggccggccgtgggtgacgtcatgctgacgtcatcatcttttctttttcccgattttctaatagattaaaacttcggaaaatcataactaaataaccgtagatccgttttaggtggttcaagttgctaaatttttttaaaatcaagatctacatgttaaaaatatccacatgtactgtttatgcttgtttttgtactgttttgttgattttgtttaattgctttagtttccgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccggttatttattggccgaagatgactttattttcctatgggttataatttgattagcatgaaccttatatattggattggttcagctaaatgctatatgtaagtttgcttagccatgcctagaaacatagctaattaaagggattaattataaactatgttattattattaatgatggttattaaatggtagctcacgatggctgatcgtgtgatgttaattaattgataattaaaacctggttaaggtgggttgtgagcacatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcatactgagaagtggcgagaagtccacgggggtcgctggggagtccatgccttgtttataagggggtgattatgatccaggaaaggtgcgctgtaatgggttatgttgtgcgaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcaataatgttaataatgtgataattaattggactcctggtttggaatggataattcctggtttggaggtttaatttgttcaactggggttggttgttcaaatatggttgggcctatgcaacatgggtgtgttgtatagtgttatttaatattgattaattattcaactgtttttactattctcttaaatgtttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttctcggttaagatgcctgtggagtggagtcgccatagctgttccgtagtttgttatcgttttttttcttttccgctgcgtagaatgttattctttgggaggaactatccacctctgtaataatttattttatttgcgaatattaaatagtcttttatttgaactctattattaatttgtcattgtgtgcctcggttgattcctggacgagggtttaacacacatgtaagcgtttggaattttggatagaaattccgggcgtgacactaccttttcaacaaaatcctgtcattcagactattcctcatcagtaattcatttcctcagtactactttagaaaagggcgagctctggatgcattgactaggaagatgaaagagagaagaaaatatatgtttcagaacactgtgtctcagaaaaattgtgtgtcttggaaaaattgttttggccagcttatgatcattttaaaaccagctagaatctgtttgccagaatccatttaatattaatcagatctggcacaatcaggtcctgcattgctgattgaaacattgtgtttcatgttccctgttttccagttagcaatgaacactgttctgcatacctcaaacataattccctctatcactaatgaccccataaaggtacagttaaaacaaatcctgttagtttgttcttctctcacaatttgtatatgcactatgctttttgtttgtttcccaccagaaatagattgtatcagtaacagacttttgttaagaactacacacttctattacataagtacatgcttgatccagtagtttagcttaactgataaagtaaatggccggtcctgcacattactgtagagatgcatctaactgaatggccaacttacttatatctccaaagaagtggtctcgttattttgtgaatattaatttagtacatttttctgttcctttccttttctttctttcgtttttcttttttgtaacggacatgttattttgaagatgtaaaatactatatatgctgataagaacatatatacaacatttcaagaaaccatatagcttttttttattccaattgcagaaaccatatagttgtagaagagatgaaataagttcatggtcaagaatatctaatatcatctctttctatataagaaaatgttttaatccgacaggttcatagtcagtgatacacatagtgacatgcatctatctgcatctttcatagatatgtaagctacttattgtaggtaagcatcagtgcccgaacacaatgccttattgaggaatcagtctaaagcatgctcttgcttcaaactacaatctatttattaacaggaagactgttttcatgcaagtgaactgatat

SEQ ID NO: 74685 - DNA, 6071 bp, Oryza sativa
cgccgtccccgtccgcccccccgtcgagctcgccgaccgccggagtgccgccgtccccgtccgcccgagccgcgccgccgccttcctttttcgtcgtcgccgtcgacctagggtgagccgtggaccgccgtctcgtttccccctttccctcccctctctcggccgccgctccaccgtgcctatggccgccgccggcgaccataggggcgcgggcgcgccgcctcccgcaggccgcgccgatgtggccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggtcctcgcacctctccccctcggctgacgcaataaaccatttttaaattaaaatttaaatgaagaaattcgtaaatattcatttaaagagcatataaacttcaaatggccatactttggccatttgaactcggaattggaccgttcaagtctctaatttttccttaagaagtcaagaacccatttttgtgctttgttcctgtttgttatatgaagtttattagagtaaaagcctttttcttttccgttggtcgtgtagacgctgcagcttcggaagatccgctcttcgtggaggttgaagccgacgtttgggaaagcgagcaaggcaagtcatatcatctttgaacatattggatcccactttatgaaattattttgatttaaattaatgcattatcgctttatttaaattctcgcgttatcactgttttatttagccatgcctatttacctttgttatgaccttatttttgttattgttattattactttgttcaccctagaataaacaaaaccccaactagtgggcgctctactcatggttcccctagtatgaatttagatagatgcttcgctgattaataagacaacattaggtggtttttataactttagactttgggaatattcatatctcttggactttatggaatggttggactattgtggaattggatgcacacctctccctctattcaaaactctcaaaatggttataggctgggcttggggtgcatggttttgatagtagcacctcggccacataaggaccggtcttcgggcctctgttgcaaagcactaccgtacttccacatgtatagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacaaggctggtgtcctgctgctaggggctcagtcctacctacctgtcccggaggttccggctgtaggtggggttgggtcggtactcttgtctatggctaggatgggttggaaactatgtcatgtcttccgtccatatgccgtggtggtatgtggcacgtggttgcacatgaggaagacgtgtcttgtgggtaaagatgtacacctctgatcagagtaaaacctattcgaatagccgcgccctcggttatgggcaagcctagcaatgtacccaagttagtgtttttaattcttaaaacctgcttaataactaaaatgtggaatggttggcctgggttggcttgggacgagctgggacccagggtcgggttgccggttcggtctgaatcatcgtaggccttgggttaaggcaggttcgtgtgggttcacggccttgtttaataatattaaatagttctaggatcgtgttttaaatttggctttgagcaactaagagtcttttaaatgctgtttattgcaaaacctaacccctatactataactccattgtactcctttgcatttatgttgcacttgtgagtgtgtcttgttgagtacggtggttgtactcagtcttgctcaatttttcccaaacccagaagaggagctcctggatgatgaaggctttggtgtttagctcgtgcctgccgtcaagcgcctgtggtcgtcgccctagtcttccgctgtttttcgttgtcttcgtgtgtgctgggccctcgttgcccatgtaataattaactatttacgcttccgcttgattaaactctgaattgtatcaacttttggtgtaccttgcctcctaggacaaggaataatacacgcacatatggaacacccgttgggttatttccggtcgtgacatgtgtcatatctaccaaaaatctcttatattatgggtctgtccagattcattgtactagtatgtgtcacatttatattatgggccggagagagtagatatatatggacggttggtttaaagtttatataaatttaaaatttgaaatatttatgatcgtacggacagttgatttaaattttatatggatttaaaattttagatatttaaagtttattgagatatttaaattttgaaatcttttactaccttactatcatgtctatctatatatacgtgagattcttaactggacccaccattcccttccattcctcttcaccacatagctgaatcttttggcgcatcatagtgtccggctcgagtggaacaaaaaaaaacagtaactgagctgaagaatattaatccatgggaaactgaggtgatgttgcaacaaaattcattgaacaaaacaatgcttttggcttgtacatgtcaccttttttttctacaaaatttgatttatagtctaccagctcagttgcaaaattaagtccatattgatctagctacaaatgttcgggtggttgcatttcctgatttacatttcctgatttattttattttgcattgatgcaatgctttcctagctctgacactgcttctcctttccttgggcggttgaaaggcagaacaacaattagagcaccaatcaccaaatctttattcaacttttattctgaaagttttcagatgattttgcaaaacaaagctaagttcctcaaatgattcactcaatctctctaagtatatcaatataaattcctcaccattttttgccctttttattcctattctaaggtttgatatgtggagtttggtagagataaaacatggcttacttgcattcatatttattactaaatcaaaaacccagactaaagcagataactaaacatactcaagatcaagatcgtgcaaagtgtgtgtgatatatggtggacatgatatataaagaaaatgcttctcctttatgcttattttcttctcccaaaaatcgtttttttattgattaggagagagcatgcaagtacatattagtattatcactttttttccattgtgtgtgtgtttcgaacaatagttataatttcagttcatattaattgtggtcagttccagtacatattagtattaaattcgcatcccaatcaatttctattacaatttagttgtcatgctaatagtgcctattatctcagttatttatttagcactccagcagccacatggatattgtgagcaatatttatagcacattaactcttgcgttccgtaggagaagctgttgtgcctaatggaggaaagaaagaaaaatatagtgtcattacactttactctttgaacgtatctggttgagaacttctatttttaaatgactatagttaattatgttatttgctttattccgcacccatgccacttcgggttacactcagaagcccaaggctgtaaccaagaaagaaaagtaattcactgcatccctctgttggtatagtgggtgctttatatatagtttttttttaaaaaaacggtccatttttacagctatagtgctactgaatacttataacaatttatatatgtttgttttgcaggcagcatggtcactattctactgtaaatatgatccagcataagtgcagtttgtatgtacatactagctaccaaagaaaacccaggcttcctatttcagcttgtttagttcggttagcactggggtcaatgaacatggaaatgtcatgcaatgtctctgcgtatacgcagtccagacagcactgtgtgtgcttacctctgacgataattttcatgtatgcctgctttcttagattttgtttctaaatacttatttgacttttctaattttcacctgttcttttaacctaactgttcttctagtttgttcaaagcacgccttattccttgctttccaaatcgaccacgtcacagcaactacccccactaacaggacggagttgttttgtatctttgtcacagtgttgtccatataccaaaagtatgttgaatatttctcacaggtttcaaatcgaaagcacaagccaccacatttcaagtaaagtcatggggcagtaaaaaaacagatgttgtattgtctcttttttatcacagaactggaaagtttcagtcccttttttctatcctcttttcttaaaattatctttagttaacacgttgtttctcagtagtaaccacacaaagatcctaattttaagaggtactttgatattccgaattttttttatgcatccccccaccgtgccgggaaagggatcctctgacttaaccgccatgtagttaagtcactgacatgtgggccatagcaaagtaggacccacatgtcagtgactcaactgcatgtgcagttaagtcagaggatctgctccccccccctccccaaccattgaggctgtctcttgcattttcattgcagtgtagaaagttttgacactaaaaactcctttttttttgtcggaccccaaattagttcatccctatccttactcagttttagtttgtcacaatatattttgatgctattccattccaaaagcttgttatttgtcagatttcttctaaaaatcatgttcccctcatcccttttattttacctaggccagagtcatgaaccgtgtgtgtatttctgtataagtgagggaattgttgtgccagaggtccccccatccagttgtcttcccaaaacaggatgttggccccatttcctgctttttttttttccaagcaatggataaagaaagtgtctttgatctccatgagcccttgccagaaatgtgatgcccctgttttagttttctgggctgttaggatttttcttgataaatatttgtctctaagtaattgttgccacagaccctcggttttttcaagattccaaagccacttgcctaatggggctttattcatagcctccagatctatgatacccaacccaccttattccttaggcgtgtgtttggttctgggactaggtgggatgggatgaaaccatccctgatttgaggattgggatgattccattcggatgtttggtttgtagaataggacgatcccagttttttgtttggttcaaggaacgagggagggatgggatgagcgccatttgcaaccaccgacaacgccgtttgcaacaaccatggccgacgccgcctctgccctcacctccggacgtggtcgccgccgacctccttgatggcgtcgatgagcggctgcggggggctcggcgacggcggcggtagacggctcgggcgacagcggcggcggcgggctcgggcgacattgacggcggtgggctcggcgacgacgacggacgggatgacccaaccgagcgctgacggcgatggtgtcggccttcgcgcagagcagccgcggctcggcgatgacgacggcggcgaggtccgcgcgggagagggagagggagaggccggtggagaggagggcgagcacgaccaccatcgcggtcgggcgggcatagaagcgcgacgacgcacggtcggccttcgcgcagagcagccgcggcttagcgacgacgacgacggcggcgaggtccgcgcgggagagggagagggagaggccggtggagaggagggtgagcacggccaccatcgtggtcgggcgggcggagaagctcgacgacacacggtcggcccgccgccgagttccccgtctccggatccgtcgccacaaccttccccatcgccggatccgccgccgccgccctcc

SEQ ID NO: 74686 - DNA, 7386 bp, Oryza sativa
gctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgcaccaccggtggtgaaccgatggcaatcctggaacaggagtcatcatggcattcattataccagcatgtcgatctgagataatacaaacctctctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctactagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacataaaagtaatcatctggattcacatattggcctgctacttctgtcgggtattcagggttgactccgtacgacgaccaatgaatactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttcaccctccaagtcttctcgtaccaactcactcttacttgcaccccctccacggcgagaataatatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagatgtttaggataagattcagtaaaacttttgaaattccaatattcaatttatattgcaataataagtttattaaatctagtaaatttatgatactgtgatagtatttttcgagacaaatttatgtatatcatttcttttatttctaaaataagcatttgaggaactgttgatggttaaaattttttaaaaaaacataactgaatttttcctaaacatcaaatatttttaccaagggattatgtgacatgagtatggatttagtgttttttctaaatcaatagaacaattttatttactaaacctaaataacttagaaaaacaaggataagccttatattcttcttaaaagatgagacattctttattattatagaacaatttggatatttttttccatatacaagactttccattctcaggaaacacctcattgcaaacatgaatatgaaagtgtttctattaaacagactttcagagtgtaagtacacttaaatcctaccatctgcttagtgtaatttcagactgtaattataccaaacaccatacaaaaattcattttccttacagaagaacacagtttcactgctgaattagtttctctaggttttgaatatattaatgtctagtacaagttgaatctcatatagtatttgcagcctcagttcatctgttacagttgaaattccaggtctgtgtgagaactgagaagatcaattactctgttaaaatttacagtatatgtcaatccagcaatatgattctctatttcaattctgtgatatacaggagtgaatgtcctgtgtggtgtgggggtcctatcaacgccttatgctgtcaagcaaggtggctggcttgggctgattatattggctctgttggctgtgttggcatggtacaccggcatcctgctgaaacgctgcctggacagcaaggaaggccttgagacctacccggacattggccacgcagctttcggcaccaccggtcgcatcgtcatctcggtaaactgtcagtttaaatttgttatgttttcattgtgttgttccatggatgatgattctgtggtaactctgattttctgatgtctttcaacctgcaggtaattctatacatggaactgtttgtaagtacttcttactgacaattcagtttagttgtgtatttgtattagattattagttgatgctataaaaacattactctctcccgaataaattagtaacgcaatttacagaaagagttaaattaatgtattactaaatggtttgtaatagaatattgagtttagtggagcaatttggtttcagaaaaagaaagtcaagcattaaccctactgaaaattgaaatttatgcaagaatagaagctggaaaggttatcataaatcaaatataccagaattgtatgttaagactggaacaactttattccgtaaagcattctacattgtagtgttaaaaagaacagatgaattgaactttgaaccattctgttttattttgtacagaatattggcaacatattcattggtcctaatgtttctctacaggcctgttgcattgagtatctgatattagagagtgataatttgtcaaagttgttccccaatgcacacctgaccattgggacatttacaataaatgcgcatatattattcgcaatcctgactactctgattgtcatgccaacaacttggcttcgcgatctcagctgtctaagcttcatttcaggtatcaacacttgtcaccggaatcctttgtttcaccaaatatatttgcaaaacttgaacttattgaatattacacacacacacaagtactctttcaaaaaaaaaaaaatagtgggccaaggatatgctgctggtatttgttactttgagtatatgtggacacacaccaaacggatgtgcaagtgtggtgtttgcgcatacatataatcgggaaaaaaaaggggtgcacaatgtgccttggatctcatcttgttcattctgttatagctggaggagtgattgcatctatagtcattgttgcttgcctgttctgggttggacttgttgatcacattgaggccaaggatgaagggacagcactgaatctcccaggaattcccattgccgttgggttgtatggctactgctactcaggtcatggagtgttccctaacatctactcttccatgaagaaacgcagccagttccctgctgttattttcacctggtaataaccctagaacaaatgtctgtgattcataagttctttaaaaaacagtgatgccaagctttgcttatgtttttttttcttgacagcattgcattatctactgttttgtttgctggtgctgcaattatgggatacataatgtttggtgaatcaacagaatctcagttcacattgaacttgccatctaatctggtagcttccaagattgccgtctggacaacggtattgttcttgtctaaattagaggaagctatgacatctagtacaatgttgacataaatgcatcacttgtatgattgagtaaaattaagttatgtatgactctttatttcagtcatctttagcattctctgtaacatctggtatagcttctaatacttaatgttgttattaggaatattgtactctactgatagtgtatactttgctttttcttgcaggtgacaaatccaataactaaatatccttactgtgttattttgtcttttttacacctattttcccacgctactttgtcattattgaacaacatgttggcagttcattacaaactaatagatagctagttcaattatacggaataagaagattttcaatttattaggttgtaaaaaagcatatttaattcaagtttctcataatgttgtttcatactttgttccatgttgtaagccgtttttgcttttgtcataagtcaaacttctcatctataataacaaaaaagtcactataaaagatatatttcacagtggattaaatgaaacaaattaatttgatgttgtagatgttgataattttttttgtaaactcagtcaaagttagagaaatttgacataggacaaaagctaaatatgaattggaggaagcagtttggatatccttaactaataaccacatatgcactgaccatgactcctcttgcccttagtatggaggagttgctacctcctaatcgacagacatactcaaacatagtcatgcttagatcagcacttgtgctatcttccctcattgtggctctctctgttccattcttcggtaagtccttctcatcacttatatcagtactttccaaaatgactatgttgcttattttctgttctaatcttcacatttaattgatgtttttgagccctttcaggacttgttatgtcactagttgggtccttcctcaccatgtttgtggtgagttatctttccttcagtttttttttttgggtcttagtcatgctgtttataccatttatatatacatatttttggttttaggcgtatattctaccatgtgcatgcttcttggcaatccttaggagaacagtgacttggtatcaggtacaaataagaattattttcatcgaattgctcaaatacttcaatttgatagttgttcaatatagaaattattactatgttagttttccaactgctgaaagtttacctcatcccatgtctgattgtctaccacccactatctaaattacacgccggtcaatatacagatacctatacattgtcataaaaccaatggggaatttcgcaaaagctcagtagcatgcaaccaattaattttactcaccttatgtggacgacatcaaaactccagcttgggcaacgtttgtttttttttttgcgaatttgtgttgaaaatgcttaattacttcccgactaattgaaaggaagtcttggggatcaattcagatgactatgcagacaaacacaagctgcaaagatcctgtactgtttccaagtaaattatgcagtagtcttcaagctttccttaattttcttacaacaggtcaacaaggcttgaagaagaaacaattcgatcatatttgcaagaaactaatttgatcatattcacaatatgcaacagatattagtatgctctgccaggaatagatgaatacatatatgtatatagtaatccaggtaatggaacaatctgaagattaaatggatcttataatttagactgatctgtctagttcaaagagttcaaggatattcattaattacgcgtcgctattcaccaattcaatctggatttttcagtgggaactaattagcattctttttgtatatgcaagaaccaaaatcccataatttcaatattcaagctcattttttttggaaatatgccatttaataaacatgaataccatctcttgcaggtactgctatgtgtattcatcattgttgttgggctctgctg

SEQ ID NO: 74687 - DNA, 19644 bp, Oryza sativa
tttgcgttgtgcttagctttgttgaccggggatttttgctgccctgacctcgcagctcgaatcgacaaaagcagaagagaatcatctcacctaccaagcgtttttattcctcctatcattctccattagggataacttgggcagctttagcattcgacgtggacagaaatctcaaaatgcacaagctaaaatatcgttttttttatggagtatagtttgttatggtggattgcttattgtgacgttcttttttatatttgaataggaattgacaagtgctattagcaatagttttattaatagtgtaaggatgcttaaacattttggacttgctctgaaattttgggacctaggcggctaatagagctgatgactataacttctaaccaccctgcccctgttgcttcacacggtaaacaactgcttttaaaaaacaattatttttctcaaagattaaccaaacatctctttttaaaaaaacaaactcttgtattggactattggagccggctcatctatttcagctgttcaatttccaatatggaaattacaggttttccttttgcgagggtgaaaattaatcaaattacaggttggagaactatctttccaagaagatagcaaccatgactaaactgaaacattgcatcctgcaactccaagagagtactgaaaatcttgatgttctatcgtggaacgtcgaaactgtttatttgtttttgacgttgggtttgacaataatgacatgtttacagtgaagtcgaagctcctatgtaacttgggtggcaagttcgcaatggtaacacatgccttgtgtagtcgaggctgttgtgtcacttctacgataagctcggtgacaatacctcacgttgggtttaggtcgtggtagtttaggttagattagttgttgtggttgtgattttcgctcaggttttcctaattaacagtgcactataaggtttattcgtatttactctttaaaatgtgtcacattgttttttatataaaacatcggcaacgaactgacgttttttttgggaaaaaaggaagaagagagaagagcagcgcaaagtctaattgggctttgtcggttgggcctagttatggagattgaaagataggctagaagtaaaattcagagtagcttttagcgattcattcattgggccaaattttgagtttgggcccaactattccttctatttcctgacagaataagtcgacttgtcgtccctcaactttaacgtcttgacctcccttatcctcgataccagaaatcttcgcccctaaactatacaaaaccgtgcgtaacttatgtcccatgacagtatagacccgtttttcctgtttttgctttcatgatagatgaccgggccatttggcaatctgagaggagatggcggaggcgccagtggaggagatcgagggccggagctcgcagagaacgacaaccagtgccgcggcccccgtcgaacatgctgttcctggcgacatagcagtctcgtcgtccatccagcaaaaagtattttctatacctagatgcctaggtgtatgcatgtaattcaaacagttataaaaaatttcataaaatttgataatatagtccatgataatataagacaatatgtaaacatgtaagtgtaaattcgatcgatatataaagaaacaaaaataacaaattttatctgcattgtacgggtactattcattatctgattttattatttttatttctctagttgtagatcgaatttagtcttgcatgtttgtatataaacttatatcatcacaaacaatgttactaatttttttctataactatttgagtcgtatgcaaatgataggtgtcatggtacttttggtacttatgtgttgaaaatcctttgtccgtccgtccatccagccccagctgtaccgctgctcgtggttcatgctcgctgcggtcgccacagcaagacgacggccagcgcgaagagctcaccctgcacatccgacacgcgcgccatcgggtggaggctttttacttggtgccgtaacagaaatccgcggcggcgccgcgttcgtggttcctcgccggaatcatggtttacccgcttgttgagaggagagctctcgtggttcactatggttcgtggcgtggtaattgttggatcggtcgtcgaggctaacggccaacctgtctgatgattctcgcctgtctcgtttagccttcttgttccatcctaaattgtgatgttttcttttgcatggctagcttgtttgatcctttggggattttatggattagtacgattcttcttttggttcttgcgtcccaggagggatgatggacgagtaggaggcgagcaaggggagtacgtgacacggcttcgccggaagagaaggtggcggcggcgaccaggaacggcggcgtgctcggtggggccgcggcgctgttcgtcgtcctccgcgagctccggccctcgatctcctccatcgcccgtgacccgcgcgaaaaatttgataatttgacactttttttcgttgcccaattatttaaattggcacttgtgaggatgataagtgggaccatctgagtgaatgaaagtggatcatgatgtcaaataatcaaaactcatttaaaggagtggtaaattatcaaatcgctcgacgtgcgcatacccatccagacatcgaggtctcctcctcttctaagaccgacaagtgggcccaatcatatgccagttaagaataaacataaaaagatgaggcctatatataatgccatgtacctaagttgtattttttttatagtttaagggtgaagatttcagatataaatcaaactcagcctaaagtttagggatggcaagtgaacttacagcatcatcgtttggcttatctgcggaataagccaaacgacatatttgcaaacgaaaaaaaaaattatgaataaaacttttatatacgtgtttttagcgatctaaaatcaaagatcgaaaaaaactttaatggaagaacctcaaaattaactccaaatttaaagttaaaaattaaaattttagctgataagtgtaagcacaagtaaaaagataatgccattattcctttgctgaccggaggaaatgaaggcccaggcctcaagtgggccccaaataggccgtgcgtggtgctgtacgtgcggccacgtgggcaactgcgtctccgagcccaattcacgtgtcaccttcgtctatttattttctcacgtgataactaatagggaaataaaattgaaaatatacttttgtttcctttcaatttacaaaaatatacttacaaaaatatatttgcgaaaatatacctcatcctaggttagcgggagcggtacggtaagcacggtcgcgcctgccggtcccgcacggcggttgcgcggaagcgatgcagcccgcggcacgagtatgcgggagcggcggggatgcgggagcacctcgggagcggcacggtcccacggaacgggcgtgcgggagcggctcggttccacatttttttacggtatcagtactgttctgcactgttcaaacagcggtgccgccgatccaacgtggaaccggctcatgaacagtgtcaaaacagtgtgcatgtgcagcttggctgcccgctcacgcgcggccggcctgcgtgaccgcggtgccgcttggccggtccgcggtaccgagcgtccgtgctgcgggaccaccggtccccgtggaatggtagtgcgggaccgcctcgatcccgcgtaaccacatcggggaataggtatatttgtgcaaattttcgctatataggtatataaacacaaaataataaaaaaatattttttcaattttctttcaactaatatacgcagtaattaattaaaaataaaccaaggaaagttggaaggtataattgggtgatgcacctcacacttgcaccgaataacatcacttcagctaaccaagcaatgtttccttttcagtacccattttacaaactcacatttacaccaaattttttgactagtggcggtcggtcacgcttagcggcggtcgatctggtgctagccttctcctgggcttgtgtgttggtgatgtcggtgtgtgggtggtgatatattttttcctttttcctgattacgaccctccaaggttgtaatcttgtaattttttcctactctatcaatagaacttcgcaccgtctcgtgcgagtcgtttaaaaaaattggcttgtttcttttcaccctctcttcagatttatagatctagttgtattgtcccgcaaaaaaaatagatctagttgtatttaagctaactctattttaccaataataaatcttcatggtttgtgtcgatgtttggcaataataaaagggtagcttaagaaattaacctaaaagaagatggatgaaaggagacaaaggtttagacatgtttcacactttcccgatgagaggtaacaccctaattccgtttagtgaattggccatcttcaatctttctcccctgtccaatgcgcgatattatttgaacttcactagctacaattgtgtggatgaaggtagtaggagtacatgaaacattacatgaactcacatcaaatgctatttgtaatgttcagaccttagtgttccagctagtcagtcacggactcacacattatgactatgagtttcaactataccgaacgttttgagatatatacttcctccgtaaaagaataagtcgatttttctacctcatcaaagtaatctcaaaagaattgatttctagccccatacctaacattggcagatcggctcatgaatcgagatatattaaataggctttatctcttcaatagccttacctaccttaccttacgtgagaacactacgagtatttattattagacaaaagttgaacatccaacgcaaaaagtgacacttccgatggactccacaatttttgtgtaattggctgtggacactcgagacaatatcttatcactctcgagagaaaagatgagagaaatttcaaaagaatataaatgctctggccttagtcctatgtaagcctgataaggtgtggtaaatcacactcgtcgcccacgctccacaccctcgatccccttccaatctaaccctaggtggtggcggtggtggcttcgacgacggctggcacgaacggcggctaaatactactttcgccattctaaaataataataatttagtaggggatgtgactccacatagtataacaaatctgaacagttctttgtctagattcgttgtactggtatgggagatttttttttctagagggagggagtattcattaatcatcaagtcctctggggacggtgggtgcagaaatactcttaaaaccgaggtacccaggagcaaaataaaacacctccacgagacgggagagattctccaaggaaacaggcccatttctggccacatcaaaaaaccgctataaatttcgcctgagccacgcgtcgctccctctcctcttctccgttgctgccgcctgcgtttctccgatttctcccccctccgtcctcctctcgccgtcgctgcctcgcctccggcccgcgccaccggagcccggcgaggccgccgggcgcgcgccgctcgctccgcccccgctggaacctccgactccgcagctactcccccggcgagcgtcgccttttttgcggcgcgccgtcggccgtagcgttccacccgggcccggacttctgggtgaggccgcctcgggaataatgatttgctctctttcgccgtcgtgttgggctgtggggtgggtgacgcaggatcgcgggtttgagttgtgcggttttgttcgtgcccgagggtggtacggactacggaggtgtcaggttggcggttgggtgcggcgggggtggtgttgtgttgtgttgtgtttgggggttgggttagggtttggagccgctcgatttggggggaattggggttttggggattcggcgtggggaatgggagagcttcggtgcactgaatgggggttttgcggggagcttgggttgatgatttgaaggtggggggcattgggtggtgaactggtggtttacccctaggtgttctcaatccttcaatcggacgtggattggagctgaggaatgactacttcatgctgcattcttgtctgctaaaagtggctactctgtttctaccataaatttgtgcttgtcgaccgaaccgaaggatggaaatgataagtgtgttttgtggctgtgcattcgggggcttgttagttcttgcggtatagggatatcaacacgttgctgctggattaacgaaacatgaagggtgtattgttgacttagtgttagtgcagctacaccaagtaaaagaactagttgctcattggatttatgagtgttgcggtgctgcattttagtttatatttgtgtggttacatcagataaatgttaactcatcgctgtttaattttgttgtgaagattagcatccacgtgaagcgttctaagtcggattgacacaaacgacaaaagaaaattgtattgactttttttaaccatttggtgctaaatgtgataaactatcatatcccatgcagtattgaactaatgttatgaaaaatttgacactatatgatatgccatatcttcttataagatatttatgctttatctgtgatttggctgttgctaatttagagcttcccatgaagaagtgaatagtttaaaaacttatggaggtgtcttttgttgaattacagggatgcaatgcctctcttaaaaaggagaccgttcttcttactggatccgccaaaggacttgaatccagaggacaaggtgttccaagttcggtataccaaggagatattccgagattaccagtatcctctttcatgccttaatggctgcttattgagttgtcctttatatgaagaataatttccattctaatctgatattatgtacttgtattagattatgttgaagtaatatggttatgtccttgactatttattagggaatacctgaatagggtaaacctttatcgtgaaagagtttggacatgtaaggtgtctggaaaatcaaatttaacatatgaggaagcgctggtctcagagcatcatgctgcagagaaggctcaacagttgccaagagagttaatagcgcctgttctacatatgattcaatacagtatgaccaccaagcttttcctaaacctgttacagttcttggcagcgttattatgattgcacatttccagaaaatgcaatggttttttatttctttatggtgcacactgttggtctgtgtccaaattgattagtattctgtctatgcattttctcatttttcctgtgctatatgaagtttgactgagctaatactgtttgaaagatatattaggtccgtagttttccccttggggtgtagtgtaacacgcagaaggctttctgtgtgacaaatctctcttttttataattttgatgagatgtcgtcctgtaattgtgcgcccatgtggaggttgtttgcctagtcctcaacttcactatagtttgcaaaagggacaatctgtgacttattgatctactgtatatttagtatctgtactatattattggtgttttgagtggtatcactgatgtgtatcattagtgttcttatatagttttttgaattctcttctgtgaaggcaagttaattattccctttacaatattttggattatttgatgattttgatagagtggaatttctactacatttgcttcaggcactcttagcttgactgaccttgtcaacaaaatatacagtattctccaagaagacttttttgaaggattagaactaaatggtagaaaagatggttctgtgtctgcttgcaagatcttaaaggttattattggctctggtaacaccaagatgtatgaggtgggttggattggtcaggacaatgcagagactaacacttcagttcttcaagccgatgatctagtaattcgcaagaaggcacgcgctagtcgtagcatgctgaaaatatatattagggagtcaacatcacagaattccccatggattatacatgcaaatcttgcaaagaaatatggaatacccactgagcccccaaaagacttattggtaaccatcttccctcattttatttactgtgttccttattatcttaaacctaaaaaaccatggcttgtagaatggtcaagggttgccaaaactgaggagaggactcgagaatggaaccacagatgatgtcagaaaaaaattgaagaaaggtgacttaacagataaccatgtcatcctctcagttcatttgatgttccatacaactacatttttgcccagcttcttattgttcactttttgcatgactatgcaggtgagccaattgatgatcttttattaaggcctacagcagatgatcccagtctgtcaaaaagacgtccactgtctacagatttcagagtgcctgtagattctgttggggatctacttatggtttgggacttctgcatgacttacgggaggattttatgcttgtctccattttccctctcggacctggagaatgcaatctgccacaaagaaagcaaccttgttcttcttgtggaattacatgctgcactcttccatttgctcattaaagatggaggcgggtattttatgtttctccagaacaagagaaggaaattaaaggtgactttgccttatccatcatttaagcatgcatatttttttgtcctttcttgttaacttgcactatgcgtaggtaacattggtcacctgggctgagtatctatgtgatttcttggaaatgacaagtaaagaagaattctccagtagtttatcaactgtaagaagggggcattatggacttgttcacactgccgtgaagcttaaaattctgcgggaactggtagatgaagccataacaacttctgctgtaagacagaatatagatgaaaagattgaccagcaacaagctattgcagcatcaaaaagagagcttgctagaaataaaaaggaagagcataagctggccatggaaggggtgacagaaaaggaaatgagtcagacagatgctgcagaaaatgtcaacgggaatgtaaatggtcaggttgtggaaaaagaaggaaaggagaagaaaaacatttatgccaacaagatgggagaggggaaagtacatcctgtgagaacctatacccttcttcatgtgaacttgcatatgcacgttcattcttacatatgcaaatgcatgtctctgctgaagctatccatgacagcaggtgcaagtcttgttgctaatctttgctttttctgcatagcagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgtcgaggaaaaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcacgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcacagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcctgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacgatcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacagcagaggcaccttggaacagaaatggagaaacaatctgtacaaagcaattcccttggaaaagacaggtactacaacagatattggttttttaggcatgaaggacgactttttgtcgaaagtgcagattccaaagaatggggttactacagcactaaggaagaggtgatcactttgcaaactttgggaatccctatgttttattttctggctaacagttctgtttcaatttgtaatccacagcttgatgcgcttattggatcgttaaatgttaaaggcataagggagagagcactgaaacggcagcttgataagttctataatacgataaggtactcaattttcattcaaagaaaaaaatataagataattcactcattgctgtagttgggtactttttacatgtttgatggttgcttctgttaatttttggaagtgacagattagctggaaagaagttaatcatcccatgtcaattttttgaaggcctacatctaatttttttaaaaaacaaaatgttatttaatgtagataatggtccagaatggtctttactggtggaacattcagttcaaggcctaaataacacaccgtagcctccatttttcactgaatggatgcgctatacttgctagacatgatcgaagctcctaaaaatagatcttgaaagattaatcattgagtgtaggttttttgagacctgtttgccttacagttgcagtctttatttgtacaagtaaaatgttctttgtgtgtttctcaaacatgaaggaaaccttaagcatgggcaccatatgctctcatgttacttttcagcctgtgggcattggacacttatggtaaactctttgctctgtttgtttagcaattgacctttgtgttggccgatgtagcaatgctctggaaaaaagaacgaaggacgtcacccagaaaatgctactccaagaggctgcactgcggcgatcctctcgtgtacaggcccaaccaagggataacccttcgatgttattcctcaagtatgtcaacaaatggaaggaaaactgagctcttactggttgatatgatacttgataggttgacatcttctttttcttttttactccctaccctttgaacccttgtagcggtttgttttgggtccttgatagctgttgatacaccaaaagaggaaacctgtcatttagacatagtcggcttaggcgagctgcttgaaggaaagatcgcattcgagtggactcatgctgctataagctgatgatcccatatccattttggaggattgggtaactgagagttgttaagcagtagaaatcctctgtatagtgaagagagtgcagaggtccatccgttgtatggaactatggatatgattgttccgccttgtcgagttccatgaatctataccattacctgtttattatcaactgttctgttttgttgtctcgttattatgttttgttttaatgagaaaattaggctctaatcttcatattctgttttatcgtgagaagttggttttgttcttgcatttgtactttttttaagggtccacgggagatattggaggaacaggtatctactaaatcctaatgtagtatatttctgtaagagttaatcacatctatatgatcttagaaaaaaaataagaggatttctggtgaatgccaaccaaatttcaaccaccccactgcacaaccgatcgaaatttttacatcacaatatttaaatttaaatattcacattatttcagttcccagagcaaatacattacaccagatttaacttacacccaggtgcaattgagcacatctaaccaccgactaaattctggagtgagggtcatccatattagccctgcacccagaatcgacacactgaaatttaattagcctaccaatcaacacctatgtaaattcatgtacaaaatgcccaatatttcctacccatataaatttacattccataatccgtattgtaatatacattaacaaaactacacaaaccctattctgctaatcacaaggcaagcgccttgtaccattgtccatggaccttctctgatatgactgccatatttatcagcatctccccggccttgacaaccctgtcggcgagcttcgccgcggcgaggcgtcgcagcggcgcttcggccagcttcttgcccttgacgccgccgccgccgaggacgacgccgcggaacgcgcagtagaccgtacgggacaccttgccgaagacgacgtcgccggcctggaggctcttgaggagcatcttggtcgcgagctccgccgtggcctgagcctgcttctccggcagagagagagagccgaccgtcgccagagagctcgccatcgcctccacgatctcctccgtcgaagcgtcggggttgctgtcgaggagcttcacgagagcgtcgtagagctccgagatggcgttctgcagctccggagcagcgaccttcgacaccagaacttgatgcaggacgagaatgctggaacagacagacatggtagattgatttcagttatcacatgcatcaagtataaaaatcagttgttctgaatcgacagatttagttcaaaagttcaaggtggagaatatttatttacctcgtcgcgatcacaatcaccttctgaaactgatcttgcacagccctcaacctcggcagattaatttggaaggtctcaggggttgactgcatgttcaggccctccacattgctgataagttgcaacaagccaacccttgtcagcttgtcgatcttctcacccttgcattctgggagaccagaaccgctagctgcggacgaagaagcctgagccattggagcaccgtgaccagctcgaagtgccggaacaacaacgcgttgagcctgacaagacgggttaaaattcagtgtcagtcagagaaaaacttaagactgctgcctatgctaatacaaccgtaaaaattgttgtgatcgtagagagacttacatgatctgctggcaaagcttggagagactccaaatgtgagctccactcttgttccacgatgctcttcgttgccgaaacccactgcttagttatagggagagacgctgatgcattagcaggaggtccatagcgatccgcgaaagccttctgcaggtactccactccggcagagccttttatgattggttgcatgagctggatgcgagccttgctaacttcagattgcagttgctgttaaatcacagaaaaaatgttaggaaaacacggcgcaaagtaagtgcaatctatgtcaggactaagtcaaggtgttaacattgaacaaacctttatttcttcgagagtgaaacgcaggcccttgatgacagcaatgacaaaggagctgatgccattgtcattaacttcggaacttgcagccaactcgttcaataatttctcatgactcctcttcatgtcatcttcctttgcaggggcagatagtttcctgatcatatccagggagtagtgcataatctgccccagatatcgcgtgtcctgggagcctgactcgagcacctttcatccaaaaaaaaaataacaacattaattcaaaatatactgggtttaacaaaagcaaattaatactaactattttattttgtcaagaccaccgattccttacctgtgacaaaatttcgaggtcaatgttctcgaggatttcctccttcaactccttggaagccaactcatgtaatgaatccctgacttccttcacgaggttaattagttgggtataatctggtttgtcccctttcatcgaatcagtaaccagatcccaaaacgctttctccatcgtcgatttcactttggcctgaaactccttctccgcggaactgacgttatcagagttgccaccaaaagaaacatcgtcctcgtgaagcatctcattgagcatttgctcattgtccgtcggctgtttcatcagagatgaactgcttggcgatgaagcagctccaggcaaagattgggcagtgaagctcgatccagacgaaccaatgctcaaaggagtagatacgtttgcaactgatgcagctaatgggtttccgttctccttcgcctcaaagaactttgaccttgtgtccgaaagagcagagttcatccgctcgatgcctgcatcgccactcagttgatgaaccttctctcgtaacagcttctgatcatcagcaacctgtttctgaatcgccttcatatcatgagagaggccattatgtgactgcccatctgaacttagcttgcacgtctgcatcatcgacagctcaagcttgcacgcagcccggacaagatcgtcctccagcgatttcgcatccttcagtttccacaccacaaagcagtagaggtaagcgcaccatgctctatcgaaatcggccagctgagcactgaacattttctgaccggcagcagcatcagtcgattgcttctcaagcacagtcttaaccaatagctcaaactccttgacaaagcttcctgctgaatccataagtagcttctccttctccccttgtccactcaacactgcacccggatgagccaggatcatgtaggagcagaggactaccctcagcgagtatcgagacgcgctagcagcagcagcaggtggtggtgtcttcttcttctttggagatccaaggtgtttcaggaggtgatcgatgtttatgaccggcgatgaaagaag

SEQ ID NO: 74688 - DNA, 4983 bp, Oryza sativa
gggtctaggtcatcgtagcttaaatatattgcatggtttatctcttcaggcattccatccactaaccatgaaggacttcttagtacctttccccactcaatttcatttatctctttgtggttcaaaagccctgcaatcgctttgatagctagcggtaaaccaccacatctttctaaaattctaaagccagtactctttagcttctcaatcgcatactcatctttcaaagttgaagcaatctgcaagcggttgaagcccatgatgttaatacatataggctagatttgcgattgatcgagaagggtaatttgtgcatttgccaaacatagaattcttagctattatttaagttagcatttctattacttcccggtctaaatttaattagagtaaccttacagttggttgtttacttcatactccctccatttcaaaatgtcactgactctaagttgtcccatttgagatgatagtgcttcatctttagccaaatgttgacaaaatgagcgaccgacatcatgcatgctccattcactattgggcattgcctgtataaggttccttataattaactcattgtaatactcctttcctagctcttccggttcatttgattttccattaacaaaaccttcacttatccaaatttcaacaatcaaatggttattgaggcattgcttcaaatgaggggctagctaggtcatcatagcttaaatatattgcatggtttatcttttcgggcattccatctactgaccatgaaggacttggtactttccccactcaattttatttatctctttatggttcaaaagccctgcaatcgctttgatagctacaagtaaaccaccgcatctttctaaaattccaaagccagtactctttagcttctcaatcgcatactcatatttcaaagttgagacaacctgcaagcggttgaatcccataacgttaatagatataggatgcatttgcttacctacttttttttttactttctttagtaacgaagatgatcattctctttgttttttgatctagaagggtaatttgtgcatttgacacacacagaattcttagctattatttaatttagcatttctattacttcctggtctaaatatatttagagtaaccttacagttggtttgtttacttcataatctgcaaaaactctccaaccctttgcgtactttccaatatgtctgcttcactacagtataacacatcatatatatcttgcaatctctatttacattcattaaacctataaacctatataattcatcccctcttagtgtacttaatagctatttcctgatattccgtgcttccacatcatcaagaaatgcattgcccgttcgatcgaatctggatacccctaataaatactttgtctctctattcacaagcttactattgtaattggacccatctcaatccatattttcctctccttctccacacccagcatgagccaccggcctcatactctgccatgacgagcgcaaatggcatctcctactctcccacatgacctcccgatcgcttcacactccccttaccctccaactccctcccccacttctaaggcccagcgctccaccacaatgtgtttttatacaggcacggccttatcactattggcttctataggacaattttatatgtatgctttgtgtgatttgataattttgttgtgtttatttaattttaggagcaagtggcttatagtatgctcaagcttttccctaagcaggtatttatttggctggatcacgttgaggggtggataaaaatctgacacaatcaatgcgtgctgtatggattctcaaatccttccctgtttatgtgttatgatgctaggcatactcctgttaatgcttccatataatgactgcaagagtataatgtttccttcaaatataagatagcatattgataggttggtattccgttctccttatcttaagctttgtatactcctacaaatttatttgcagaagcatggcatttttgtgcctcgtatgtttatgtgccattatgttcacataactaggcctcactatattgttgtccatgtctactcttatatctccatcttacccttttcacttagaattagtcactttttttaactagctgacctaagttggttctgtagaatacgtcaaacttgctcagagttttgccattcactaactgatgatatgcttattttctcttttgctccaatcagataaaaaaaagtaattatcacccagctcctatattttcttgatttgcacaaatgattctgaacattcccctagagtttccctataaaataccttggattgccactacttcttggaaggatgcgcaagacggatattcaaccaatcttcgataagatcgcagcacgggtcaccggctggaggggaaaaacatgggaccagtagggagatcaactctggtcaagtcaatgatgacagcgcagcccatctacctactcaccaccctcaaggtcaccaaagaagccgtaggcctcctcgaagtgaagagaaagaggttcctatggaaatgcaaaataaactagaaaaagatgtgcctcccaaccttgaaccgggaaaaaccggaaccagctcctcagccggttcgatttgctgcaaggactggacatgcaatcgaaccggtcacaaccagatgaaccgggcagtttttggtgaaaaccggtgaatccgacgcctctgaaccggcggttctggcgagcacgtggagcaggctacaaaggcccactaggcccaagtcatgcatgtgtcatttttactgaataaatgaaaaaagggtgggaagatgggattcaaaccctggttgcctcattacaaactcaataactaaaccaactagaccacttatgcatgttgttcaagggagaatatacatataatatgaatgctccggttctgcagtcgaaccggacgacccagcggtcagacctgtgagccggtgaacaagaagcttgaccggttcgatggccggtccggctttttgcactatgctcccaaccgtgcaaagaggactgggagttcttaacatggagaagttcacgagggccctgcgcctgagatggctctggcacgaatggaaagaccccaccaagccgtgggtgggcctcaagacaccatgtgatgaaacatataaattgctcttcaccacgaccactacaataacgattggggataataaaacgattcgcttctgggactcatcctggctagatgggcaaaggcattatgccactaccctatgcagtctccaaaaataaaaagagaaaaaaatactacgtgaaggaataaaaaacgacgtttggattgatgatctggacttaaatggcagcacccatttcacagtggatctgatcaacaaactcgtgtccctgtgagacacaacccagagcatccttctagatcaaaacaagcctgaccatactgcctagaagctttcaagccatggagaatacttgggagcgtcggctgatagagcgatgcatgggaaccataggtaccaattttaacggcttaatatggaaatcatgggctcctacaaagtgcaaatttatgcatggcttgtgatccaaaatagagtttggacttctgatcaactcgtagccagaggttggccaaatagcgggacatgccccctctaacgtacgtcaactgaaacagcaagccacctggttgcccaatgtagatacaccaaaagaatttggagcctaactaccgcatgggtagcatatcaacaactagacccgagtcactaggacccatgccaaagcgttaacgactggtgggaaatgttagccaactcaaaggaagtacccaagaaaggcatgcggaccctaatcctactcgtcgtctgggaaagctcgaaagaaagaaattagcgggttttcgagcacaaggagatggcaaaattaaaggaggcaagaacttgggctatgggaggagcaaggcagcttcgggattttgtttcgaaccaaccataggtgccatgtagctctgtacattttttttccttacccctagccctaggggttgtattttttacctctatatttaatgaaatagcacaatctcgtgctgattccttcaaaaaaaaatgaaactagttaaatagcacccattccacatggttttattattaggtggtggtgattgtgcatgcataactgacataacatttgatccacaagattagagacaaaaaatggttggcatacctagtatatctattactccttaaaaaacatctagtggaggtgacagtgaatctgccaccccactattgctttggctgttttcagaaattacctacagatattttctaatattgtggaatcatcgaaaatttggtttaaacaagtgaatagcatataatcaaataaacaaacaagtgatactaagatatctattatatattaaaagtcccatgaaacttcctacaaatgctcctaagccaccatgtgtcgctcctacaaacgcttataaaccgccaagtggcactacaaaatctaatcgttcatttttctttaaattagtgggtccaatattttcaaccattagatctaataaaaaacaaaactcccctatctccatgtatccccatctcccctcctcctgttggtacgtacatacttcactcctctcctcatctctttttaatttcttaatctctaatttaagccacatatcttatttttattgttaattaaataaataatttaatatctatgctgttctatgcgccatatgctttctatggcaaccaaatataacaaggaaaaaaaatttcactataaaaaagttaataacatattttatgttactttaaataattctacaaacatgtgtcgctaaattgtatcgacgatatccaatctatctattatatagtgaaagcccatcaaatttcccataaatgctcctaaacgccatgtgacgg

SEQ ID NO: 74689 - DNA, 1112 bp, Oryza sativa
atatgtgattaggaggcgtcagaggcctatagtatcaggtaacaattcgtaatactctgaaagtctgaattcctgataactattttgttcagtttactgggattttttttgccccttgagatgatgacccatcgtttctcccacgtcaactgaatagtcatgaaaaaaattgataagatagattaacatatgatatattgctccatgagacaaattaaacttctacaaattataaaaaaaaaacttctaatgtatgaatactttaatttgttgttttctacaatttgtagaggttaaaatttaactttacatgtactattttttatattttttcataactatttagtcgacgtgcacaaacgagaatttgactttatatgtaatatattttatagttcttttgtttttttaataactatttgacgatgtgctacaaacgggaggcgtctagagaggagaaaatcatccccatagttttctactccctccgtttcaggttataagtcgttctgactttggttaaagttaaattattttaagtttaactaagtttgtagttaaatatagtaatatttataacaccaaattagtttcatcaaatatataattgaacatattttcataatgtatttgttttgagttaaaaatgttactacttttttttctacaaacttaattaaacttgaaatagtttgacttttaccaaaaacaaaacgatttataatatgaaacgaagggagtgctttgatatacaagaaggtgtaaatcaatgcaattatattcaccagatgatgatgcgggcgttccagctgctactgctgctgttcatgctcgtcctaatcctgctttggctgccccttcaattaatctgtctagtgtgaaggaggctacagggaatttctctgaaagcaatatcattggcagaggtggtttcggcattgtctatcaggtctgcacttttttcaacaatttgacacctttatgtacgcaaactaagttacgatttgacttcactaccacaaatcttgaaatgcaaagtctgcattgaaacatctgattttacaatcaccaggggaagctgcccagtggtagaaaggttgctgtaaagaggc

SEQ ID NO: 74690 - DNA, 12587 bp, Oryza sativa
ttttgctatataattatagcatttgggtgcaatccaccggtgcagtttgcgcgccatctaaataccttataatctaacaacaaatattatattactatgaatcattctacattctacaaacatgcatagctaaattaaatatatagtatcgaaataaaaatttaaaaaatacatattcaatttgctaaaagaaaaagaaataattcaacaatataggtcgcagcatgatatgtttgaaaacatgtatagctaaacacactacataagcaagagtaactaactgaaatataaatagtctgagccactatataaaaaatcgagtgccttttagtagagaaaatattaagttttttttctaaatgtgctcaaataatccaaacaagctaaatgatcttctatttaatattccacctttataagtttctcaaacacggtctacgattcatgcccgcgcgaatgcgtgggctaccttccttgtttgataaaaagtatattttgctgtgacatattatgatattattttcttctgcccaaagcaaagcttgggtattttgctagtgtgtacagtgtgttacttttaatgaaactgcaaatacatgttaatgttggaaagtgctttcatggatattaattaagaatatattttatgagtaatcaagtcaaaggttaatcttgaagactttaccaatacataataggattttctacagagggaataattaccaaaataaatactctgaggcaggagtaagaaataaatacgaacctgtttcttgagtaacaaccaggcatcttgccgagataatatgtccacgcggtggtacggctgtatggccttcatctctcgggcaactctttcgtctctggtggtgatgagaacccagctgccttgagcagccgagttaactaaagggattcttaatgaattgttccaagcatggacgctccacatatcatccatcaccaaaaagattttctttccagatattgcttctcgaaggattggctgaagcagggacagttcttgatgcccactgtgctcaccaccggcaccagtgatggccgtcctcaccagctcaggatcactgaattcctggttaatgctcagccatattattttgtcgaacttctccttgatgtcctggtggttgaagatgttctgtgcgagggtagttttaccaatacctccaacaccgacgatggcaacgaccctgacgttgctgctgatactcgccgcacttgcctcttcctcctccctcgttagcaactccaccagtctccttgtatcttgctcgatcttattcccgacaacgcctgaccgatcaagctctggtgttgtccggcgtaagccatggccttgagctgtcctgctgcagtcaccgtagcgatcgagcttgatgaagctgaattgctcggcacgctgcttgatgccatcaagccgctggttcagcgccatgatgcggcttccaatgtggtgggcgttcaagggattccgcagggagagtagcgacgggttgttgctgcgcctactgtcctgatccatggctttgagctgacacagctccaggatgtccgtggcatcgtacatggcatccttgagctccttcacccaaccctgcacgtgcagatcggtgatgcgcctccgctccgcgtcggcgaggaactccttgagcccatcaagcctgacgcggaggctgtcgatcttgtcagagataccaagcagcatgcccacctccttcctcgccatcttggcaagcacattgctcaggttggatgccaaggcctccagaaccacagccatcaaggctgaacgagtagtgcttctgcatctcagatttaaccagcttgtcagtttttacatacatatatagcaataaaacagaaaaggtgctctaaaggattgtgtacctggctttaattagtatgcaacttctccgatcctgttcagaaccaagtagattgatgaaatggaatggtggcacagagctcaatatatacacatattgagccatttttaattaatacaatctattttctaaccctactcaatggctttcctaatcctgacagcaatgtggatgcaggacacctcacgcgagcagccacgtattagattatcaagaatcttagtcaacaacgaaaaggggatcaaatttcaagcgaactgattgttgtctccatccatattgtggagatatctaagaatatgccatctcctaacaactaaacaaaactgatttcaaacaaaactgttgacgcaagttaaattgtactgaaataaaccatctctgcactgcactaggaagttgccgcgtcactttccacttccaacaaaataatctcagatgttctgctgtaaacatatctgtttctttaatagaaatgggagggggtaacatctatagttaaaaaaactaaataatctcaggtggctgcatcagcatcaaccttcacttttagattagcttatcacaatgtgttgactcgggacttctcaatatttttggtcacagtttgttggaacattgcaatcagtgttctgctcttctagcccatgaatctcggccacaactacgccataaaattatcatacatgctgtgaagtttgtacatgacacagaaattccaatgtacctatgtcaaataaatctatcaagaaactaatggggtcgctgctctcccttggagaatcagtagatggaaaaactcttctttttttttctttgaacgaaacatacaaactgttatgtggcaagaatatttcctggtattggatttttttttcttcaatatttcctgctattggatttgtctgacagaacatttgatggttgatataagtatcaaatacatgtgcttcattctttgcccaactaaaggtgccttctctgactggtgcgaattattagtgctaagctattaccaacaaaatttcaatcagagaatcacaatggttttgtttcgataatgggaataaaagctcaatgaacaatgatgtttccatgtttcatatattgcttcagtagttcaaatgtgtcaagataggaaatatcgtagatccaacaaaaaaaaaaggtgcagatttcctaggaaataaaaaaatgaaacaaaattgaaaaaaaatacattaccctgccatgacgtcaccgatggagctgctgccgcttcagctacccttggtgcagagcaaggcaacgcggacgcagctcacccccactatccagcacacgctgggatccccaatccaggcctcaggctgctcatctgcattgccccacggccgcagccgttcctgcagtgttgggagagagatggggaataaccccgcacgagttcaccatggagagcaccacactgcggaaatacgaccacctgctgagggatgactatcttatcggcgccgatggccatctccggctgcctctcctgccgaagtggtttttgctgctgcggatctggaggtggaagaagacccaggggcgaaaatgacattctgggcttgttcactttattgctaaaatcgaccttacctaaattcgacatctttctaaattttgatagtgttttaatgagaggaaacttttgaaactatcaaattttggtagaattccattggtaagatcatgtgtagtttgtaaccttaacgaaatttggtaacacaaaaatttggtaggattgaacataacaataaaatgaacatgcctttcatattagtgttccacgttgatgcgtcttatacgtaggtggaacaaaattaaaagagtcttgtctctctagcgacaatttccttaaaaaaatgagcaattctacggtccttgaggaggtaccatgaggtaccaaaaaaattagtgtaaattatgaggtaccatgaggtaccaaatttacaatagaaaaattggtacctcctcaaggaccgtaaaattgctctaaaaaaattattagggacaaatcttataatggcatttggagattggccacttgagttgcaaatagttaaatttcccctcaaatgcaatatatgtcatgaaaaatcatgaagaaaaaaaaaagaagaccatatagcgtagtgacatatatcatctcaccaaatttctattgtataatcaattgagcaatgagaagaaaaattcggatgcatataatatttgtattgcttatatctcggatttgtctctcatattttttagatgttacgttcgagttgagtttagacttgaacatttgaacatttaagatggtatacatttcctagctaaatgatatcaaatgttttaaaagttgtatctaattagttactatgtatttagaggtacaagggagatctgtcaagttctccgggaatggaaacttatacttctattcatacaatatgtgacggtatcacatactatagtatttcttctaggaatcacatattatagtatttcttctaggagtacttcatatgtctttggttcaaagttcaaactagacaattgttcatacgggtgaaaacagatcggacattcgcttcgttcctaatccgtctgaaacaaggatatggtggggcttgtagaaattcggcgaatacgaacccggatacggatatataatatcctgttatgatccaagtagattgacaaaatggtttggtggcatcgagcaaaatatatagacgtatgagaactttctcaattcatacaatgcgcatgaaggacacatcgcgcgaccaggcacgtattatattatcacgagtcttggtcaacaaacaaaaaggatcaaatttcaagcagaactgattttcagttgtctccgtccatattgtagagatatctaacaatatgccatctcctagcaactaaacaaaacagatttcaaacaaaactgttgacgcaagtgaaattgtatagaaataaaccatctccgcactgtactaggaagttgccacatcaatttccacttccgactaaataatatcaggtgttctgctataaacttatttgtatccttaatagaaacgtacgggacggcaacctctctggtcaaaaaaataatctcaggtggctgcatcagcaaacttcactgttagaatagcttatcaacaatgtattgactcaggacatctcaatattttggatcacgggttgttggaacattgcaatcagtgtttttgttcttctaacccatgaagcttggccacaaactatgccatgaaattatcatacatgctgtgaagttcatacatgacaccggaattccaatgtacctatgtcaagtaaatctgtcaagacactagtgttctgaaactatcaaattttggtagaattccattggtaaagatcatggttaatttgttaccttaacgaaatttggtaacacaaaaaattggtaggattgaacgtggcaataaagtgaacatgcccttcatttccgtacgtgttccacattggtgcgtctacgtatcatgccatatatacgtatgttgaacaaagttaaagagccttatctctcttgtggcaaattacagggacaaatttaagaatggcatttggagagtggccacttgagttgcaaaaagttaaattttccctcaaatgcaatacgtgtcaagaaaaattgtaaagaaaaaaaatgaagagcatagagtgtacgtagtgacatatatcatcaaatttctatttcataatcaatttggatgtgaataatacttgtattgcttatatctcggatttgtctctccaatgttttgacattgcattcaagttgaattaagacttgaacatttaggatggtataccgtatacgtttcctagctaaatcaaactaaatgttataaaaattgtatatattgtttctatgtatttagaggaacgagggaagtacctcaagttctctagagatcaaaagttgtacttccgtccatgcagtatgtaacagtatcacatactatagattttcgcctaggagtacttcatagtatgtctttggttcaaaccagacaatttttcatataggtttaaatagatcagatattgtgtcctatccgctccactccgaatctgttcgaaatgaggatatggtggggcctgtagaaatctggtaaatatacaaatgctgatacggatagtttccagtttagatcgaagtaggttgatgaaatggtatggtggcaaagagctaaatacatacacatatgaaagcattttcaatttataaaatcacttttctatgcctactcaatgactagcaatgtgcatgtaggacagctcgtgcaagcaggtacgtattagattatcatgagtcttggacaacaaacaaaaggggatcaaatttcaagaactgattttcagttgtctccatccatattgtggagatatctaccaatataccatctcctagcaactaaacaaaactgatttcaaacaaaaattttgacgcaaatgaaattgtacagaaaaaaaccatctctgcactgcatgcactaggaagttgccacatcacttttcacttccaactaaataatctcaggtgttctgctgtaaaaatatatgtttctttaatagaaacggaagggggcaacctctctagttaataaaaactaaataatctcaggtggctgcatcagcatcaatttttcagttttagattagcttatcaccaatgtattgactctgaacatgtcgatatttagggtcacaggttgttggaacattgtaatcagtgttatgttcttctagcccacgaatcttggccccaaccctatgccatgaaattttcatacaggggttgtgaaatttgtacatgacgcagtaattgcaatgtacctatgtctaaatctatcaagacactaatggggtcgctgagctccctaggagaatcggtagatgtaaaagctattctctctctaacgagcgtaagagctgttctgttgttgcaacgagctttcctgctattggatttatctgatagaatatttgatggttgatatcagtaccatatagatgtacttcctttctttgacaaattaaatgtgcttgagtattgtaatatgctggcttaaacaaatgtaaacatgtctctggctggtgcaaatatttagagctaagctatatatggcctggcgcaacctcaatcacaatggtttcgttccgataatgggaatagctcaatcccaaagatgtttccttgtttcacatggtacaacaatttggcgggggtgggtgcgatacagtgcaataactcgagaattgaacgttcgagtgcaacaacttgataagtaggtgcgttttagtataagaacttgacaatttagtatttgatacataaacttagctaagcatatgctaggtacttaaaatatacaaatccacgctagtatattgtcaaaataagtacttaaaaattaaatatgtataaaaaagtgctccaaataattaagttgccgcataacttgttaacttattgtatcgaaatcgtacatatcttgcaagttgttgcatttatgtgatcacttataaagttctggtactaaattacacctatctgccaagttgttacgttaaaacgctcatttctcaaattcttgcaccaaattacacccatctgctaagttgatgcaccgtaggtgtaatttactctttcagtagtttaaatgtgtcgagagagaaattagcagatccatcagaataggatataaatttcgcagaaaataaacaaaaaagggaataaaggagggagactggccggagcgccgctcccgccgttcgccacgtggcagcgggccatggagtcactcacccctatccagcacacactagaatgctcttggagcgccctaaggccggcctcaggtttgctcatcttcatcgccctccgtggccacggctgtcggtgacatgggaccgggagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgtaggttttgcgccgcgtgtatgggttaggtgagcgcagcggggctcacctaaccgcatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcatccctagccggggtcggcgtgttagctcctggaggtggcacgttggacccggtcagatatataccagccttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaaaaaaaaaaagagaagacgatcccagaacgatcgggggctggaggggggatgatctggagagggtttttagaataagagctctctggctctccagctctttgtagcttcttcatacacagatccaccagaacacaggagtagggtattacgcttctcagcggcccgaacctgtatacatcgcccgtgtcttgtgctttttccactctcgcgaactttccacagactaggagcttagaatcttacccagggcccccggccgaactggcaaaggggggcctgcgcggtctcccggtgaggagccccacgctccgtcatctggcgcgccaggtagggggctctgcgagtgatcttctgagctctcgcactctttcgtgtgcgcccagcttttcctgttcagcccaatggccgaacaagcaaaggcgcacaacctctctccgagcgttagcggtgacgatggggagccaaacccacgccgtcgagctcgtactccaccgccccctccacgccaaagtcctaggagggaggaggtgctcgagagggtcgaaggatccgcgacttcgacatccacgggtgatggagaagggcgcccagatggggagcgtcgcctcctcgtctacggcgacggcagcgcgccccagggcgcgctccaagctgcgggcgcgctcttgcgtcacccgcctgtcgtccctgacctggagtctccagcccaacgatgactggacgacgtggccaacttggtcatgacggcacagcggcgcctaggtgctggtggttggtcctccgccaccaagacctctggcgctgctaccaccggctccgtgtcgtcaaggcggagggcgcgacgagcggcggctgttgctcgccattcggctgccactccctcgtcagcgcctccgacccgggaagatcagcgtggggggccagatgcccgcatcgatatcgagcgccggcgtaatggtcggcgtgctccccacgcaacggagggcgcctcctcgtccggagagtcacctcaacacagacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccataaactttcaaggtacatatccgcgcccaggtgaagaagcggacttacatgcagtccagcgaagggatgatgagtcacttcgctcatatattcagcggttctgtcaagtccgcaacaccataccatgcatccctgcacacgcggtgatctacgcgttcaggaggggtgtgcggcacaaccgcatgcttgaaaagatcgcctccaaagagccccagactaccgcggagctttttcagctcgcggaccgagtggctcgcaaggaggaggcctggacttggaacccctccggttccggtgtggcagcttcggccgcccccgggtccgctgctcggacagggcggcgtgacaggaggaggaagaaaaggtcggcccattccgacgacgagggtcatgtcctcgccgtcgaaggcgtttcgctggccacccgaaaggggaggcctacgagcgacaaaaagaaggaagccgacgctccctgacctcggctacttggaagagcgaaggtggcgcgcggcccttacagccgcgcgctaccagcagagcctgcggcgctaccatcagcgccacgtccgggcccgatcactctgcgtcgatgacctcgtcctacgccgggtccaagcgcgtgctggattgagcaagctctcaccaatgtgggagggtccgtatcgagtgatcggcgtccccaggccgggctccgttcggctggccacgggcgacggcacagagctgcctaacccgtggaacatggaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccctgggacatggtgaactccgggggggaatcggcaaaaacccacaatcgggtcacccataaccctcggtcaccatgctcccggcctggccagtctcgacatgtggatctccccaggcactagccttgacccgcgtcgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcgtataacaagaagggggcccgaaggcctcggaagaagaaggaaaagctattaagattggcggaggcctaggggctcactccgacgcgcccgggtagccggcctcgccgtcgctgtcgtccgcaccgtcgtcaccgcactcctcgtcggagttgaaggcaaacgcgagccaaggggccgctcattattgtcggtcggttttcccttgctgatgcgcgcgatttgcgatcgccgggattctgcccgaagagagagagagcagggaggagaggcccccgagccgaacggcggcccaaggcccccgacggccggagctggccctctgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctgaagatgtggcccctgacgaagaagatcggccccgccgaaaggtgcagcggcccgtctacttcgttagcgaggccctccgggacgctgagacccgataccttcaggcccagaagatgctttacgctatcctgatagcttcgaggaagttgcgccattatttccaggcgcatcgggtcacggtggttacgtcttatcccctcggccaaatcttgtataaccgagagggtactggacgggtggtgaaatgggcaatcgaactcgctgaattcgatttgcgctttgaaccacgccacgcgatcaagagccaggccctcgccgactttgtggcggagtggaccccagctcccgagctcgtctccgcccccgaggccagctcgggcccatcgcagctgcctcacaccgccctctgggtgatgtagttcgacggcacctgtaggaaccggccccacctatcaccaggccttagaagtggcgtcacgcccgaccgcttccctcggggagggcgatcgccctggcataacgccaggggctactgtcggtgacatgggaccgggagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgtaggttttgcgccgcgtgtatgggttaggtgagcgcagcggggctcacctaaccgcatttattggggtttgga

SEQ ID NO: 74691 - DNA, 640 bp, Oryza sativa
cccgccgaggcggagaacggaacatcgacgacatccgagctcgagaaggattctaatgcggccaaaccttgtcgttccgacatgaaccgcgagctgacgaagatgacttccgaagtgacaaggtcctggtgtcctatccacaaaaccaggaaacacactttgtgtcacatcctgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaactcttaataatacaaagaacagttcagtaattatttgatcattaatgatctaattataattgttaaagagcttttcttgtttaaaaatccttaaattataaattgttgtttaaaaggaattattagaaatgattttaaaagcttataagagaagatctaattttaatttggtaaaatctcaatataaaattgggctagataaaatttcattaaatactttgcttaattctataattcctagatttttctgggatttatttgagctaagga

SEQ ID NO: 74692 - DNA, 10079 bp, Oryza sativa
aaattgaaggtcacaactgcatcaccatctactataggcccaacagccttgtcactatcgtcaacaatcacaaatgggggaagatactgatcattagccttggtctctgaccggagtgttttcacagcttcaacagcgttttggaacttgtgaggtgcttctccaagcacctgagcatcccatccacgtttaacaacatcccagtcattctgcaaaattgagatattaaacaaatagttcaatacttccattagtacatattatcccaagtcagaaagagttgcaataaaaacagaatgcagctgagagataagatatgagcaatccaaactgacagagaggaaggagggtattcatacctcatatcggtccatggtaacatacatccttccaccacctgatgcaatgcacgcatcaatgcccttggcacgcagttgagaaagatcattctctagcgtttcaacaaaaccaacgcttgtgccatccaaaacatcacgtccatcagtaagaatgtgaacacggatttttttcgctccattcgcacttgcaccattcaggagcaactataaacaggaatgacaaaagacaaaaagaattagatactggacagatcaacatgttgtaaagaaacattagtgcctcatactatacaagatgatagcaaactatagaaaagagtacttttatacctgcaactggtcaagccgtgagtggacacctccgtcgctcaacaacccaataagatgaagagtgccttggtcaaaactctccttaatgtacttaaacccttctccttcaaaaatttttccagaggccaaagcagtatccacaagtttagccctacaaaagaaaatggagaacatggtatatttagaggcttaagtctgaggcttctaacttctttcttaaaagaatgatttcatatacggcataatggcaatgtctaaaaggcaccacatggatttagtaatttaaagagaaaatttggaataacttgaagtacacagcaccacgagtagttggcatgccttcaaaaagtcgctgcatgtcaagtataacatacaactcaaacagttgttcataaaagaactacccttcatctctaaagtttgtaaatcagtacacgggatatctttttagttagtactagtagctgctaaaggaagtgcatgatttgtataataacatgagatagtaatgatgatatctctttcatgctcatgtggtaatccacatcatttggagagatctgtgtaaatctaacacttaagatgccaaaaggaaccaatggttgccatttgattttactaaatctggcacacaaataagccaagcaacagaaacctgatgtaataagacctttagaaacaaacgcaatactttttggccatccacagattataactgacagtgtgctaataaaaaagagaaccaggagaaacatgtacccttgagcaaaaatccgaccagcaccaagtgcgttatgcccaacctcactgttacccatgtcatcatcagaagggagaccaacagctgttccatgagcctttacaagcttccacttctctggagcacccttgaaacatagaaaacaagataaaccatgaagttaagtaaaagggtaagaacaatcatcataaagcgtttcaacaatatcatactaaacttgttctaatatatgtcgcaaacaaggtcagaatccattgcctacaactcataatggaatgttagtatgcacggaacatgcaaagacagtgatccaggtaccatacttaacgagtacagtatttcttcactgtgacaatttgtctaaaaataccaaccataccacccacaaaatgtactagagtcaatttactaagacaactacatgaaggagaagcccctagcaaaggtagggcgaagataattggttggaggaaacaaagaatttgtgcttcaggtttcacctgtcacctaaccaccacagattcttcaaaaacaatacacagcaaattacatctatggtggctaacctccaaggccttaactacatactaaaagctaagaaaatataccttcttgagcgaatccattgttggtgtctcagcaacatggatgcagttatactggtccgcatcagcctcaccccatccatccagtacaaccacggccaccggcttccccttagggagctttgggtgatcaggcaatgtccacgagaaatctgagcttcccatcaccaactaaacctaccaaaatcacagatataaagaaatcaaagttagaacatgaaattaaccatctcagaacacatacctgccacacacacacacacaaaaaaaaaaagaacaacaatgtcgcagcaatcccgttctaaccatcacatctcaacaaggtggctatcaagagcgaaccctaggtactcttcttatgggctcttcatgggctattcatgggccattatactaccgttaatcacagccgttggatttctttctcttcccaaaccctaattccccccccccccccaatcctctcgtctactcgacgccgcaacgcgtgcggcgcgcagccgcgcgcctccgccgcctcgtccgtgccttctcacctctctcctcgcgagctcatctcactaagtaacagtgtattgtattgctagtaacaattacagaagtagttggttaatctgcagctgatctcctatcctactcgaagcgatctatagagatcaaaaggggtattcccaaatagggcttagcatcacacattctccagaatcgttcgactcgaacaaaatcaaaccattctccaatcttaatctccatctctaaaccgcacaaaaatgcatctgcattggaatcagactatcgcgcacgcataggcaccgatttggttaaacaagccaaaaaataaaaaaggcaaaatagagcgcaaaaatgtgagggaaacaaatttaccagatctacactacaacagatttctgggggtagggaacaatccaagttaaccagattggagaaatcatagaaaaaaaatcgagcggagagttcaaagcgaggtgagatcgagaagattaccggaagagagactgttttttttttctccttttttttcgttgctatatttttctctggatgccggatgatatgaagccgcttggcttggagaggaggaaggtcgatataaatagagcgagtgcgattctcttctggtatttttgcagattagcccacaagattagctcgatggcaaatacgcccttccgagaaaaaaaaagcccttaattaccatgtttaactgctgctccgtacgaaattgactagagaatgagaaaacagctttgaactctgtgccttaattttacttttgaaattagaaatgtggtacgagttgtataaagagttcgtggaaatattattatgcgatgcgcaaagacgacttgatctcttgctatgcatgatcgacatatttagttaattaatgcttataattactaaattcaatgtttgacgcaattataaaaccagcttatctggcctcatgctttagatcggagatgatgtatttaccggttcataaaatataaggtgcattaggtttttacacgttattttaatgttgagttttgaatctctcattgacaactatgaaattaacatagcaagaattactttcaatgcaatattagcttaaatttttagaaaatacttctaaatattgacttatcctgttatccttaaattcgtgtctcgtacgcattgcctccttggcggcagcaccgctacagacctacagttaccgagtcccctgtgtcagttgaacccgacgaaattcctaaatacgctacgtaaaatgaaataatggataagcacatgattaattaagattatatttgacatagcttcgaatcgaaaatactttagagctggatatttttaactccatgaatctatggatctgaatttacgattacattgataatacatgtatgaatctattttttattttaaataaaatatgagaatttatatcactacagtttaatatacaaacttcaaatccatcgtgaaatgtcaaatagtatctaagtattagctttaaaaatttaaaaatgaattaatactttttaagataatttttctatagatttcttggtaatcgtgtacgaacgaactaagcaaatttggtttaccgtgcgtccgtgccatgcaatgaagcatcatccgtccaaggcgtgcaaatcacaggccaggattagggtccattcggccattcccccaaaccaaattaggcctactccatcctgatgaaattggtcgcctcaattccgccttacaacattttggcccacagatatttttccctcacgcgaggcgctcaacggagagaacttgtggcccaagacaaatggcccaatataaaaggcctaatctcatcgcttggtggcccaagccacccacctctgctatcttccaaaccaaactttcctccttccgcttccaaatcaatccccacagcgcagcagcgcacctccgcctcctcgccaccggcaagccgcacctccgcctccgcctccggcctctccaatggacgcgctatggtgcgacctcaacgccgacgtcctccgcctcgtccacaagcgcctcccgtgcctcgtcgaccggcgcaacatgcgccgagcctgcaagtcctggcgagctgccgtcgcggcgccggcgccgccgcagcagcgcccggtcccgtggatcctcgtgccgagcgccggcggccctaccttctcgtgcgccgtcggcggctgccgcagacacgacttcggcgtcccggactacgcgcgcgaggcgcgctacttcggcacgtacagcggcggctggctcttcctcaacttcggcaacacccgcggccacggccggcacgtcctcctcagcctccgcaccaagtaccgcatcggcctccccggaattgtctacctccacctgaatcctgaattcatcagggacatggtcatgatagccgcgaccctctcctcgccgccggaggacgagcactgcatcggcgccgccatcagctcgtactggccgcccgggatgaatggtgcacgcgtgcacgcgttctggcgcatgcggcgtcaggtcgctgtgatgccgactgctatcgagggcgtcatcggaccaattctggaggatgtcatacaccacaaggaagccttctatttcctcaccgcgcaagagcacctccatgttttcgcgctaccggagttccgagtaaaccgtcgcggccatctgcatatagcacccatggagattcgcagcttcccgcatgatggtcgtgattacgacggacgcgccgttgctcgctacctggtggagtcccgcgagaatctcctgatggtggtcaggttcgtctctgatcctccccaaatgccaccgaggacgtcggcattcaaggtgttcgagatggtggagctgcccatcaacaacggcgaggcccggtacgcgtggaacgagctggaatcgctgggtgggaggatgctgttcgtcgcgcgaggctgctcaaaatcctacgaggtggccgattacccggggttggggttcagcgccggcgtctacttcctggacgacgggagaatctacgacgagttcacggtcctcgatgacaccgcacggcgctacccctgcagagacagcggcaagtggctgctgggggcggcggaggcggacaacttcttgccggagcaagccctgtcgagctactcaccgccggcttggcttctcccctgagcgtgtgctcatgttagtttgatcgtcgtggcacaggtaatgtttgctgccgatcttgttgaaatctgcttacagcgagttgtaacagttgatattttcattcgtgatctgattttgcggctgttgatttgtccagttagtataatccatgatgtttcattctatttcgagccttcgaggcccattcgttcttgcaattgcccggccatcttttctgtaccttctgctaattttcgatgcttcgtgatttcagaatggagaaatggttgacttggattgcattagtgcatcattgtattacagtcgattctgcagtgtgagaatgcgtttagttaacaccagcacttgcctttttcttttctttttttttgaagaaaaggcaagctgccaattttcattgaatagaggagtaaaactgtacaaaggcgaaaacgagctcaggacctttggtccgagctaactaaaagaaagccaattatgaagatttttcgcgcccgctaaggcccaagttttggcctcttccttgattttagctagaagggaggtggtcgatagctctttttgctgaaaggttctgcggtttctcttagtccagatctcccatgcgaccagcaggatcagtgtgcgaagagccttcttgggtgcctcctggatgtttaaggtagcctcccaccattctaacaccgtggaggtttgctgccaccgacatggtttcaacccctcacacgccgtccattccgcaattgcctcccagattctctttgtgtatctacaacccgcgaggaggtgtagggcagtttcttgagatcgacgacataagggacatatggaaccgtttggccatcctctggttgctagtctgtcggaggtccatactctgtttggatgattagccatgcgaaggttttgtgttttcgtggcgcccaggtcttccaaattaggttattaaagttggtggctgtggtgccgaggagttgcacattgtaggccgacgttgccgtgtattcaccatggctggtaagcttccatgttattttgtcatcctcttgctcttctagttgtagtgtctgagtggcggtccagattgtgacaagttggtcaattaagtctgtcgtccatcctgcatttgacggcaggtccaaatcatgaatccattggtcggattgcaaggcttgctggatcgtcttgttctttttcttggatgctgcatagactagaggagctacatctttcattctccttccttcccaccaggccgaatcccagaagcttgtcttctcaccgtttccaattgttatgaaggtggccgccgcaaaacggagtttgtcggtgtcgtcacatggtgtgccggttcccacccaggctttttccgatgatttccattcatgccaaagccaatgcagacgcaaagctctcgcgaacttttctaagtttaggatgcccagacctccggaggcagtgggaaggcaggttcgtgtccaattgactttacattttccccccgtcaaagcttcctcgcccgcccagaggaacttccttctttgcttgtctagaacctcgagggactccttggacgcttttagtcctgtcagaaggaagacaggctgcgaagtgagcaccacctttaccagggtagaacgtcccgtgagcccgacgtgcttccctcgccagccagcaatacgactcatcaatttgtcatagagaggttggagatcgactttgcgcagtcggcctgttgtcaagggaagtccaagatacttcaatggcaggtttgctctggttgttggcgtgtcatggaggatgtcgtctaaatccaggttttcgcacctgatcggagccacatgtgatttttgaaggttcgtgcataagccagttgcttgaccaaagcgaccaaggagatcggtgaaggcttgtacattttctttgttcgggtttatgaagactgctgcgtcatctgcgtacatagaagtacggaagcgtactgctctcccccgcagtttgcttatcacccctagttcagtggccatgtccaataaacgttggagggggtcaatcgctaggatgaagagtagaggtgatagagggtctccctaccgtaatcctttgccatgctgattgcctctcctggtgtgccattcaggacgatctttgaggcggaagctgaaagtaggcccgttatccattcacgccattttggtgggaaacctatgttttgcaagagtgcgaggaggtagtcccacctgaccgaatcgaaggctttggatatgtctagcttgaagaggaggatcggtcgtttggtcctgtgatgcttcctgaccatgtttcttacatacataaagttgtcatgtatgcttctccctcgaatgaaggcgctttgattcatcgaaatcagcgagtgcattaggggccgtaagcggattgctagcaccttgtaaaagagcttcccgaagccatgaacaaggcttataggtctataatcttctattccttccactccttcttttttggggattaggaccacattggcagaattcaggaggctgaaatgcttgttccttgcatcatgcagtgcattaaaagcggccaccacatcgttttttatgatgccccaacacgacttgaagaacttccccgtgaagccatctgggcctggagctttgtcggcaggcatttcttttatcgctttgtgaatctctgcctcagtgaaaggatcatcaagcccggagaggtcaagcggtgtgtaccctaattccggccagttgaggtcgcaggaccttggctccggttgccccatcacatgttggaagtgttcggcgatgacaagttctttttctgcgtgcgtgacagcccaaccattttgcttctttaggcggtggatgtgatttttccttttccttgcattaatcttgcgatgaaaaaactttgtgttggcatctccttctttgatgttagtgatgcgcgcggcttgcttcttccttgctctctcaataactgcaaagccgaggagcctcctcttgaggcccatacgcagcctgtactctgcttgtgtcagctcacggtgctcctgtgctacatcaagacggtacttggctttttcttaatctaaccatgctttgcatcaactgaatttcaacgaagatgaattgcatctcttcagaggatccaagcagaatccttccaacgggtgctacaaatttcatactactacgcagtccttttcacctgttcataacttccaatgggttctgaatttactgataattaacaatgagatgacactatatacaaggagtactaatattgttcttaagacttgctattacaggtattctttcagcagtactctatagtccatagcagaaaacgcttctgaatcagatttacatgaatgcaattttatatctgatctgatgaattccatgaagtcataaaattgctattcatgacatgaattgcattagcgcaacattgtattgctgtcagttataatgcaatttgaaaatgtgctcaattagcagtgcttaatttccaagatagaagcatgttttgcatgaaatgtatttgcattgaaggtgaattattgcttctacagcctgctttcagttgcttgttaactgcccaagatgggactgaggctggctacagcctctcttttgaaggacatggattgcatatatttcataactcaactgctagtcttcttcacttgttcataattgtgattccaagcttctcaaaatatccgaactgagatattttcagcatcagtttgagaagcttggcatcaccgtcgaactactactcactgccggcttggtttcccaagtaagatgagctttctgccgatcgatctggatgagatgtgcttgcctcacatcgaggcgtccgtgtgatgttgttgtcgtgctgatcagtgaactgtttttgttgtttccgttccagctctgaaccttttctgtttttctttgagccaacttctgaagttcacatatttgcagttgttgattgtccagtaatccagttagtacaatgtacttgcaatgctggacctatcataacatcttcaagtattttagtttctggtatgggttggattgcattagtgcaccatgctgcatatataaagtggattttcaatgaggaggaattgtttctgcagctttctttcagttgcttcaattctcttctgaggagatctagtcagaaattcagaatccttggtggatgctacaagttagtttcaacactcagcttcttaatttgttatactgagataacatcgtcatcatgcaccggtttgagctacctgtgcaagaagta

SEQ ID NO: 74693 - DNA, 605 bp, Oryza sativa
ttgaagtcagaatgaggccgttcaagtctcataattcatctaaaaatatgatctacatgtgggattactttttatgtattgtttatttggtttttattagtctttttcctcgttttgcgtgatagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagcttcacgatggtcaatcgtgattggttaattaattacttgccaactaaaacttgataatggcgggttgtgagcacatggttttgagag

SEQ ID NO: 74694 - DNA, 764 bp, Oryza sativa
attatggatatcatgtattcatgatgtttgtttagtacttaagcacataattattacaatgggtcgttcattgattgttgcattgttgtcccttgcattgttaactcgatggtatattgcttgcatacacacataacatccaacaaatttaatccgtttctgaaccgagtccgcaccatttccaacatctgaaacaatccgctcagccgctctgaatccgtttagaaaatatggtttaggatatggtatgaccactatccatccgaatctgctccatttttacccctatatactagtcatgtcactgctgcggaaaccctctttaaccccggtttgcaaccccctttaatcccgggttgcaaagcgggactaagattccggaactaaagatcgctatctttaatcccggttgaaatacccgggagtaaagatgcatctttagtcccggttgggaacaaccatctttagtcccgggactatggtttttttcttttttttcctccttcggttttttttcttttttttcctcctttcatgatcttagattcacagcacagatatcacaaattcattcacacatatcatcacaaattcattcacaacaccacaaattcattcacagcacatcatcggaaatttattcacataaacattcacaaacacattcacatatacattcacaaatcaacaacatccacaaatcattaaaaaaaatcaagaaaaactcaaacaaatcaaaatccacattggcatgtgccaaccgg

SEQ ID NO: 74695 - DNA, 42367 bp, Oryza sativa
cagaataaagaggagaatgctttcccccgggcactcgacgggccagggaaatatcggtcgctccaaatggtggaccagggttgtgttgaccacaagattttttctcaagatgagcaattacctttttctctcttctcttgctctatcccagttccatgcatgcatgcataaacgcatgcgggctaacaaaatgcatgttgttttgctaacaaaatgcgtgcatgcattaaatctattagcatgttctaaatattttctctaaaattatttattcgatcaacgatccgatcactgctatatttggtgcaattaaatctttacaacaagatgtcatatgattatattacaattaaaaaagaaggtttagaccattgtttttttatgtttcacgtgtcagatgccaacgtttcaattggaatttaaatttgttccacattttaagttttttgtgttggaaagagttgttctttatgttgcgtacgatgctatttgggtgtttcaataagtattttctagtatttcactagttcatttgcaaatgttgcacttcagtgtggtgtttttgggtgttccagtaagtagtttgggatgtttcaaaaattacaaatcaatgtttcatgcgtgatataaaaaatgtttcaattagaaatattataatatattttttgtcataaaaatataatcatgtgagatctcattataaatatttaattataacaaatataacggtgcaaatagattatgaatcagataagtaatgtaaaagaaaaggtgatttaaagatccactaaataaatcaattttagatggaggtaaagggtttggctactcagttttagatggaggtaaagggtttggctgctacaacatgtattaatgcagcatgtatgttctatgatacgctttaattaattggcatgatacatgcaacctttgctgggagccaaccagccagaggcatggggtgtccgatttttttgggtaaaaatcgcacgcccgacgcgtagtggctctagaataaaaaattccctattactcttaagtttcagaataaaaaatgacagaattattgtcatggacattgggctagaggcccgtggggccagcttctggcaagtggatagttcaatgggtactgtagcagcaggttaggagtagataatattagattgggttagttaattaagggtaagtctcaccagctacataactgttccggtaagcaatgttcttctttctaacctaagtcctcatcccctcatcgcagtgattatcctgtcatggcctcaggtcatgacatttatcaacatgatatccacactagtttataaacatcaaggctggcatttactgacagactacagataagggcaatggggcatcttatcctgtcatggcctcaggtcatgacatttatcaacatgatatccacactagtttataaacatcaaggctggcatttactgacagactacagataagggcaatggggcatctatcttacttgtcatgtttgtgttgatgcattagcactcttgtgttaaatgatcccttctaggatacctttgcaagaaactatcaaggatcaaaaatcggctaaacagaaaacatcaaaatactgaacgtggaaattgaatttggccaattactgcctagtttgtctggttttcagccagttaccacccagaatcgctgcctttgtctggttctcagtataacactgattttgtttgaatccacttgtctttctaacaccaaatactaacacatatcaatgggtactaatcaaatcaattatcaatacaaactagccaaaaagaaatcaataatatggttagtgtttgcatgcttaaatttttcatgctaggaaatttgtgaggtccaaattaccatgaaacatgtcattgaatccaatataaagtatagtaccttaaatctgtctggttcagccaattcaaagaccaatgaatcaccatcttccaagttgtggtgcatcgcaaaacctctccatccaccacttaggcctgtacggttcccaatgtagacagaatcaaattcaccaccctcttcatcctccaagaccatcttatactctttgggaggcagatgcaatttgcagaatctagttggaagacccttgtaggatggaaaagaaacatagctatgagtactcattgatcataatatttttaacaaaattagttaatgaattccatacaacgaaaccttacaagccaaaagcagctggacacatgtgatcgaaccatggtcttaacaaacgacgggttctcagggtctagactattttgaagtctctcagcttttttgaaagcacgttgttgctgttcataagaggcaactcttccggtgtaatccctcccctgctctgtgctcctaatcctactgcccctgttcaacacaagcaagtagccaattatattgcctggccacagccacaactatcacaaatctgtaaaccatatggaagtattaccttctacggcatagaaaactgttgagttcatcaaactggcacaataaaaagagcacaacttagtaccaacatttgcatgaaaataatctttcatcacttcacgaacaaaacaaagcttccttgcgctttaactctaagtaattattccctccgtttcatattataagtcgttttgactttttttcctagtcaaacttctttaagtttgaccaaatttataggaaaaatttagcaatattttgtacataaaatgaacatattaacaaaatatatggaatgttagtttaaatgaaactaggatcatgtcattaaggattcatttgggattgtaacccatataaaaaactggactcacaaacttgttctagaacatgactacagtatctgaatagacatcgcaaaatttcttcctaaatccccaacaaaagcaacactaccaatcaaatagcactagctttgaagtggaccaactcacattctctttgtacgaaaccgagttgcgcgccctcgatgaacgcctcacttcagtggccccaacctcaaacttcttccgcggcttggggctggcacgagtgctctgcaagaagacccagagtaaatcaatccacgataccagcaacccaaatcccccgcgtgtagcataggttgccgtaatcaccttctgcaatctcgccgcctccagcaagctcttggacatcttctttatgcccagatcctgcgcagaatcaagcaccgaaatttcaaccaaaaagaaaaaaagaaagataaattgatgctgcgacagtgcatccaatccacacggaatcggcaaaggggaatgcgtggaatcccgcacgaacatccatcctctaaacgaatcaggttctaccggtggaaaaaaagcacctcaaatctatccacgatccacaacgaggaacggagaaagagatgagagccaaaaaaaaaaaaaatctgaaacgcttgtgtgcacgggcgggcgggctcacctcgaggtgcttgaggttctcgaggacccgcttccggcgctcctcctcgtaggcggcgccggcggccgcgctgccggcctccgccgccatggctcctcctccctccgccgaaacccttcttctcccctgcacgcgactacgcgaggaggaaatgggtctctctcttctcctctccgagagaaaaaaaaatactaagagaaaggaaagagacagtggagtcgcttgttgccttttggagacgggcaccctctgggctgaatttgaaatttcgaattccaacttttgatgcctcggggttcgtgcgggggaatccgacgggccgtacggatggtgggcccgctggcagccttcagctgacacgtggcggtgccattctggggtgcgcggcacgtggggccataaaacagcctcgtgcttttgcgggtctcctcgcctcctcctcgtcctagcgaggagcttagggtgcgcatccatctgccactcacgcgaaaagcccagctggcaccatgtagcaccggtccagctaagagcactgtgagaggcctaacagaaccaaccgatacgctaatatgaatcccagcatttcgacctcacatgatcaatactccttctgtcccataatataagagattttgagtttttcttacaacgtttaaccactcgtcttattcaaaattttttgaaattattatttattttatttgtaacttactttattatttacagtactttaagcacaccttttcgttttctatatttaaaaaaaattaaataagacgagtggtcaaacgttgcaagcaaaaactgaaaataacttatattgtagaatggagggagcagaaggtagtatagtcttccaatatctattactacataaatgtcaagtagcaccaaagtacagtggccttgatctctctactaagacataaattaaagtagttcatgtagtatctgcaacaataaaagctactacctccatcccataataattacatttctagaaaattagagacaaattaacaacaaacacaatttaccacaataaccctatttaataactatgctgcatacgtatattccatatgtatacttgattaataggaaggttgaggaacacattccatatgtaaacttaattaaaagaaaggtttgggtacacattccatttgttgcgtcccatcttatcagaaatacaatatttttaggacaaaatttaaatggtagaaatgtaattataataggatggaggtagtaaatcacacgtagcattgatatgtgtctcaatggatcaaagcggtactgatatgaaagccaagtaacatgtatccctgtcatggatcgaagcactactcaatggagtagtattcctgacatctatcccaatagacaagtaaccctcacactatacgctatgtcatatcacaactacttcatctataagtaaacacatggcatctacaagtaactccctcacatggatgtgtctgacacctatccatgtgaccaaaaaaacattgtgactccaaaaaggtggcttgcactgcccaaaaaattgactcctttaccgacctgcatcaaacaaataaattttcagtgctagctgagtttttctacaagtgtcctcagttaacgaggacactctagaagtgtcttacattgtggatgccttaaggggattagcagtgcgccacctatttttctcagcctggggctgtcacataggacgaagacacaagaagaataatacttgccacaagtctcacagtgctacatagcctcaaagagtagccacacaaataaaaaaaatcatttctttctcccttatcctcagtccgctccccacctacgcgcgcttctccatctccgcccacgcgcctcgccccttctcctctcgccgcacttccccttcctcctccggcgcggcggcggcgccgaaccacccagttgcggcgtcgagcggcgcggcggacgggcggcagcgtggagcagcgcagtggaagggtggcggcacgaacggcccgagcggcaacgccagaactggtcaacggggtggctcaagcgcctcccctcctcctcctcttctggcgccgcggatcgaggggcagcggcggcggccggcgggacggcccgagcggcggcggggtggtcgagcggcggctcacatgatcaatactccctccggccacctccctcggctccctcccctccccgtcccctccggcggcgctgggcacaggcctcaccctctcctcttcccggcggacgacggtggcggcgccgccgagctcgccagatccgtcctcggatggcggcggcgccgagctcgctagatctgccttcggtcggcagcaatgacgacgatggtagtggtccatctttccttcctcccttctctccggcgagctcgggtggtggcctcgccggcgacgcccgtcgcccccttgcatggggccatgccctcttcggcgatgctctcctctccccggcagcgtcgggcggtggaagcgagcggggtttggggcggtaggacgacacggcccacgagtgtgggccccacctgtgaaacaaaggaggaacggggagccaaagttggctccacggtcttgggcaagccgcgtggattgccgacgtggggacgaatattccgtttctaggggtgaggctgaatgccacatgggagcattgtgaatggcctaagagcaagtttaatagtataatcaactactaactccaaatcatctatatccaatgtaatagccaatttatacaatagttgcttgctacactattaatatctggtcccacctatcatacacatattacgtcttggagtccgtgctgcagctggctacagatatgtagcccgcttctcttctctctctttttttatctctttaaaatatgtttatagctggcttatagtctgctattgtacctggcttataactactggcgatcaaacactaaagcaatcactataaacaaatagactatagtgaataatgatcatgtatgctaattagaaactaaccaagaagtaattctcactaagcaaatcttaattactcataatgatatttctattaaagcagagtaattaacaagatacaaaagtaggaggagattaccgacaactccgggatttctccgatttcttctaccttactctctccctattctaatatacaataaagtacactagagcctcttgtaattcagctcatgctttggtggttcgtcacccgcatccaaatatacaccaacacttgtgtaaatggttagaaataaatcctaccactacgttggatgctttacttttatggttttatgcaggtattgacggcgttaatttggtatttaacagccgtcaacaacgggatctctcctagatattcgttcgacagcatctacctctcctacgacggcgtaatttggcgtaagtaagtatatgtggtattttcactcaaagcagtttggaatatagggtttccccaaaaaagggagcttttttactatcagtttttataaatttgtacagtttaatatcacaatatttatggtttttatattctccacgcgaagtattttaatagtatataatccacatgttattaaactatataaatttctaaaattgctagtcaaaagatagaaatttcgacttataacaaagaatgacgatcgatttaaaacgcaagtactaattgttgagaaaaaaatactgcggtaaacacacagacacgctatttctactagcacatttgacaatatgggccaacatatcccatgatcaaccacgtgtcaacgagtactctacttataactaaagaattagttagccgtaaatataaacacccacgtaaatctgaggagaactgaggaacttatcatcccttattgatagagatactaaggagtaaggacttccgttattgataaagaaaaaaatggtgagaaaatatacgctcaaagggattcgaactaaataggcgtgctgctcctagcagctccctgctagtcaagctaggccccgctctcaaatctatgagttaaaacttaaatagactgacttcaccataaaaaaactaacagagttatgctctgttcgctgcattgttaactcatcttggttggaagacatttttagctaatgacaaataacatacaagttaacgtccgtgtaactttcaaaagataatttgaggataatcttttatacttctaagtaacaaacttagtatttcatattggcacatcctaatactacgaatttggactatcgtactaggttaattatattatgggacggagggagtaagccgcagctgagttgcttcagtgcaggcgaccagaatgatccacaagtctacagtatcatatcaaatctgaattgttgaggactcatttggatcacataaattttacagcattcttttataggatttagcccaatacctccaaaattactttgaaattcctccctttttgcaggcgtttcgtcttctcgctttgaaagccttgttcagcttagctaaaagaaagtttagaagagcattgtgaatctaaacgggggaataagcctcatatcatctactccctccgtcccataatataaagaattttgagtttttgcttgtattgtttgaccactcgtcttattcaaaaatttttgaaattattatttatttttttatgacttactttattatccaaaatactttaagcataatttttctttttttttgtatttgtacaaattttttaataagacaagtgatcaaacagtgcaagcaaaaactcaaaatccattatagtaggggacggagggagtatttggtagcttatcagccacgactgaaatttaaattttaaaattgattttaggttttcttaatcatattccattttttacattagcttttaaaccactaactaataacggagacatacagaaaaaaatatccataaattatttctactgcttattagccatagctcaaagcctcaaacgatcaacatcttgctttctaatgtgtatcactgtatcctaacatcagcagcaactcagcaatgaaagaccttttggcaaaatttgctacaggacaccgaaagattgtggcctttgttgtgagacacccgaagatcgtgtatttgctcgtggacactgtaaaaagtggtaattagctactagacactcctattattttattattttcggttgaaatggagagagaaagagttgtgtaaataccaaaataaccctttgacactgttcttcctctctctctcttcttttcttttccccttcttcctcgcagtggagcagaggcgcgacggcggccacagcggggcggcggcggcggcgcatcgccggggttcaccgccgacagtgacgacgcacggcggcatcccggtgcatggcttcctctctctctctctcttcttttcttttccccttcttcttcctcgcagcggagcagaggcgcgacgacggtgggacggcggcggcggcgcatcgccagagcgcgtcgagtacagcaccgtcaagccctagctcttcgagtggaaggccggcgccggtgccactgccgctggccatggcgagtgcgcgcgggtggacggcaatatactgacctagattggcaaggatctggcgccgcctggacccttttggccggccacgacgccgcccggagctcaacccagcatgctcgccatggccactcacctgcatgccgttgtcccctgcagccaaactccgtgcggctggcgttgcagtggcggcgatggtggtggcctcctccgctcttcctccgcctccatggacagctgccaccagtggaggtgacagagtgggggacatcgatgacggcgagaagggagaagatcggtaccctttcgctgctgctgcgacttcttgttgtgcttcagccatggaacaatctgctgttctgatgaacaggccatagcctgctgctgctaatgctgcttcatggccacggcggagctcggcggcggtgcaatgagagagatgaacagagaaagagaggaagaagagagagagatattgacaagtggacctatgggcaaacttgtttttaaccaaagtttctctccgtttccaccagaaataataaaataatacggtcagtgtccgccaactaattaccacttttttacggtgtccacaagcaaatacacgatcttcgggtgtttcacaacaaagggcacaatctttcggtatcctatagcaaattttgcacatagaggacatagttatcaatctaagtataactgtaaggctcaagaatattccatcttgacaaatgcttcgatagcagcttgcaaacatgttgctcagacaagtcacccaaggcagacaaatccctggtactctagctcacagtaactaagaattcttcacactatcagtatctcagcactaccagtaataaataaatcaaatgttctaattatacaaccataggggaggatttcgcctcgctactcatccatcatctgtcagttatgagttaaaatgtcacatggagatcaaaattctagcagtaacagattgccgcgcgaatgccaacaccatcatgaaagctttgctcatgaaaaatttaagttgtgaaggcatggattgattgatttctcttggagggtcaaggaggaggaggaacaagcatccagtcattgtttcatccgtttcatgccaccattactgaatggagaagcactaccaggatgtgggctttcctctctaagtggtgagttcaacaaagcaagttctcggagttgctgtctcttgtagtaatcttgcgattcatcctatatagcacagcgtgaaagaattagcattcgaaaagaggcacgaaaagtacgtacgaattatgatttcgaaagacaagtatatgaagtagaaatgtgttagtactaagtagtgcactacaaaacacattaagataaaacagctgccgtaggaagatggaagttgtgaaaatgatagtgggagaaaagagcaagctatgttcagtttattacttattaattgcaaatgtactaacacaaagctcttttttttgttgcgatgtttggatgttaatgaatggaaagaaagataactgactcaagacaatatgcataccactggtttcaacaactcttctaggatttcttgtgcttttgcgagtctagcgtcaatgacattggcaggtaactcggcttcaatcaagatatgcaggggatcatccaagtgttcatacccagcccttcccttaagttgctcctccttttaagaaatgaaaggaaccacatgtgagcatcgttagcttgccaaacaatagaaacagacaatgaaatagccatttaaacacacaaaccgtatccactgcatagttccacattgatattccacaaaaggtgggttttgtttaccttgttagggtctttaattgagccctttcctcttatgaaaacacgacaacctgtagaggcctcaatcctcttcaacgaatttccccttggtccaagaaggcgaccaataaaattgaactaagggaagcacaacacagtgagtaaatattaactccaaatacacaaatatgaaaatgaagagcatacattagggtaagcatctgtcggtatttccaaccgcaagatcttcttgacaatgtaagaagagggactttgtggtgctccttgccaacctggtccttgagagaaacttactctctgctcaatgtgagaataacaaggttaggtgccacaggagttagggtatggagaatacaataaatgtagcactgaacaagaaggccaaacatagctgaagatccacaggaaatggaaccatagaagtaaggaaatcagcctgatgttcttataactagctatgctattcatccctagttcataaaatctactcaagaatatgctatgaaatttcttgttaagaggcatatctatttattcccgtgcgactacgtaatacagaattgagttgcaaaaaaaaattaagatcttgataataagtatggcaatacatccttcggtaaaagaatagttacacttcctaataattactccttaaggtcaatattacttgtcatttccgacaagcaaattgtcctaaaagcgggtcagttcaattgtctgaaacgacatatatttccctccagagagagaattcgttaagcattttaagagttaatcatatgatttgctaaatgttattgaagttcaccaatccagttgcataatataatttgaaaggcacatggaaaaacaaggaacgaaaaacaacattctctgttggaatgtattggtagtagtgccacatagaatggaaagtcaaggtttctcaaccaacttaacttagagctctgaacactctcttcattgcatttgcacaatgcagagactatatgatttggacaagagaagtaacagtttagggcaggttattcgtttggttgcctatgtaaggaagatatctaagtattttgaccacactggcacactgtccaagaaatggccagccaaaattggtaaactttaattttttttgccaggatgagaaaaataatacgacatccattgctctgttgctgtaaagcagtggaagtgttgtaagatagagggacttacatcagagtctctggactgatgattgtctgctattaggagcatgataggtctaacaactaacaccagaagtgacagtgctgaacaaaaaaaatgtgcgccctatggtaaagcacaatgttgaggtgactgagattatgtgttcaagtcacaataaagtcttctcttccttttcttctgaaggaaactaatcctctgaatcaaatatgggtagttccacatacatagcatcatttgttttttcagagcgggcagtgctaatgatacaaaatagttgtatataacaaaatttcttcattctaaaaggattttaacgactcaagcaccagagcttctggactttgaagtttcaatgttgcactcgtttctcttatatcctgaatgaaatagacatggaaagttgcagttcttgatagctctttatataaagaaaatgtatgcatactttagaattcgtgtatgggatgaaatattaaagagaaaggagagtataaactctaaacaacaatccgcgtcttacattgatataacgtttacaggtattgtggcgataacttattcagaagtccaaaggttaagaggcggcaggggagaagtggatcttgcatgacaaaagtcaagatgagctgatcaaaatgttacccattccaaataaaaatcactgacctcttctataaaccacacgaggttcgatgtagaaaagctatatgatggccataggctacctgttgtgacatgtatagtaatcattcttttaagggtatacataatactctttaaaagccagttttacttcaagaggaccttgatggattaaattgatggcaccctataaattgaggaccttgcgcattcatttgtttccatccttgcatatcgcaattctaataagtataacgcaacttatcagtgatattttacatagcagtccttttgtagaaatgtttaacagctcctgcagattagtgatcaaatacgatacatgactgcatatagcgtgttcgtgtacttggataactaatgctcacctctggacgcatcccattccatggaccaaaagcattaccacagaaattgggcacgatgtgcgacggatgcatctgatttgggcttgcaggttgcgacctctcgaagtcccctacgccgggttgccgaaacatcccagacactcgcattatctctgtcagcagcaaaacattagcacatggcatcagcatggacacacatgaaaacacttgattgccactgaagaaaagatacactgatacagtctcttgtcaagaatcaagctacaacctttcaagccctacgaaacacactaggattgcgcatagaccccgatcgagctaagtttcgcatcatcgagcagggacgagcaagagcaaattagccaaggccgtggaatcggagaagacgaacactccaatccgatccaagaatgctatccactcagtaagcagggcgagcagagctcctcaccttgattcaacagcctgctgcagattgggagcacctgcatgaacggccccagcttctgatgctcctgcaacaactccgccaagtactgcctgcttcaccaccaccaccaccaccaccaccgcaatccaatccaatccatccatccatcccgagcagagccaacaccacaagaaacacaaggaacaagccgcaattcagagaaagaaataattccttctgttgtgttctccgcgcaagaagaagaacaaagaaagaaaaaaaaaacacaaaatcaaaacccaatcgtggcgtccggtccttacccgccgctggcagcgtcgggcgggacggggggcctgacctgcggcgacatggcccgcccgggagagaagcagccgtccgtaccgtgcagcccgtccatggcgatggcggcggcggcggcggcggccccagccacccctcggattggggaggaggaaaccaaagaagggacgggacgagggggaggacgggggtggagtcgagtcgagtcgagtcggggagggggagagacgagagagaggtgttggttttcgcctcgtattctttttcttttctcggtacggtggcgaggtcccctttttaggaaaatctcggcaaaaccccccctctgcgctgcgcagtgcgcacgacgtcgtcgtcgtctcgcgcgcgcgcgcccgcgccgccgccgtcacctgcttcgccggtagggtttactataaaacgagagccccgtcgtgagtcggcgagaccgcgcgagagcgatgagatatgctcgtacgacgcggcggcggcgtatctggcctgcgagtactttgccagttgccattttcaggttacctatcttcggtttcgtaattcctaggtctgtttagattttaacttttttcattaaatttttaacttttatgtcacatcgaactttcatacacacacaacctttcaacttttccattatgtcgtttcaattttttcaaactttcaattttgacgtggaactaaacacaaccttagaagtattatttttagacaacggcatgggttttattatattttttttgattttatatattatagtatgcaaaactaaataagtaaacatttaattttattaaagtatttttttgctaatctatatatcgtattgtaggatttaaattaaatattttagaattattgataatcaaagttaaaatagtttgatcttaaaagttaagaattacgtaactaaaaggaaaaatatgtggagtgtttttgtaaagatggagtgtgtattctttttcttttacaaaatagaggggcttttatctttttccagaaaaaatgtgtgtattatagattgaggttagtatgtttttttccttgaaatgacatatttgtgccatgctagatatagtcgatatttattgtatagtactattcgccattatttggatatatatatataaataaaagagcgctacgtaaattctcattgcacaaaagaaaattggtatacatttgatgttatgaatgcggacaataaccatatgtgtcacgctcgatagctgtgatgtgacgatctcaagtgcataagagttgatgatagctagctagcaatatatgacaatgcatatgtgttgtcttcagttgtacgtttggagatatacgctgatcccttgtcactagtgttagcatcgcgctatagtcgagaagtggcggtgttgttttactaacttatactaattccttgtcactagagttagcattacgctatagtcgagacgtggcggtgttgttttactaacttattacttagaaaacatataggggttgtttagattattatcaaaataaaccttaccaaaattttggcaagttgacaatattaccaaaattttggcaggatttcttatgtatttaccaaagtttgacaacaaactaaatgtagtcattttttttacaactttatccaaaaaaataatatggttaaaaatagcatcaatttgaacatgcccataaatattagtgtcatgttatgtgtcaatatatgacatatactattatatatggacatgtctattttgttcttttaaatattgttttgataaaaattcgttttttcaagttaacttttaaggtttctttttttgtccgataaaattaaataatgaagtattttatgtgcacaagagagttccaacattaccttttcaataaaataatgagataataacactggtggagaaaccgtttgtagtcccggttgataacccccctttagtcccggttttccaaccgggactacgaatccgggactaaagatcgctatctttagtcccggttcaaataaccgggactaaagatcgatctttagtcccggttggtaacaccaaccgggagtaaagagggggaatccgggactaaagaggggaagcgacagttcctcgagattttttattattattattattttgttgttgatttgctaatggctagtgttaatctatgtattttctcccgaatcgaatgagatgcacatcccaaatcaacatcacaaatcaaatacatcacaaatcctaaaaactacacacaaattaaatacatcacagattatacaaattatacatcttagatccatgcgatgcaatgaatcacaaaattatacatccagtgaaacacaacttacaaaaaaaaaagaaaaaaaaagaaatcgagccagcgcccggccaccgcctgcgcacagccgcctgcccgccggccgcctccacgcgcgcggccacgccgccgcccgccgccgcctcccccttcgcggccgcgccgccgccgcccgccgccggccggctgatggaagacggagtagaggggaggaggaggaaggagaggggaggagaagaggaaggggaggaggggaggaagagaggggaggggaggaggaagaggattggatatgagaagagcaagagaggggatgttccaatcttatctaaatatctgtctgggacttaaccgatcggatgtgggagagaaatatttactcccggttgataacttcaactgggactaaagatcgatattaccaaccgggagtaaagatcactcgatctgataccaaccgggactaaagtggtaatttttagtcccggttggtagtatgaaccgggactaaagatcctcgaccccctgacatacatctgataggggatgaaccgggactacaaatcatctttagtcccggttggtgttaccaaccgggactaaagatcaaaattttttaaactgggactaaaaatcgtttttagtcccggtttttaatggaatcgggactattgtgaaatttggtcgaccaaccaaagatggtttctccaccagtgtaattacaagctcggacaaatttgaaatttggcacggcctaaaaaatgcttcttcaaaccgatggagagtgaccactgtatgatggcaatgggcagcatcattttcaaacatggagtagcaatcgaccaattcaatacagagtaccattatcttaaaaaaaacagagtaccattttggagtttatcgttcgcgtaacgaaaaccacaggcaaaacataaaccggtggagcatgcaaggctgtataaccagccaaaattattgaactgaattataaggctgtcagctggctcgtgtcaggaaatgatatcacatatttattctgatttttttctctcctctttttcagttccaacctttgatttggttagcgatccaactggcttctgctaattctaccagtaaaccagacgttgtctcgaacaagatgcatctgaattgtctcgatcgagatgacgttggccggagcaaaagacagtccgtcgattaagcctgagctgatgttaactaagcacaccatctcatgatttttaataaggtgtcaatggccaattaggaatctgcaacctaacacgatatatacatggttggtgatcgacagagaattagatttaatgccaaattatcatgcatgtgtgtgtgtaattgtggtaccacttctttgtcacgtgttcctcacagagactgacccagctggtttgagagcgttgcagctgacccaccgtcgatcgatctgcgacacatcgaggccctaaaagtcaacaatcaattctagagtagatcatttactgtggaattcgtcgcatggatcacgatgatgtcttgtgtagtacttttatgatatgtctatcaaacgtgtgtagacgcctgttaagtgacacattacttatatttacggctaattattctttcagtgatatatggcgtatctgtcgatatcgatgcgctcatggtgagtccggggactttattaatttcaagatatgtcggtctaatattaagcgtgtgcgtgttgtgagcgcctacgattatactacagcgaccccatacgtacattgctacaagacatacgtagagtgttgttataaattgtacaacggagtaatatagatcgagtattcgtagaactgactgagatatgattatccaactctaagagaaaaagacttatgcatgttaagaaaaaatatgtaataatctcaatctttggaagcacaactcacgaatatgaattataatcaataataatattcttttttttcctatagcgttaactttcaacaacttctatctccgtatttactagacaaggaaccaaggttatatccaagatatagcttaaaaataactattaaaattattttaagatagaggtaataagttacaattgtattgaacaagtagatagattagggccaaagaaagcatgcccaaaaaatcactctctccttctacagatttcccatttctagatcccaatattttggttgttggccatgtaggcagttagtgggaccgtcgcatccgtggttctacgtcactatttgttggctgaccgctgccttctgcgttattgtctattagttgccatacgtcgcttctattgttgtcgctcaacttacactatcaatatgtacactatacgtcttaaccaatctgattattattcattcagttctgtatttttattattaacatgtgaaaattgtcctgaaaactattgtaatgtcaagcattaccaggtgagattgcatcaaacacaagacaatcaattgacttgtactaccaagtttggcctcatactggctggcgttatgtagagttggggccacactgacaaaggaggtgaagacggttcctgcggtggagagataggtgtgccctgcagtggagagggcgaaaacagccaacgaaaggagcggcaacgtcttgcagcggagcggtggaagcagtatagctggagaaggaagcagtgacgaccaacaacggagaggatgactgacgactgcccttaccttgaacggatagcgaggttgggcaatagcgggcacaatgaacgaggataagccgatgacaacctgacgagaaatttcacgcgacagttaaaaaaaatcacgtgggagttggattgggagcatcgatcgagttgcttcaattctggctcgctttgcaactggtttttggcatgaggtacatttgagaacgattttgggtatctgttggagcccagattttctaaccatcaaaatttagttttagggatatgtttttagcttttcacggagatgctgtaacgacgctgtcacatactaagggtctgtatggatctagggactaaaataggactaaattttagtccctgtcacatatgatgtttagattctaattagaagtattaaatgtagactaccctggactaatttgcgagacgaatctattaagcctaattaattcttgattaatctatgtgatgctatagtaaacatgtgctaattatgaattaattaggcttaaaaaattatctcgtgaattagttcttatttatgcaattagttttattattagtctacgtttaatatttctaattagtgttaaacatatgatatttagtccatgtattccaaacaccacccaactcctacacactaaacatcatcattgcatcaacgtcttctctagtcctaaagcctcacttgcaggagagttcatagcacaggggcactggggatcataatatcatcggatcatgcgagtccaagagcgaatcgcaaatcgcaccccggccagtcgacacgcgcgcgccgtgcatggcgacccaccgacccaccgacccaccgaccgagcgccacgacaaaaacccccccaccatcatccctgattctaaaacccggcttccgtacatcggaaaccggggacgcccacatgcgcaaacccacggatcaccggagctcgcaaatattttttttccttttcggactgggtttctcgcgcacgttcgcgcgtggacgcgtcgtcacctgcacgtgccgctgccgctgccgcacgagtactcctacgtgcaccggcattggatgccctgcgttttttagcggcagcaagtgttgggggagccatgagtatgtacgtggaattaaatttggaaatatattgtttatttaatttttttttctcaaaaatattcgagatgcaaaacttttttcagaaatatatcgtcggtctcgcataaccgttgcacgaaaatgatatgggaataacgttatgggtagtatcacgcggtgaaagcgcgagaccgcgtggcgcgagaccgttcggtctcgctgaagcaataagcgataccgatgccatgccgatttaattagtgattaattatcctaattagtgattaattactaattattatattaattgttaattgagtaattaatcactaatcaaatggagatgctggatagtgccgctgtttgatttggtgaaactgttcggtctcgctcttctattccgcgagaccacgcggtctcgcactttcaccacgtgataccgcccgcgacgtcacgtctacgttatttctgtggaatggttgtgtgagatcaacggtatatttccgtaaaaaaatttacatcccaaatatttctgaaaaaagaaattgaatgaacggtatattttcaaatttaattctatatacgtgtacgggtgtacatgtgggcgtagcagttgggaaaagcggggggtgttgctgatgcaatcactctcccgctagcggctagctgccccagcctcgtactaccaggctaggaaaaagagaaacagtgacgctgtagaggagttgtgaaaaaagcagtggagatggagatcctcgataggttttgtttggttgcttttttgcctgcgacgcccacgcagcttgttgtagcagaggcgaagcagactgactcccaagacaaaagcgtcatctccgccgtccccaccgtgtctgccgctgcttcggcttttcgagctcggctctcgcttcggcggcgtcatggtggcctggcgggtggtgacttttcggcacaaatccagccgaccttgtcatccacccggccgaatccccaacctaccacctccgcatcagtccagtccctgctcccacttgggcgttgataacctaaatgtaaatgctattcctacattagaggaaggtatttctctttgagcagatacaataaactattttagctagtgatagtgtatccacgctgacgttattgatgatcaggatagggaacagggtgtgagccggcgactaattagttgccaactacacacgagctccaaggcgaaagaaacaatacaaaagagcaagatgaagcgatgacggcgggagcaggctgtgacgcgagatgccaaattaaaaaaaatgatatattaatccattgaagtttgtgcatatagccggctgctgtactatcgatgagtgatactcgtggatcagatgagttgagtattggggtacgttggaacgagggtctacgtagtacgacatcaagcagataaaagacaatgattatactggtttaggccccctatcgggtaatagccctagtccaatttatatgggatttatgatgatgagaacagattacaaatagagtagtcgaatcagacgatactgacgagattgtagtcgagggttttgacgagatctcccggcgacttggttccacgtactccggcttcgtaaactatggtgggtgtgttggcgattgaattgtatgcctttcatcccccctgggggtcccttttatacagtgaatcatcttgacccccaagaaatacctgaggatatttgatctggtacgataaaatataaattctatcccttccgaataggactttggaaatcgcttgactcgtagggatattttccataatttggaacatattctttatgacattcatagggatgatccgtgtacgcgaaggtataccctgtcggtatattccataagttgtaggatatgaggtatgccttatctgtaaccctgacatgtacgtattagctttttctgtctccgctattgacgtgttcttttttactgccggcagccatcgcccattattgatcttgctcttatacacacaatcttttcatgtatatttattaatacccacaaactaacaaatatcatagaaaattttatatacatactttaaatagtatgcacctatgtgtaaaattttattttcaaatttattatactttaatcataaaaaataaaattctaacatagttttaccctttaaactgtcagaaataaaagacgatgaagagagaggagaggggacgaagaagaccgttcggagagaggagagagaagaggagggagtgagaatgacatacaggctccacgtgggccccatcaattttaatttttttaactgacacgtgggtccatagtttttttattatttttcagattaaattgccacataaacaccacatcattaccacgtgagatgaagaaatagtcgaataagccatgtaggcaccacgccagccgaaataggagataatactaccgagggacctcgtttggactggttttgtaagttgagggatgagttgtatctggttttttctttaaggaccaaaatcaaactggacaataacttgagaaacctaaatcgaacttattccaatgatggcctaaagtgggaatcacggcccatccaaggcccagaagatacggcccattactctacacccacaagtcgagcaccaccccgtcggcctccacgacgcaggtcccaaccgcttctggcggatagcaagctaggctcgggggaatctcgccgtcgcatcaccgccgccgccgccgcccgccggttcgatctgagaagccgccacctcgccgcccggatcccgatggcgcggcttcactggctggaggcgatgctgccgctgggaatcatcggcggcatgctctgcatcatggggaacgcgcagtactacatccacagggccgcgcatggcagggtacgcgcctcctcctcctctcccttccgcctccgcctccgcctccgcctccacctgatccgggaacccctcgcgttctgacgacctttcgcatggtttggtttcgtttggatggatgcagccgaagcacatcgggaacgacaattgggacatggccatggcccgccgggacaaggtgctcctccatcaggcctcctccgagaacaactaggtgcggatctgaacccatgccgctggagcttgtgctgtggtctctctttgggttttctcgcggggcacggcttatgtgatgggattggtgttgggatgcgggattctagggtttgggttcgatttgggaatgtggttaggttacagcgagtgccttatgcgcatcgattagaagatttagggtggtaatcttaggtctgtggctggaaaatctcaattatcgggccgctcctgctggaaatttgcacatttctagtgaggattccactgatggattgttatggttagtacagactctgtgatcatgttagacttgatactgcgatgatgttaaattgatttcatttcagtgggaataactacttcatactgctgatgacactgctcaggttcttccgttgtatgttggtacgaaatttcagaaaaaaaaagacgtttggttgggttgtcagagtggggtgatgatgttttgtggttaggagagccttttaagctgtgttgctcactatccagtcgttgtgatgaaacctgatcaagctttgcttcaccaatctgccttttccaaacttaatgaatattgttataactacagtctaggttgctgcttagttttctccccagtctccaaaaacccttgcaggattctaccaactcactccaataaaggctcagaagtggcgtgttactgtttatttggtcgctgaagtatattcgagagctggtatccccagtgttaacatattaccacttgtcctttaggtgcttttttgttttgtgcagtactggtggttgtcggcctgtgtttctttttctgtttgaactctgtatcactgttatgggcttggttttcatagctgggtaaggaaattacctaatttctacaagaaataaaaaagactcagaagtcagaacatggatcactaacacaacaactagaagaattgcaacatggtctttgttctatattcttcttgtttttcttttttgctatcttgtgactaaatattgttgcccttaatgtgcaacaaaccttctatgcatgaaccatgaataacaccggtgatcatggcaattctttgatttaatgttaccagtaccactccagcttgctgttgtttggtcacaatgctcaaaccactgtttttcaaagctaagacttaatagtatttgctttatggaaccatttttcttgtgtccccttgcattctgatcaattgctgatgctggaatcacactactagccataatatttatgttgccaaattacctttaatgtgattgaatgtattaagtccccattgcgttttgtatctgcagcatatgggtgggtactatatttgaaatcttcctcagaatattgaatatacagtagagctagttactagtattaaataggccgtgccaatatttggctgatcatggtgaaggaaatctcaacttctattagacagatacatctcatctattggcagaattttttggaatatgctctgatctgaaaaaagaatgtgtattatctttttcttaaagaaaatgctccactgaattttgtgatatttgtgtattgcgtcacttatctaacaatggaaaagataacagtttatgtgtgcattggttacatatttttctatttgttgccgtggtaatgctgactatatccttacccttcatgttgtaggatattgatcaacaatatctagcctggatgttgatgaagttatttcaaatgcccagaattactcctgttagtttccgtgtataatgggaagctgggcttatgtttttgtttacaacttttgaatattggatgaataatgtgtatctggaatctgtttaattacacaaagtgggtgtcgcttgtcaattgtgtacccatttctccccaggagctgatcatgacgaaaatatttgttgttgttgttgttgttgtgtttttttttctctactgtacaaattgagctagtcaccgcggtactggagtttgccatccccagtgacattgtgaactctaccgttgatgccttgggtcgtctcctgatagctgttttctgccaagagtgctgaataaatgaacattagcaggacttgtttcaaatgaaggttttctttaagaatttttcgagtattgaagtttgatatgaaaattttattttccatgacccttggattgtagaatggctttcaaaatcctatgcctaatgtttacatttcctttgcgaagtctaatgcaaagtctcactgcctctcctcttctttccacgctaatatatatttcccttgacattcctgagattttctgtaattcctcggccatgacatccaatcccttacatcttctcaatcatacatttttccatgttgcagaacacctaaataacttgaacatttcattctttatttaaactgaactcctatattcaaatcctaggaaaaagtataattactgatgatctcaagggacagcaagattggttatatggagtgagataatggcccaaagcaggaggtgctttattttcacaattaacatatggggtgagataattacgtgtgctaggaattacatgcaacaaaatgacccaaaaaattaataggcacaataaactctctacatgcacacaacagtttcagagcgatcacaagatgcctttcgtcaatgctcgttcttcatctctgtcacgccattatcgtccttgaagctccggcgagttggggtcgtcgtctctgctgcaccaagatcgtcattggagctccggcgtgcaggcgtcgtcgccgtctccggcgaaccaatgtcttgcttggtcgtcggcgtctctggcgcatcatcggcatcttcttttatgctccgtcgagtgggcggcgtatctggctcgtcgacgtcggcttccttcaagctccggcgagtgggtggcgtctctggcggcgcatcaacgtcggctttttccttcaggctccggcgagtgggcggcgtctccggctcatcgacgttttcttccttcaagctccggcgcatggtgggcgactcggcggcgcggctgttcgacctcgacatccccatcctgccggcgtggcccaacggcgactgcggcggcgtgcccaggccgccgccggcccacaagccgtgcgccgcctcgtgcgcccggagatgacacccgtactgctgatggtcgtcgtctccctcctcgccgtcgccgtcgccggccatgtcctcgtcgtcgaggtcgaccacgtcctgcatgttgagctggtggaactcgacgatctcccggaggaaccggttctccctggcgtacaccgtgttctcgttcgccagccgcgccttctccgccagcagcgtctccagctgctgccgtatctgcatgggatcatggggagacggattggacgtatatccgtttactgtatttcaattaaatagttataattttttttaaaaaataataagatagatcaatatgtaatatatctctacaaacatgtaaatttaaattcaacttctataaattatataaaaaaaataaatttaattgcaaatatttttaccaggtcctcgtcggcgtcgtgcttgccgtcccggagcatgcggttctcctcctccagctgcgcgcaccgctccctggagaaggccatgtcggccttcactgtcttcagctcccgctgcagcagcttcaccttggccgccatggcgctcgccacctgatcaccgccgccgccaccaccacaagcacaccatgaaattcagagagcgcagtcgcaaatccacctccggaacggcaacaaaagaggagggcaccttacgtcgcgagaagccttgatctgcggcgactccgtgtccgacatcgtcggcgacatggcctccgggctggacaatcccatgctgctgttgcggaggtccatgctgcaagccttcctcctgatgtgcagcttccggccatggacgccgtcgcccgtcctgctgctaccctccaccttcgtcaggccctcctacaaaaataaaataaaataaaattacaatattgatcatggcattcataaaatctctgaatgctaatcttgaagagaatgcgacctcgagggcggtcttgatcttgcatccaatgtccaagggagggttctcgggcttccggacccggtcgtaggaccaacgagattgcgatgtctgaaatccatattcagaaacaggttagactgatcactgatcagactgaacaagcaaacggaaaatgtcaaagttgtctgaattaagcctgaatttgcaaacaaagaatcgatttaatttgctgctccatcagcttgctaatcgggtgatgttcttgttgttccagagctctttaccacagagtgattatcatccgtgccgccgttttcgtcgagcatcactatggcttgctgtgccaacactccccagaatccgtgcttcgtctcatttcccttcgcgccgcgcgccgatgtgtacagctgagtgacaggatcctgcaattgttgagtagcatactgtttcacaaaatttcacatcgattttttctcaaattgattcacaaattcagaggaattttctcaaatttagttttgtatcggagcagcgcaccggggtggagccgtcgggctggggagacgaggaggcggcggcgagggagcggtcggggcggcggctgtcgtcggcgaaccgggtggcgcgcggcgacgcgatggccggcgaggaggtgtcccccggctgcggcggctgctggcggtggtcctccacgaaggtggccgacctctggatcccatgcttcctccggtacgccatggccggcgggccgggggacgggggaactcgagcgatcgacggggcgctttgcccgctctcggcttcgccgtccttggattggcgtcctcctcctcctcctgccttaggtcaggtggcgcgcgctcctcccatggccgccttccgtctccgcgccaccgcgcgcaagcagtggatggcatggcattcccatggccgttgcttcgcccgcgttttgaggccgcgcgcttcccgttggatcgcagctcgctctctctaggcattttgcacggaagaggctcctccgacgtactgccctcttacgtggctgatatgtgggtccaccagctgtggggcccatatgtcatcctctcaaagttagggagcagtacgttagaggatcacgttcctgatggtatatatgctggtttgggtaaaaaaaaattaagagtaaatttcataaaactacatgttttatggttcaagttgcagaaaactacacatattttaacacttggcacttaagtatatatattttagtagtttagtttcacaaaacccactattgatgaatggattgacccatgagatgacgtggttgttccatctaggatggggacgtggcatcctatcaatttcgtgtgatggctagtaataggatgccatgtcctcgtcctaggtgaaacatccacgtcatctcgcgagtgaatcaattcatcgatagtgtggttttgtgaaactacacaaccaaaatatatatacttaagtgccaagtgtcaaaatgtatgtggtttttctgcaacttggaccacaaaacgtgtagttttgtgaaatttactcaaaaattaaacaacttgaggaaatcattagagcaagtttaatagtataacctactaatagctccgattcatctatagccaattcataaaatagttgcttactatattattaatacatgattccacctgtcataaacacattacgtcttggagtctgtactacagctggctatatatctgtaacccgctactattctctttcatcttttatctcattaaaatatgtttgtagctggctaatagtcggctattgtacctgctcttaggctgtgttctttacttctttcccatgagttctcaactcatattcttcgtttttcgcgtgcacgtttttcaatctgctagtaaacgtacgcatttcatgtgcacgctttaaataaaaaaatcatattaatccattttttaagttttctatagctaattcttcattaatcatgtgttaatctatcgctccgtgggagggattcccaacccctccaaaagaacattcccaactcacctccttcgtgtaccatgtgcacgcttttcaaattacaaaacggtacgttttttttgcaaaaagttttttacgaaagttgcttaaaaaatcatatttgatccatttttgaaaaaagaaaatctaatacttaattaatcacccgctaatggaccgttccgtttttcgcatgttagaaatatattcccaacactagtaaacgaacacaaccataagttgtggatgcatgattatgactccatatatgaggattcacattctgatgcccataaatattatgtactgtaataggtttagtgacatcggatgtatgctgctggtttctgtctctttgagcatatgctacgaggtgcatttgtaggggtgttagtgtggtgttacgtgcgtagtggtgtgtatatatatctgttgcgtaatcgtaaaaaaacaacttaaaaattaaatttgtctttttaatttgaagttagttataaatatttggcgattatttacgcttcaaaattcgtgcatatttcagaggctcacaggtctcctggtccggggcagttcagtttggccatacgtggcgtcatttcggcctttctgcgacggtcctcggcagggctccccgtccccgcgagccgcgaagccgtaaatccccggagaggcatttcctcgaacacctgccgcgcgcgccgtccgcccccaaaaaccctcgccccaaaccccgcgccggccgaagcggcggctccgtgcggatgccctcccgtcccgtcccggcgcgccccggccggcggtagtaggaagtggggggcgccgagcgtaagatgcggcgcttctccccggccgccgcggcgctgctcctccgacgctcgctcgccgccgccgccgccgccgcctcaccagcgctccgctcgggtccggtaatctcttgcctctttttaaagaaatatttgttcggtggattgaacctagctgagcccgactgcccgaggtttatgcatgggtgattccgaggcctcgttgtgaagggagattgcaatttggacgattggaatttgtagagaatggggttactgtgtgattaagttaggaatttgtctcccattagttatccccgagttaacctggagatcttggtgtcttggtggctcgtgagagcttgcatagtggatttgtgaagtttgagccatgtttaagcatttggggattgtcgtatgatttactttgtgttgttttaaggttcattcgcacagtgtaacatgccttgctttgtggcattcaaattgctcatttgaattctattcgtcttgcctacagagacagctggtgcgtgcctcgcttcttgacgaaagtttgtctacacagacgagttcagcggcttcaaccatggctgtgcagtaccaccaatggtctagttcagcagacggggatgatgatgaggttcttgaggctttcaatcgggactgttgtaccgatgcaggtgctggtgttttggatgattcagcatctactgcctatgttgagaagctctgcacatcaggcaacctccctgatgctgttcagattctccgacatttacatgataggaagatccatgtaggattgggtacgtttaatttggtgctggagcaaacaggcgaagtgaacaacttcgttctttttgccaaggtgttcaggtacctgctgctttccaaaatagctcctgacttgacttcttatacaaatgttgcaaaggcccttcagaagttggatgactatgaactaatacttaaatttgtgagacaagttatggaaattacacatgatagagatcctacagtgatgaatcgcattgttttcaccacggctaaatatggacagattgataaatgtttgatcatatttgaagaactgaagaaagatcaaagagggttagatgttgtcacattcaataccattttggacatgcttggaaaggctggtcgggtggatcaaatgcttcaggaggtgaagctaatggatgaacttggccattctcctgacattgttacatacaatactgtaataaactgcttgcggaggcttggaaggttagatcagtgcaaaatcttcgcaagagaaatggttgagagaggcatcgatccagatttaagaacatatactgcactgattgatattttcgggcgggctggccatattactgaagcccttgaaatgtttgaccagatgaaaaggtcacatcaaccttcaatttatgtctaccgggccctaatcagtgacttaaagaaggctggacagtttgaacttgcacaaaagttatctgaagagatgaaaacaagtgcttcagaattactaggccctgaagattttaaacataagttcaagggtagaaagatcaacaagaacaagtaagaaaactgtcaatgatcttccaggtgtgaatatttcgtttgcatgtgccttgtgctcatccactgtttcagccaaagattctgggataagttgaaatttttcagggaatgtatctcattaacaatgagataatcacatgggcttacaaaagagtgatgattactaacagatacaatgatatcaggccgagagaaccagaatataaatcataaacctctttgaaatatcatggttggaggcttttgctgatgtgcatttgaagagacaggaacacacttctctcatttatatcttcacggatgcaagagattatctagagacaggtcctttgcttatgagacctgaactgtttatctgagattgttccaccatagcgcaaacttgagccaatgaagagttaattctcgattgaattatgtgtgatgtgcttctactggattatcatgtgaatgacttgtgatttgttcagcactcactggttcaatttctgcttgttctgcacttctacaagttcaatttcagcattgccattcatgttcagtgccgtgaagaatagttggagccttgagtaagttgtttaggtccttgtcgtggatcactagatataacaaattaaatatagatcacattcttttattgtcctctactttgccatgcagccaagtagaatattttgtactcatgtaaactgttagtccaaaggaagtggctaaatttctgtcgatttttcctcccattttattagttttttggatctttggattgcatatcaagattcgtgcaaagaaactgaggttccacctgttttgtttttttattcgaaccccctttgttactgcgcctcctcctttttgttttcttttcaccagatggagagaggggggaagctacatgagaggagaggtgatgggggcgatttcgtcgccggtagatcctgcagcggtgagcttcctgatccctcctgtcatttttgtgttgattttgtcttccttgtcctctgcaggtttcagcaatctatgactggaggccagtggtgtcgagcttggccaggcttttgtcggtgtagcacttcttctgtctgtaaggcccccctagcttgtcgtcccttctgaatccagtagctaggtttcaccggtgctctagttcttccttctcatgctttgttgtttatatgcattagggtggttatacaggtttttagtacggttcaatcctcttttcgttttgtatgcttatggactctgttaaatttttgtggcttagagattacactttcagttgtgctcctggctatttcactctttcccctgcttcatttttgttttgatgcataatattgtatggttaacatgcaaatgcaaaaaatcaaccaataaatggtctatgtgtttttctgcaatcatatatgcatttgattagagttttctttaccagagatgtggggttgattcatgattcccccctatacacagattaggtactttcccccccttcatcttttccaattcctgttgctcttcctcttccttgtcttcgtcctctctttttttactgttcctcttattcctgctgattttttcctttttttttgttttctagcaccatgttctgaatttttatatcagctgatcttttaatattcaaatagatgtccagcatcagtaccttgcacaaaatttctcaatacatatttttcatttttttgtggttttatatctgcttcagaaataatggttttactatatttcaacaactctagtggcaatcccttcgaattctaccttttatctgaacctgaattttgttcagtcgcaaacatgcttcgacaattttcatgttttcttgagatgatggtatatatttattttacctgcaatattcaatcaaacatctcacccttttacttcctgataacaatgtgaagataaatgcatttctcgagtacattaaaatgggagtggcattagttttcaagcattattctatcagactgcagttcctgaaaaaaaatgcttgatttgtgattgcatcaggtttccacattagagatacctagctttagatgagctcacctctgaagtcagcatgctcaatcttgagcgtgctaggcaaataaagagtcgactggtcgctatatctggcatagttcacaaggtcagcttgagcattatggtatatactacaagtatatgtgaacatttatacaatgatgatatggtttattgtgactttgtgagtaattctgaagtgtccgagtgctatttccatgaatcgtttgacaggtcagggatgaactacagtgctagctagatgacgacatcgacatgacaaagctcgcttaccactcagctggctgccagtcatcaagatttgacatcgagaaagaagcaagcgagctcgaagatagtaataggtatactcctacaagacaaaaaaaaaaaaaaatcttccacaagttgataagttggtgcttcatccaaccatggacatgacgtgtgcctgaatgcagcgccagggaggacgatgttgataagttgcaaacatgcttccacaattttcatgttttcttgggatgatagcatacggagtataagccttcattttatatttttacctacaatattcagtcaagcatctcacccttttacttactgataacaatgtaaagatagatgcattgctcgagtacattaaaattggagtggcattagttttgaagcattattcctgaaaaaaaaatgttgtttttctcgcctgggctgtgtatgttgtgttgttgagttgtgtattcggctttgtgggccaaaaagaacatgcgaatgttttggcaaagaagaatccagccattcttgaccgaggtggccctaaacaacattcgaatgttgggtagacaatccctattccctagtccaaattatcttatcgtctgttgattatttgttttttccacgtgctttcatgctatcctctgtagaaatatgccatggatttcaaattcacagtacgcttctctagaaaaaaaaaatctcctcttacataatgcacttcaatctactggtcctactaaaccaaaagcaagaatttggggatacaaggctctctattagttggagatatcctgtattttacgatcaaatgtacaagaggtgctgacacaattcctttgcctcatctattgttttcagcagctaaccaaacaaaacatacaatagcaggcctctcgcaattgtccacggcccggaaaatgcaacccgcagatccaacagggtcgcacttccaatcaccttgcactttgcagcaacatgtatttcatgaacatatcatattatgtcatagtgcagttagtatctacaaaagaatcagatgaaacattataaactacaataactcgagggacagcggaaaaatgtacaaccagacacagtactgccgacagcagctaacccaggaggagcatcatattcaggcacacacacccagagggggctcaaaatcaaatacctagaacagcatggtaagatataagataatccatcctgccatggagaagacagcaaaaatgtgcacccagaacaagattgcagctgattccttgccacaacctcttaggtttgcaacagcacctgcccataaaaaatagcagattagtattgcaactgtattatactcaaaggttgattaacatgccaaatatgatgtctcagtcatccttatactttttcgtacctgatagtaccgatgtgggcatagagtgctgcagtaacaggacgaacttgaacatcttgtctccttttggaataaatccaagcttgtcagcaaatgagacgatgccaataccagcaattggaaccaatatcaagcgtgcaaatataatcgcgacggtggtccgaaccccaagtctcctacttccttcaccagggcctaaaaccataataaaccacaagtatggacttcagataaacatataaattgcagaagtataaatgtactaaaagcacacttcatattgcagcacggttctaatgagatttgagaatacaagatgagcttaccgtcaacaagattgccaccaacggcaagcaaaatgcacggaatcatagcttccctgaaatatataaaacagcattgttagcaagagatggtttttaaatgcgaatcatatttgttattacaagacactataggcatattgcaagaagaaactacaagtcatgagacaggtcaatacccaagaatgagacagctatctgttaaaaagaatagaggcgcgtcatctgtgaggatcaaattcttcaagaatggcacaacaccgagagtaattgcaagaacctgttacatgacgcaaaggaacattcagataattgagaaaaatgcaagtattgttttacggcagtgataagagacaaaaaccaaatataccgagcacttacagatgcaatgattggtggttggaggagctgcttcttttgtaggaatctaaccatgcccttgataggaatcattatctgcattaagccataaatggagtattattagttattttggtaacaactactgaagtgcctctattttttttttccaatatgctgaactagcattatgttgtgcccacttcttacttttgaacctaaagaatgaacgtcctgcccctcctcctcctcctcctcctctatagatagcaggggctcttcctcatgtgtattgccatgagcacttgatggatatttcgctacacttgacatggtattaggagccttaattggaagtttatctctctcctcatcgcagctgtcaaaggtctgcccggggggtggagcaagcatcttgaacacatatgtgtaaacaataatggcaccaacctgcaccggtaaacaatccaatagatatgataagtatttggagtagcattttaaaaagggatgtgcaactccataaacaaacggatttggacatacccattgaccaaatgataagtatgcatttccatcttgagtacatttgttcgagtcaccaaacggatttaattggtcgcgacataatgccgagataaggacaagtggtatatttccaatgttccctgcattaagtgaaatgttaaaaatataatgcagaatgcgtgatgaatcagaagctagcgatattcataagggcgtgaggaatgtacaaacctattccaatgtgagtgatggtgaacttgaagtatggataaggcggccgtacaatcaatgccactataagtccaaccaaagatgcagagactgcacccagagcaatgtttgctggaatgaaccacctgcaatgcaacatcatgagtaatgttgaaatgctttgacacaagaagaccccaaatatcgccaagggaaagatacaacttgtggctaatcatctaaatgagtactaatatgttctttcttaccactccatgatcttgtcaattgtgattgatctcccgagctgcgcaaatattaggcaaggaaggagcagagagaacacaagctgcaaaaataacaaaaaaaaaaaagacaagataaatcaacatagctagcctgaattctgctgatgttcccatagctagtctgaattccattatattctgaaaattagcgagccaccatgatggttgtgagaactactgaattaggcgccttaccgcattgagaagcttgcggccgctgggcttgagcacgccgacgcgcttggacgccatgaggaaccccatgaagcagacgacgaacaccttggcgatgggcagcacggcgtacctgaacatgcccaacaccgactcccccgccgcgccgccgccgccctgcgccgccgccaccaccatctccagcaccgacctccccatcatcgccgcccccgcctccgacacgaaaccacaagcaaccggcgaaatcgaacaggattcctccccacctaaaaccgcgcgagctgaactgatcgaacagacgcggctgcgtcgcgacggccaagcagctgcccggggcggcgaacttgtagccaaaaatagcaaggaatcagttcccgaaacggccaactcctcctcccgacttgtacaaccactttccccttccgtgtcaggatccaacccaatcactcaatcagcgtaggaatcggataccaactcgccgaaatttagggttaatccagcattattagaaagaaaaaaaaaggatatccgagatttaggcagcttagtacgagcctaccaaccgccggaaatccgagacttgagctagagatcgcgcaatgtgatcccactcatccgtgcccaaaaagggcggaaaacccgcaggggagagagagctcaaaacgccgccgcgggagcacggggaagaagccgacggcggcggaatctccccgggaatgcggcgaggcgatcgtggtagggctcgtcggcggcggcggcggcggcggcggtggcggaggattcacggccgacgccgccgcgagccgagggaagttgagaagacgaggcggcgacgagaggagaagcgtgccacgtcggacgcgtggggcccatggtccagctacatccccggtcacttttttggggcccacgtgacgtggacgagttcttggttgggagacagagagaggaggacgtgacgtgaagtagacgagtgggccgccgaaatccagcggagctggatttgaggcccatacaggaaaggaaagtaggcccaagtttaagaaaagagataggcctagttaatttacttacctttcgcaagtggttagtggatccgttggtctaccagcttgcactcctactttaagatgccctcaaccaagagcagctccaacggcgaactccgagatcaagtcgccgaggagagcgacgaccacggccacgatcgactttaacttggaaaaatgaatgatttttcaacttatagtagatctgttcttttcatctcctgcttcctactgcaaatgatagcgtgattatatttgcagtttgatcatcttcctatcgagattgtgtggtactatttcgctacaagtatatattggtagcgtgattatgtttcatgatgatcgatgagaacggttaggttcgatccacttatctattaatcctattcatagatatactctaacaaatcttcagaatcgctttaaaatataaagataaaagaatcaaacccctaaaacctaggtctaaagggttcaacccaaaaatggttttacatgtatagatggccaaggtttgtacaaagttaccaaatttaattaaatttaacaagtttttatggtgtgaacatgagtttcaaaaatttgggtctgagttttacacacacgtagcgagaatttctcgatctatttgtaatatattgtggacatcacatgtataaatggcataaagttatttctctgtataataaatcattccaacaaaatttaactgaatttgataaatttttttggtgtgaacacgagcttaattttttttaaagttttacatgcatatattaggaatttattggtctattaataatgcaaatgatccatttgggtaaccctaaataacatatcgatatgatgaactcatggtggattgatccggttgaaaaatgtatctacaaactcagtaaaaatgattatgtttgacacatatcctaactattcctatcctgagttatgtttacaacattcctttttttcatggccatttgctaactttaacgtctctttttttcctgagtaatattttgtattcaaatataagattaatactataaagttctggtcaattaaatgttacgtacacaagtgtacaaagtgaaaagagtaaaaatgtgatgtccacaattttactctttttctattcaatgaaaatggcggattgcatatgttcttaagtttccagcctaaaagcatccttggcatccgtccaatttcttgcttgttagaagagaagataaaacaataaagcaggtagttactatcatacatgagacttggtatattgcaaagataccttttaaaaagatgagatttgaagggagaaacttccctcaaaacatttttttaaaaagaaattgtgagtgcgtgggtgattgaacacaggacatgggattgaaactacacactcttacaactgcactatctgcaagtctatctcacagagagaccttttaatctaaaatcctctctgagagctgttgacgaaaaaaatcgaacacgccggcctgggagatctgcttagctcctgtgcaagtccaaagattggtcagatgcgggcgtgccagtcagtttgattctgcaactgacaagatatgcaaatagtagatcaaaacagtcgatcggctgacaagccgatggagtagttccagccgatagccgacaatagccgatgccgataccagccgatagcgatagggtttaagcaatcggctatacgtccaatgtagattctaacactttagtaaataatgatatataggcaatcggctactgataataaaatataacaataatatagtccagtataaaccaatcggctagcattgatatgatagaataagcactgatctgaaggttaaagcatacgtcggctggaggcccgatgtcatgaaatccacaagattagattaaacagtgaaacctttgttgtcatcggctaaatccaacttatatgtatatgcaatccttatgagtcgatgcaacgttcagataactcatcggctgaaaccccgatgaaacccttattggcaatcaagaagcaggctagagattatgtttctaagcacgacttagtagattaaacttaactgatacaacactaagtatgaaaagaaacataatatctagacaatcaagccgttgactgagttttcagggtggtagatgtctaagctaatctaatctagcaacgcgatttagccgataccagcaaaaaccctaaaacgagaagcagccaatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctggaccggcggaacattggacttatcccttcgctggagatcgaagacgatgcagccctgcgtcgggtgccaaattccgtcgggtgccaaagggtggcgatgcgccgaattgtattgatcgtagcgatagattacatagaccccgggtatacatatttatacccatgggttgatacaagttcttgtcggacaagaaagaaactttcctaaagataaaaggaaactaacaaactattcctaattaatagataacttgccatgccgcattctctttgaactcggtctcttctggataagcttcctttagtagatcaatttccttagccgaatatagcaagaatccgacaactgacgacttgacaactctcatcggctaatctcatgacttcgaagccgatgctgactctaagcgatgactactccgggcttaccaaatttcactgttaacaagagcttgagctaggacgatggttttgtttaccggagtatagtgttttcttcctgtccaacaattgattatcaagccatgctttacaagtgttacttgcaagagaacttttatggtacaacaaactgatagtattaaccgctggaataaatgatctaatgctataaattgatttgatctcccacttataaatagatggtagtataaaattttacagggtagattcatctttctttgctattctgcaagggtcattttttgttaaaaaaagggaagtaattaatttagataaaaaaatggtaccgtcgcctggggtgtatgagcaagacttagaacgtgtaagacctttcacacacatctgctatgttacaacttacattatttgatcggtaattggtcacttgtaaccaaagtatgtagatttttaatgatgatcagaatcgaccaggaatcgtgccactgcgatgctcgtcattgtctctcgcgggcgtacaaatgagatccaacaacaatgctagtggcccgacacatgaacgagtcctaattggaccgaattgactctcaacaacgaaattactagaaaattttctccaattttcgataggactccaaattttcctatctatataccggcagtatgttgtactgtaaaagttctaatttttcaactaatcatcggctgctaatgttcaacaccttaaaacatttgctcaaacacattaaaaaatttgctgcaatttttctctattactgcatactcattgttggttgaacgatttacatcacaggttcaccaaaactggtatactttgatgtcctgtctatctggggactatggcaagtagttcatcacctctatgaagaacttggagtattcatgcttgatcctacaatcatcactgcaaaagactacatagcctccccatccctactccacgccgcagcaggcggtcatgcactggtggctatcctccggtagcaccagcatcctactgcgacaccctccaaccttccacattgcttcctggatcacgtcctcagtgatcttccagcaccgttggcactcccggttgatcctcttgactccaacaccggtcgctgccttatcgctgtcaccctcgacttggctgatgcacttcttcctggtagcgtgagcctcattggacttgtagaggaggaggatgagcacgta

SEQ ID NO: 74696 - DNA, 9845 bp, Oryza sativa
tcctttttttttttgtaccatggtcatgtacacttcatcaacccaactaaaacaatggaacctttttatttcttattattacatactcatgtttgattgtattgaactgccaggttgatatgtccgtctttgtgctatctcagtgcgcaagtggtaaagctgcatagaatcttcaataatcatgccccttccgcttacagattcgtttgtaataatgttgttttttatacttctccttctacttgaagtgctttgatttgaaatactggttagatcaacataagttgacaaaatctataactattatacataggaagagtgcacacaagaaatctgaatgctttctgttggcagagttgtaccatgtttcatagtgatttgggagggttgattttaggaaagggtgatacatcataaaagtagcccattcacttctctttttattttcttgattattgccttttatgtccaccaatttgatacttttggtacaacatttagccaaaatgcgattaggttttcttctatacatttcctacaatggttgacatataagttatgatatgtttgataatataggaactgtcggttggacctaaaataaattccttaagaaacctggggtgttctgtacctagtattcaaggattcattgatgctaatgaagagccaaattctgaagattcatggttgtgctctccttttcttgccagaaacatttattatgaaggttaaacgatttaggtaacaatattaaggaaattaatttgatgtcatgttaggaataagttgcatgacgtctatccatccattttgagtaagtggagatttattacaaccctattgtcttttttactctaaataacagccactataaaatgcataatacaatattttgtttggtgcttctttgttcattctttatactattaactttcaatcttaatttttctttgacgtgctaccttctctcacacatattaaattgtgcaaaccacattttccactcatagtatccgaatcaagttcttgacatatggtaagacaaatttgttataagaaatcaacaattctcaaatctcacccattcaaaaaaggacattttctttacaattgtataaatacatgcacattttctgaatgtttaaaggatgtactgttgttgtagatgctatacattactaccgtgatgcctgatgaatgcagtttctaaagaaaagcatttgtgttcttgaaatatattcaatacaacatactttaaacatgcatgatactactttgcaaaatgaacaaatgaatgttgaaagacaaggaaagagagttaccatctccccactgtgcttgctgatccattgcttgcagtctggtttttagctcattgttcagagatacaagtccattgttgttcctctgcaaacaatataaaaaattactaagattgtgaaaactccgaatcaaaatgaccacaccttctaataacatacctgcatcattgccacttgtgctcataatgtagcagtctccaactgcaacacctagaatttgtgttgaagctcccctatatacttcatctttttctcctttgactttgcggcagatgatcgattgttcaggatcctgaaaaaattacaataagatggtgattttcactaacaaagaacattgtgtcaaactatcaatccgcatgcacggactagtacacaagaattgaagttcacacacctcttgaccctcctaggatcagtcaagacaatctctgagaggaatttatccgccacaaccttcttcttatcatcctcagtgaatttcacatttggcaatggactcgccttcaccaccatttgcctctatagttagcagaggggggctggacatctgctgtccaacagctccaaaattgaggttccccatcatgaagctgtcaaccgacgagctgtggcaatggtgggttgtactgccagcaccagagctcttagcttcattctctctgcttccagaagggctccatgcctgtatgcccatgtccttaaggacagcagccaccatgccccccgattgatgcccctcggtcgttgtgacctttgtcttaactgatgctataggtagcatttgcgggttttgatgtgaataccctaagaggatgtaactatgcgaccgcctatgccccaccataagcggtagcctgctaggcggcccctggttagatctcgtcgaatgcagtgcaagagaggtcatcggtggcacatctatggcatcatatggaggtggaacgatggattccactgagaaaaaagtattaggaaagaacaagtaaaagtcttcgggtgcaaagccactgccaacttcgtaccatagaagccgatagtggtggttccgagcagggggacaaggcagataccgtcgaagaggtgaagtgggcaggagcagggtggatcaacggtaggaatttcgattggtcgaggcacttgtgggaggcgaggttgaggatggaggggactcgcggtggaaccaccggattctcgctcccatcaccgcaccggtccaacaaagagaggcggcacgagggttcgccctccatgttcggcacaaagcaagggggacgaagtggcgcggccgctagggttttggggatgctaccaacaagcacgaggatttgttgattggtaatgcgagagagggaagcaatgagaaaattgtgaaggttgtatttgtgttgtatgggtggcatgcaaaaatggaaaggcgcgtgggataaaaccggcatcactctctcatcttgtattttgttctgagcacacgcgtatgacttatctgggccaaaagcccataagcaatgatgtggcttactcttaagatggacttctcatggaactactggtctggtgcaagaaatatgtaatgacacatattcaatgagatgagtacagcacatttttttgcataacttttacttttcaattgttccactattaggctggactaaaataatcacaagaatccaatgaccactactattagctaaaacatgagtgtattgttcatctcaaaataggtactgaaaattctcattatgccatatcagttctaagttttgtaagctaagcttaattaagtcattatgcccttgtaagaactattccctctgtttcatttttattttactgaaaatactagtacaatgtttcccccagtagtcatatctccgttttatattataagacactttgacttttttcttagttaattctttttgtcagtttgacaaactttatagaaaaacatagaaacgattctaacaaaaaaacaaacatactatcaaaatattcaatgttagatttaatgaaactagtttggtggtctagatgttgctaagtttctctatacatttttctaaacttaagaaagtttaactagaaaaatattcaaaacgctttgtaatatgatacggagagagtacttgatttccattagtggaaatataggggtttctctcttgatcagaaaaaataaatggctgtcgttgtttcatacactgtgcaaaaatcagtcctctgaatatctgatgcagaccagtcaccagtcaccccctatatatggttaaatttgtaaagaaaaggcaaaatttgctacaggatactaaaaaatcgtgtaattagctgagggacactgaaaaacgtgacactatcgatggacactacaaaattgtgtaattggatgtaggacaccggaggcactattttctaatttctaggctgaaagaggggagagaaattttgaaatgacgggaatgcccccctctactccttcctttcttctcgatgcagctgacatgtgggcccgcgcacaatgctgtcgtcctcctctctccaacgcccgacgccactgcatcccttccaaaatccgatccattccctcgcccgtttccaaaataagttgaggggatttgatgtcctcactttcctcttcgatttccctcaagaatcctttgatatcccaatctaaatcgctcagatttgagtaaagttcgagctttcctttacctacgaagaaccctaattttcctaattctttttcgccgcatccgagtcggattcttcctcgtccacctttaaatagcatgccccagagctcctctctcaaattcccctttagccctggcttgccgctgcccggaatcctctcttcgcgcgttcgagcagatgggggacgatgagaggacgacgacttcctagagcacgctcctcgtggagtacacgtgggtcgaactctgggcagagtgcgtcgagtcatttgatgccatggtatgcaagagatggaggcctgacgagagctccatggttggcgtgcgtacctaggtgcccatggcatcgagaaggtgacggtggtgttcgacgtgatggacgacaagaacgcgtggacaattctcacatgtctcccttcttgcaaggtccctagctgggcgcacgcctttatgaagatgaacgggaacatgtagctgtcgggctcgatgccatgctccaccatgttccaccatgtccatgcagaggaagaagaaaggaaggagtggagaaggagagagaacaagaaaaagggttgaaccgtacttttacatatatttctctctccattttctttggaaataataaaataatgtcgtgagtgtctggtagctaattatcagttttttgtgatgccctacagaaaatactcgttcttgcaatgccctccaactaattacacgttttctggatgtcctgtagcaaattttgacaaaagaaaaatgagtgcttgcagggattcttctttgggtatgctagcaacatcgagggcttgctagacaccttgttcatgttgctatcagaggctcttgggcctaagtagagttacctggatgcaaccaggctgccaagcaggggtagatgataatttgccactactaccctctatgcccccagcttgagatcgccatcaggacaacacgccattcggactccaacttcctgaccgtgctcctttaggatcaaactggtggcctgcaagtcctctttgacaatcggtgggtcgatgtcacgctgatacccggagcactcatcttcaatataggcaatctcatgcaggtatcatgttcagagttcatgaaacacacaatgagaagaataggcattgccttgcagatatcattttcagaatccacaaaaatacaatgaatcttgcagataccatcagaatccacaaaacacacaatgacttaggtggtctcttgctggtatcaagttgagaatccacataacacacgataatcaacatgaaaattcaaaattttgttttgagacaacattaaaaacccaacttgtttaccctacattattgaacatatatttttgagaacacgcaaaacacttgcgcatcatttcatttctgaacatatatcggagacctgttttaactaatgtccatatgatctcgaatgactagttcaaaagcatggaacattcaaacaggggcacaaagttcagggccaagagtatcaatcgcgtgtttacccagcaaatccagcatcgacaaagatgttcagtccgttcaaatagctgttgtttgatcactactacacaaacgatttttccgtgcggtcgaaactcactttcgcgtgcggttgtttcgcccgtctggaacgaagggtctgcgaaaatcgtgattttcgcgtgcgggcgcttaagccgctcacacgggaaaatagaaaatcgaaacaaaaaaaaagaaaatcaaaaccaaaaccctaaccctaaccctaatctagccgcctgtcgggtcccaaaactaaagacttagatccgactaagattaatgtatcaatccctggatcagtaaatattgatgcatataatacagctggttcttcattgcatacgttaaagtttacaatactaagagttttacaagaataggtactcacctaattaaacataggtactaatattacacagcagaagttctaacacattctaactaggaaagtataacctctaaggattttctaagttatcagggtcgtcatagtaataaacataggagtcctcctcttgacccaaatctgaaaaagggttataagagcaagggtgagtattcacaatactcagcaagttaccaaggaaacatgttatgcattggcatagagtagagttctttgcaaaaggcaataatagacaatatggaagtattaaagcaagagtttgtaaaacatatactttaggtttctaaccaaggtaccatatgagtcccggtactcaattccgtgagtacggctattcgaatagtttcatgaatattctactgcagcagatgtacgctttacccgtagtccacgacttgccaattttcattagcttagtcatggcccagtattaggttattaacaattgtggtacctgttccgtgaacttatatcctcatgcgctctgaacgtgacgttaacagcagtgagagcagttctggcgttcccggggtatttaaggggaactgatcgtatgacaccacgtcatctcgatcagggtttagaattaccattatacttataattatactcgagtgtcataaaccaattacctgtacatggtaatggtaaaatttgcccttcgcggctatagttgcctcctgctcgaggacttaaaaataaataccatgatatagaggtaccacattgctaattaacataatgactaggtctgtccccattctagaaactgcggtcatacccattcgtttgacataagtacctgataataactatatcgatcgagacagtactagccaccaagaaatcatcccattctaacgtactgtcccaatttaagtgtaagacattttaaccagattgtaagcagagtaagcaatactaaattgtctgggtttctatggttgaattatgcataaaaatagagtattgaacagaaaggctataaataaataatttgtaaaatataggcttaaatgatcaaaagatgtatagtaacttgccttgctcgatgtccggagattgactgatattatctagtgtgtcagaagaatcctcaaggccaagggttagacatataaaatttaaattcaaaaagggattcaaataaaatcctaaaataggaaaaatataaaataaaatagaaaaatagaaaaagtagtctcaaaagatagagaatgattttaggagaatattggttcaagtttcactgaaattggatctatattttaaaagatatgggcttctaaagtttgaaaatcaaattaaatgtgaaatggcactgtgtacgggtcccacctgtcagtctctctctctctcttctcttcttcaacctccagccgttccccatttacggccggcggtgctagggttagtgatttcggcggcgatagagggagaaaggggttgcggccgaggaggggaggtagctagggttctccggcgacggcgagtggcagcggagggattaatttgatgtgtggatagcctagcggctagggtggcggtgccatggatgagctgagatggtgatcaaagtggtgagagttagacatggctcggagagggttcctagagcatctatgaggtacctagaaggatttaggtagcttgccgacctttggcaaggtgtggaaaatacttgccaacgagcgcctccattagcggcagtcgtgtgcacgtcggcagccaaggaggttgtatggtagtgccaacctattgcgaaaatggaatctagggggtatgtagatggttaaaatggaagaactcaccgagataggctgagacgacggattacggccgaaaaaacttctcggcggtgaagaacagagcagagcaggagcgacagtgctcggctcagtgcggtgaggtgaaactcgacacggagcttcggttaggctttagtaagctagaacatggttgaatataggtgttctaagggttggttagggtggagggtggatggaggggtgtaaagtcgatcgcgcacaaggtgttcgaccgatgggcgagagtggttgatgatatgaattggcaaagcagggcttcggggttgtggggttatggttggtgatgatcgatgatggacaaggaaggggctgaggtcttatttatagggctaggagaagcggatgagttcgggcgccattatcgccattgatgaactcgggaattaggtgtggcaggggtggcagagggctgagagagggagggcaagatcaatttgagtggcgggaggccatgttcaaattcttaccgatgaaggcttgacttggccgcgggtgaaaacggctggcgacatgttggcgccaatccgagcacgacgcgcggcggcggcgatggttaaaacggccagctcggtggtgattggtttgaattgagagaggggaaaccatcgtatatattcaatccaaccgtgcggcaagaattggcgcgattcaccccgggtagaagaaaaatcggactcggcggcggctttggacgggcatgcacggcatcgagcggcgattacttgtggcggaggtcgtcccggcttcgtcctcatcaagattggtgcgacggcggtggtctgagaggagttgtgcggctggcggcgcgtcaaggcagtcgggcacacgcgagcagccctgaagctgaagcgagtaaaggggatggaaaggcaaagaagaccacggccttgggtgggttgtggtccccaaggacccaacctagactttgttaaagattggatggatgttgggctgctctagttggactgggcatttcatcgagcaccttgagtgcgatgaacagtgttttcagagaattttgaatatttttcctagaaaagaatgaatttaaactataaatttgagaaggtttcaccagggtttaaagtatagcaaactctcactactaaaagggtaaactaaggaaataaactaaagtttgaaatttgagagattttgctcaaattcactaaggtttaggttaggggaataattaaagtaggttaaaagaattctaaaggagtaatacttgaaccaataaaataagaataacaaggattcaaatagatttttaaattatattaatctagtcaaaagccagcatgatgcagtcaaaatttagtttaaaatttgaggatgttacaccgccgctgccctagccgaggcccaccgccaccgcccgctcccgttgccgatgccggccaaacaccccccatcagcgccgcccgccatcgacacccctcccctctgccggaactagggagggaaggaaggggaggggagggaagccggatcccgtgcgggaggagggaggccggctgccgtatctgtgcggggacagccgccactgccaggtccgtgcagggacgaccgccgcccaccggatcctgcacctccaccgctgccgcgtggaggaggccgctgcgtgccgccgtcactgttgccgctggcctccggcccacctcgtcatcgtcagcgcccgcctcccgccggcctcccgtcggcgccgccgctcccggcctttgcgccgcccgcctctcaccggcctccatgtcacccaccgccatcgccgtgggccgccgaggagagaggagagaggagtgaggaggagagaagggaggagtgaggagtgaggagaggagaggaagcatgagagagaggactgaggcgtgagagagagcgcacgtgagtgaggggacttagccgcgcggataggggagaggagagaaaaaggaaaatttttaaagtgggtaggagggaaactattttcccgtgcggctctcttaataggtacgcatgggaaaatcgactcattttcgcgtgcggggcatttaagaggacagcat

SEQ ID NO: 74697 - DNA, 13577 bp, Oryza sativa
aactcgcttccttcgctgctttactgttcctctcctctcctcgacttcttcttggtttttctctctctccctcgagagagaagaagttgggtttgttgtgttacgctttcctctgtcgtttgaggtggcaatatatacacagcgggtgtggggggagtattcggaaacggattgggaatcccaaggcggatcggacggcgaggaggggggtccgagacggagatggaggacgcggggaggccctatttttccgggtttttttttcttttctcggtttcctctcggtattttttttctcttttttcggttttttaatacgtgtgtacgtacgcttttttttgggttttttctctccttttttactattttttaatatgtgcatctacaaagattgtataggtacgtagtatctcacacatttacatagtttgtagtttttttattggtttttaatacatatgtaaagtttgtatatgtacgtttacaaagtttatatacgtgtatatattttttattcactaaaaatgtatacatataaaaaattaaatatatctatattttttatatacagtgtatgtactccctcttctcattggatatccattagttgattatgaatagttagattaaaagagaaaaataaattactgttcccttctttttttttttaatttctgcgtgcatgcactccggccgttacatacgcaggttcaaattttttgatatggttgaggaagcacgttactagtatatgtatttttttttctcggcacacaagtacaaactttttgttttatactccctccgtcctaaaatatagctatttctagcacagtatcttgtcccaaaataaagctatttcttcacctacctcctcctctcaaccaatcgcaaccattcttcttcacctactttctcttttcaaccaatcacacacttcctctaattattctcacctactttcttaatacccatgccaacctaaaaaatggcttcattttgggacggaggaagtagtatgtacactattgcctcacaaattttgacaatttgactctttgcaaaaactaattatacaaatgaaccgtggtcaaaacttattttaaaaacgacccttttgttcaaacacctcagcgtcaaatagcatggcgctgaatgcaggttggcacgccgactcatactcccatccacgatggcacgacattcagcgccagttgacgtggcgctgagttgtctaagttcagcgtcatgagatttggcgttgaacaaaagggtaattttgaaataagttttggctacggttcatttgtataattattttttgcaaagggtcaaattgtcaaaatttgtgctactgcctagtagtttatatacttgtttgctttccatatagtattgtacggtgcctagtagtatatccaagaatgaacaatatcagcacttttatactactttgtaaatagtagtagcgatagatatagagaacttttaaagtatagctagaaaggtagcccgcacgaatgcatgggcatatgtcgtacgttaagtttaagatacttataaaagtgaaatattaaccggagaacacctcccatgatttctctataaattgttttcatggcattaattgcttttataagtttataacctattagctttatgttaatcatatttaagtaatatctataagcaattatttataatattcttcattatttgaaaagaaggtagacttattttcttcagaaaacatgtcagtaaaagtaagttggttttctttttttagttgcgtatatattatcatagtttactaaaggatgaattgggtgggacatgaagctccagtaaatatatgggtttatatagtctaaaatgattaatgtagtttgagagatgatccatctgaacattcatttcatatagagtgagtgagaggctccacgcaatctaacatgaatacgataacgacgaaatataattacgcagtaatatttttaaaatatgatgtaccatgaatacacacttgtttttttatatatataagatagatctaatggttagaaataatggtttcacggatttaaaaagcataggagtattccatatatgtagcttttggttgttttaattatgtagttggtgacttacgaacactccggagggcatttaattgattttgattgtgtacaatgatttagtataacacgatacatattttcaattaattttcgtgtttatttagtgttcatgcaaacggtagggtctaccttcaaatgatatattttaacttttatatagcaaaatatagctaatgaatgtttaattataaataaaataatagttatgactatttttatattatgttagttagaaaaatatagaagaggcgataattgcattggagaggagaggatgcgagaggcagagtgggaggagagtggcattacgaaagacaggatgatgggaggagattagatgtttttaaaatagatcgaatgtgcactataatttagagttatctatttttataaatacatttaatattagatctaatttaaatactttgggtgttgtattttctaattaaactacttaaattattctaattttagtgcattttgttaatcaaaaggtttaaaaatatatttgatataataataaggtctagtttgaatttaaataatatataaaaaaaggagggtggacaccggccttggaacacgaaggaggaggcgtacgtctgtttctacaaaagtgtataggacggtgatttagttttataggacggtgatttagttttatttttttaaaaaaatattattataaattgtgatttccatctaactaaaatagcatgaaaatcatgaaaataggagagagaatgaacagaggggaaggcgtacacagatggagttcacgtaaatggaaatgtacttaagcgggacgggaggggatcgatgctattttcttttttaaaaaaaatagatctaatgacgtataatattaggtccactatataactttaaatctaatagctaaaaatctaaatagtgggtccaccggttaattagaatgccacatgacggtttaggagtgtttttacgagtacacgtggtggtttaggagtatttgtaggaagatatggtgttttttatgtacggacatatgcatgttttctttttttttccaaataataatctcatgtacatgcatatatacatacatatattttctccggatgaatagtatagatttatttttctctctcacaaatacacatgagattagaagagagggattaattactttaatatgatttgatctaatctattctacacctgtacatgtgtaaatcaattgttgtatatttatacgtgactacatatacaagggaaagtgatgttacgtgtgggaggaaggaggtggaggtggaaagattttttttttagataaatctgacggcttgaaataatgggtccaccgattttaatgaaaacagatggacagatgttttgtttttttcttagaatttctaggaatttctattatttattagaatgtcatgtggcgacttatgagcgtttataggatgacatgtggcggtttgaaagcgtttttagggagtttaatggacttttagtatataatagatagatagatagatagatagaagatagatatactaacagtatatactacaagtataaccgatctaacggtatagattgatttgatatttcattgaattagattgtactataaaattttaaagggtaaattcgactttgcatgttatcccgtggacgtattttcttaccgctcgacaaaagaaaattgtcgttcggccctccccactccttcttcttcactacgggcgacgagcgaatccacgcgcgccgtgccaccactgccggcgaccgcaaccacaccgcgccgccgccaacgggaatcgattcgctctcctctcctcctcttcttgccttcccatccaccaaaaaacccaaggcatgcgctatctagaggaggagcagccacggcggacgcgacggcgctcaaggaggaagatcagcagcatgcatgcagagggtcgtgtactcaatggcagattttgtcttccaccccgcggcgacaacggcctcgtatgatcgtatctgattgctgattcgactctcgtatgactacggccaagtagcacaacgccacaaccaggctgggtacttaatgaggtttctccctctcgagacggaagaatttaagggcgtcatcgtttcgctttttttctaatacgccaaaacggcttattagggaataaaaatgaatttgtaaataaaatttttatatatgtgttcttggtgacttaaaagccaatgctgaaaaaaaaaactacgttgaaaatatctcaaaatcgttctcaaaattaagtttgaaaatttaaaatttggttttttttggtttatctaggccatccgatgggagcctaagtgaaaaggcatcatgaccggatggcggatgctcatgccggaacagttcagctatttgctcttttggcttgtgttcccaaaagtgaaaaaaaaacacacttgttttcttcatttgcttcaggactgcatatttgaagatacttctgaaccttctttttgatatgcatgatttctgaacttggtgaatgtgatacctaagaagcaaagatgataaactgaattttcagtacaataaaaccaaacaattccatggtactgaaagcagtactataaaatcttcagcacttcacaagcaaatactagcaatattacaagataagcacattcgaattgttataagtgtactgccttttcttgtaagggaagatatgaaaattgtgccatctttaattatattctaaacatccttcatgtgctcaactgcatgaacaattacacaagtttcaagagaacatatggaaacacatggagtaaggccgaatgacagccaagagaatgagtcgcactgctgcctagcgcaccaccgtcgctcgcgagcacaggaatgacgccggggacgaatcacaccgccgcctagcgtgccgtcgtctttcgcgagcgcacgaactgaatcttatttattggattggattaattctaaacgtagaaagctcttttccactttctgtcaaattcctaacatacccttctatataatgtaagtatatactcatagtataatatactgtaaaagttatatttctgtaagaagttaatcacacctatacgatcttaagaacaaaaaaggaggatttctggtgaatgccaaccaaatttcaatcaccccactgcacaaccgatcgaaatatttacatcacaatatttaaattaaaatattcacattatttcagttccaagagcaaatagattacatcagatttaacttacacccaggtgcaattcagcacatctaaccactggctaaattctggggtgagggtcatccatattagccctgcacccagaattaatttttgacactgaaatcagcctaccaattaacacctatataaatttatgtacaatgcccaatatttcctacctcaccccggtaggacaagaatttacagtccgtaatccgtaatgtatattcacaaaacaacacaaaccctattctgctcttcacaaggcaagcgccttgtaccattgtccatggaccttctctgatatgactgccatctttatcagcacctccccggccttgacaaccctgtcggcgagcttcgccgcgccgaggcgtcgcagcggcgcttcggctagcttcttgcccttggcgccgccaccgaggacgacgccgcggaaggcaaagtagaccgcccgggacaccttaccgaagacgatgtcgccggcctggaggctcttgagaagcatcttggttgctagctctgtcgtgtcctgaatctgttcctccggcagagagccgaccgaggccagagagcgcgtcatcgcctccacgatctccttcgttgatgcgtcagcgttgttgtcgaggagcttcacgagagcgtcgtagagctctgagatggtattctgtagctccggaggagcgatcttcaacatcagaacttgatgcaggacaagcatgctggaacagacagacatggtaaattgatttcagttatcgtagaaatcaattgttctgaatgaccggtttagttcaaagtattgggggttgggggggggatgatatttatttacctcgtcgcgatcactatcaccttctgaaactgatcttgcacagccctcaacctcagcagattaatttggaaggtctcaggggttgactgcatgttcaggccctccacattgctgataagttgcaacaagccaacccttgtcagcttgtcgatcttctcacccttgcattctgggagaccagaactgctagctgcagacgaagaagcctgcggcgctggagcaccgtgaccagctcgaagtaccggaacaacgtgctgagcctgtcaataagggataaattcgtgtcagtcagagaaaaacttagactgctgcctaagctaatacaactgtaaattgttttgatcgtagaaacctacatgatctgctggcaaagcttggagagactccaaatgtgagctccactcttgttccacgatgctcttcgttgccgaaacccactgcttagttatagggagagacactgatgcattagcaggaggtccatagcgatccgtgaaagccttctgcaggtattccactccggcagagcctttaataattggttgcatgagctggatgcgagccttgctaacttcagtttgcagttgctgttaatcacagaaaaatgttaggaaaacacggcgcaatgtaagtgcaatctatgtcaggactaattcaaggtgttaacaaggaacaaacctttatttcttcgagagtgaaacgcaggcccttgatgacagcaatgacaaaggagctgataccattgtcattaacttcggaacttgcagccaactcgtttaacaatttctcatgactcctcttcatgtcatcttcctttgcaggggcagatagtttcctgaccatatccagggagtactgcaaaatctgccccagatatcgcgtgtcctgggagcctgactgaagcacctttcatccataaaaaataacaacaacattaattcaaaatataccgggtttaacaaaagcaaattaatactaactattttattttgtcaagaccaccgagtccttacctgagacaaaatttcgaggtcaatgttctcaagaatttcctccttcaactcatttgaggccaactcatgtaacgaattcctgacttcctttacgaggttaattaattggctataatctggtttgtcccctctcatcgaatcagtaacaagatcccaaaaggctttctccatcgttgctttcactttggcctgaaagtccttctccgcggaactgacgttatcagagttgcgagcaaaagaaacatcgtcctcatgaagcatctcattgaccatttgctcattgtccgtcggcggtttcattggagatgtactgcttgacgatgaagcagctccaggcaaagattgggcagtgaaacttgatccttccacagtaggcttggaagtagggtttggaacctgtccagatgaattaatgctcaaaggagtagatacatttgcaacagatgttgctaatggatttccgttttccttcgcctcaaagaactttgaccttgtatccgaaagagcagagttcatccgctcgatgcctgcatcgccactcaggtgctgaatcttctctcttaacagcttctggtcatcagtaacctgtttctgaattgccttcatatcatgagaaaggtcatgtgactgcccatctgaacttaacttgcatgtttgcatcattgacagctcaagcttgcatgcagccctgacaagatcttgttccaatgatttggcatccttcagtttccacacaacaaagtggtaaaggtaagcgcaccatgctttatcaaaagcagccaactgagtcctgaactttttctgactggcagcatcagtcgattgcatcgaggcacctcctggtctatcaagtactgtcttaaccaatagctcaaactccttaacaaagttttctgctgactccataagtagattctccttctccccttgtccacttaatacagcacctggatgagccagtatcatataagagcagaggactacccgcagtgagtatctagaaagcttgcttgtctcggaacccttcgctggctttttcgcagctaccctagatctgctagcaggtgccttcctctttggagatccaaggcgtttcagaaggtgatcaatgttctcggctgatgatgaaccagttggctgagaaagaagcaaacgtttctcgaaccggtcaagcactgccttggtggtctggagagtcgttggagattccatcaacatagctaaattttcaaatggcatagatttgacagacatctcattaattcccaaggcgtcataagcttgaaccagtgcatatgttgtcttgttagatttcaaaaatcttttccagcatctgaagtacaacaaaatggaaaaaacattgccaattagttaaaactttcacatgtgcaaatgcaagaaaataatattccaaaaatcaactgtgtgacaccataccttgccagctttgttgaaagaaattctgcatgcttgatgtaatcagcatgggcagaactacggggacttacccgctgcttcaagtactcagctctctgcctttttgcctgttccattaagttaacttaactgtaagaaatagaatagaagggctaaaacaacaatatcagagtataatatgagagaacaaacataccttctgaagcttgctttctagctgttcttgcaactgtctcctctctgattctctcttgctgcatacagtcttggcagctcgttggatgtgcaaaatcctagcctgggctttcctcttctcagcttccagcaatgccagtcgcttcttttcagcagcattgcgcttttgtaagatcaaagacttgactcgctccgtgtatttcctctcagatgtctgtttccgcacaagggaccgcgccgttctctccttcattgccgcccgcttctgcatatgtgcatgcaaaagacgcatgcgatttgcctctgcttgacgaacacgagactcgactcgagtcccgagttcttccctttctttctcgatccgcatttccacgatgttcttcgccgcttgtcggagttcatccaacttggctagcctgttctgtgcctttgccaagaggctcaacctgcaagatacaaataattagtatcagactctcagagctcctctaattgcataagaccgcaaataactaatatcaggcactgttttttttcattaccttttctgctcggcggcctgaagcttcgcttcgaggcgctgaccttgatcttcctcttgtgatgaccatgatgggctccgcggcttcttcctcgctttgcaggacacccattcatggaattgctgcaaagtgcaaacaacatatgaccataagctatgttgatcaatcatttatcaataaatacagtaccaacatcttaataacaaatcaatcaaatatactagacccaaatacgagtcatacgatacggtcccaaaaagaagaagaaaaaaacttcaagtgaactgaacctaccaaatcacatcaaccaaaaaaagtttcacccctattacttactggtcaccaaattttcagtactacaagtgcgacgaaagttacttctaacttctaagcgaatccaagtgtggtcggtggtacacaaactattcataccaaactaccataatcttttcaccgacgggacaccatgtgctgaattgtttgctcatgaccctttttctacaacaaatattatcttcctaatttgaatataaaaaaaagaaattattttacaggcaacctgtcgtaactcgatgcagacaactaaatatgttactgatatccactgattactctttagcaaaccgcaggtagaaaccaaaagataattatatactgcattaaattattagtgcagtgtatatccaacaaacagataaaaacgggaccttttatatggggaaagtacgctttaatccagagccgcaaaatcatgcggctgagagaaaatcgaatggaaaagaaatcgaattcgaggcacacgtgaacccaacttcatctcacgactacctaccaagaacagaatcccccaaagaatgttacttcaactccccaccaggaatcccaaccaccaaaaacaaaaaagaacctcactgcacagaaatccttccacgtaatcccaactttgcgtctccactaatcagccaaaataagtttccaattaaagtagaacataagtgattaagaaagaactggtcgtgagtacccccccccccaaaaaaaaaaaaactgaaaattaaggactaatcctagtctaaaaatagcagcgaaattcatcaaaaccaccactctgaactgttcatcagcatgtaaagggcactatggtttaatcagtagtaaaacatttcttacgaaactcgaaaccgaaacaaagcaactcaaattaaatcaaaaggctccaaaagcttcgaattcacagttcactctcgtccccccacaatccaccgcgaaggacgaaatgaaagaaaagaaaaacaaaaacaaaaaaagcgacggaaagggaacccggacagggacacctacctgcctccggagctccgcctccttcagcttcgcctcgatctcctccgcgctcgtcggcgccccgcctccgacgcggctcccctccagcaaccgccgcctgatcctcggcggcatcctccccgccgccgacgactccaccgccggtatctccatcgccaccggctcccgcaccaccatcctcctcctcctcctcccccgatcaaaccaccaaaccaacccggcggaatcaaactctactacgggcgaatcccgcaaagcagactcgccttccttcctcgcgctgctttactcttcctctcttctcctcgacttcttcttggtttttcttttttttttttcctctctcgagaagaagttagtttgttctgttacgctttcccgccgttcgcgtgaggcgtcaatatataacggcgggtggagggagtattgggaagcggtttgcgaatctcgaggcggatcggacggcaaggcggggatggaggggtgtttcggtaatttgagtagggggtgtgtcactgacggcgttaggccttagggcgggggtgggggggttcgagacggttcggggcggtggggccccgcgcggttttctcgtttgtggatcgggttttggattggacggaattgcccctgtagtgtaggcggcttcgctttggtgtccgaatccggttttgcaaaggttaggctgcttttgcctgtggccaatgagttgatcactttgttatcctcgtggtggataataatggaggtctacgaggctatggaaaaaaacgtgcatagagaagatgtttttttttattttttctatgtgactaatatagaggtctggctaacacgtatgcgccaccgtggcatatacagagcgggttagacagcattttgatctccatgacactcattagacaaagtttggagacttgcatattacattttaagaatttagcgatctagatgacacacttatacaagtttagatataggcacctgtgtactttgctcattttctaattgtaatttaatcttgatttgaattttgatatttgagaaaaatttacgtgcatctttacttttttcctattaatcataggaaaatactagtaaaaaataatggaacaaagttaggaaaatactagtaaaaaataatggaacaaagttattgatgaaggattatttttacacttaaaatcaaatttaaaatttgagaattagctacataatacacttgtcagttgtggctgactcactgttggcccgacgttgcttcgactttgaccattgataatttttttaaatggttaaattgtgttagataaaagtgcaatggataaaggcggtatatatcggtttgatatagcgaccgataaaaaataccctcctctaaaaaaaagtgcaatggatagtacttcgtactccaacatttgccttgcagtgcatctgcctgagctgctgctgggacgggcacgtcagcgaggctcacgcctggcgtcggaaaccggaagcggataacgtccacgtgtgcctcctccacgtagcctgctggtcagtgacacgtggggccagatctacgatggccccacgggtcagtgaggaggtgcggtatattctcaggtgattgcgtttgctgctgctgctagttggggacacgcgtttccccactatgcaggaggggccaggggaaacgtggcacgaggagaacgcttactttctctcgtctaattacgcaactgccctcacgatcatttctggatttctggccagcttccctcactctgcacgtgtcacttcttttgtctttaggtggtgtttggttggagggactaaggccctgtttagatgagactaaaacttttaagtccttatcacatcaaatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggaagtaaacaccacctaaagtggagctaaactttagtccctctcacaaaaatataagtccctaccatagggacttataattctgtgagagagactaaatttagtctctagttcccaaacacccccttaaaatagcaaaatttgctacaggacacataaaaaaaatatgtaattagctgagagacacagcaaaaacgtgacactgcctatctaattggcctaggacaccagacgtattattttatcatttttaggatgaaagaggggagagaaatttctaaatgactggaatgccccctttactcctccttcctttcttctcgctgcagccgacatgtgggcctgcgcacagtgtcatcgtcctcctctcgccaacgctcaacgccggccgtgtccccgccctcgatgccgccgtcgccttcgcctgtcgacgcgcctacacccagaccacctcccccctcgccccacccgcaccttccctcctccgcgacaccctcacccacacccgcgcttaccccaccggattccgcagcggggacatcaagcgatgtccagatcgtccaattcagcggcaatatcaaattctgacggcgcatcgcccccctcgtcatgtccaagaaatccatcaggctcggcagcaagaggcaacccgtcttcccctatctcgttgtcggagaggcggggctgcagga

SEQ ID NO: 74698 - DNA, 22141 bp, Oryza sativa
ttttttttaaaaaaaaagaaacataaaattgtacgcatgaaacataggcaagctggcaaacggtgttctgtacacgtttaatgttgatactctaataatgaagtatttctgttcacccgtagtaaggttagaatgaagagtctcccttggaggaaatttttatataaaattacaggaatagagaaaacacacataactccgtcccaaaatataacaacttttagcctcagaatttatcccaaaatataataacttcttcaccacattatcttcccaaccaatcacaaccctccaccattcactttttctatatacctccactactcatccaatcacaaccctccaccattcacttctacctactttattaataaccgtatcaaactctaaaacttattatattatgggacggagggagtagaattttaaagtttgattttctaagaatgaagtagggagtttaattgtcctctcataatcatgaaaaaaaagaaatagacaaggaagtaacacagaaaaccccaaagggcctattcattttggaggaatttcaacgcataggaataggaaaaataaacgaataggattgcatacacgctttaatccataggaatttttccatgaggtttgtgtggatgaaaaattccctttgttttctgtataggaaaggaaaacttcctttggttttcctatatttacattcctatgaccccaatgacattcatatgaattagtatttaggaatctaaatgctttgaaattcctccaaaacgaataggcctaaaattaattatcaaaccaaatgcacccagaacataccgttcaagacgccctgagtgtaggtgcactgccggtagggcccaacctcgtggtgtccaaccaccagcggcttctgatcctcggggatcttctgcagagacgacggcctcctcggcggcaggaggtactgcgagctcttccggccatcttcgtgctgctgttgccggcggtcaccttcgtcgtcggccgccgccgtcgtcggcagcagtggcttgatgagcccggagatgatctccggcggctttccccggaacgaggcggtcaggaatgagtttgatagacggctcagcgtcggagtgcccaggaagctcaggttcggggattgcacgctactgtacatgtcaatcgactgcctgttgatgcatagaaagaaaaaaacatgatcaaattcttgtgattcaacgttgcttattaattctgagattgagctatgatggaaactgcatttgaacatttagtgaagaaattatgcgtgcttgttctggttcatataaacggaaccagagtttggaatttcggtttggaatttcggatctacttctgtttaattcttggtaggaatttactctggtctaaattttttgattttgtttcactgcaacgaaatttgcgcatacacagcaaaaactaatttcactgaaaattccattttgatatttctgaaaattttcggaaatttcagtcgccgtgtttcgttttcttaatttctttccaaaatgtaaaatactatatattcagaacagataaaaaattggcaaaggcgccgataatattgatctgaaattctgaatattcagattgcacaacgccccactgattctctctccttctctcagacaaaattattttggaagaacagatggggaccaactgaagctgccaagtcagcaccagggaccacaggaacagtgacacgtagcaccaattccagtactagccgtgacacgtcactatcgtgggcccacatgtcaatggcttctgcaatccacctataggttcaccaacacgtgtcctcacaccccgatgccatcccaaatggctactgcatatcctgaatattctggccatcataggcctatcaggatcagaaggcatctgaaatataatcaactaaaattttcgaagaatatgtcatgtggtatgtctatgccaaataaaaatgtataaatcattgttcttagtttcaaactgttcttgcagagactcttttagtgtgtttggataatgggataagaatagtgggattggaatagggaaatggataaagggctatgataaaacgagggagggataatggatggctaggattagaagaaactctttgtttccccaacccattagccaaacaggcctttgtgtgctagtaaaaagaagttagaatctaaatttgtattttgcttttctacctaccagatgttcattatccaagaaacgtaccaaatgagttgttgagaaacaacagaaaaactgccatactttctttttttttttgaaaaaagtgttgcattgcaaaattcacagttaaaaaaagtaagactagtggtgattaattagtacgggatggcaaactgaactctccagaaaagaatggaaaagactgaaattattcgactgtaaacagaaaagtttggacttttattgacgcgtggcactgcgaaagaaaagaaaaaaatataaagaagaaatgaacttgcgtcggcgaacctgtagctctgaggccactgctgcgtataggagctgggctggctgccgcggccgccaccgccaccgccggcggcggcgacccgcggggtaccgcacgaagacgacgagtccgacccgtcgtccgactcatcgccgccgtggccgcgacgcttcccatcctcgacggcggcggcggcgtcgtcctcctcgtcgctgtcgatgaggaagctccggtccgacaccgaattgtccatctctcgcagtagacctcgtgctgaatgcaaatgcaaatgcagcaacgatggatcggggggagagagagggagagagagacactctgtgtgtgtgtgtgtgtgtgatgaggacgggtttatattgcggcggtgtgggcgctagccgcttagcaagcggccgggatgcattcagtggcggcgacagcggtcgaacgtactagaggtgaaacgaaacaaacaataagatgagcatgtggtgtttattaaccgaggccattatccttagtagcaatgatgtcgaattaacctattactctccctctgtcccaaaataagtgcagctatgagtttccgtatctaactttaatcgttcgtcttatttaaatttttttaaaaaaactaaaaaaaatatgtcacgagtaaagtactattcatcttttatcatctcataacaataaaaatactactcataaaaaatttcaaataagacgaacgatgaaagttggacgcgaaaacttatggctgtacttattttgggacggagatagtaccaaatagaagacacgatactatggatttggatagtagacacgtctactccctccgtcccaaaaaaaaggcaaaccctgggtttgcgtgtccaactttgactgtccgttttatatgaaatttttttataattcgtatttttattgttgttagatgataaaacatgattaatactttgtgcgtgacttgtctttttaatttttttcataattttttcaaataagacgaacggtcaaacattgcgcacggaaaccagggtttgtctttttttgggacggagggagtagattgatatgtcctcaccacaataatttgtagttttcttgatgaccacatgatatcattggcagtcaaaaatagtcatcaagtttagtcattgtcttagcggttaaaagtttgttactctcttcgtcccattttaaatacattcatcagtttccgtgtctgattttgatcgtccgtcatttttttatgattagtatttttttctttttagatgataaaactttatgagtgatttatgtttttattttttttttcaaataagacgaatgattaaggttggatatggaaactcatgactacacttaaaatgtgacggagggaatatattttaagatggatgtactatttatcatcgctgatctgcacttggataactaacaatctagaattattagattaattatgatgaatgaaagcctactacttgtgttaatatttagtatgtaatacgctttaataatatgacatgtatttcaatattttgtaaaattttgaagagaaatataaatggttaaagtacaaatataaatagcgctagttgaagaagcatccacgtgagtagtgtcctaatgatattccgttggagtagcatggaagggtgagggtgagtagcatggaagggtgagggttgcttataatttgagtctcatgatgcccatcctttatactcaagtttcatgaatttttaagataaaaaaagtttcatgaattactttgatttttctctatttcccactaaaaatcatgaattctgctactcgatcccttcattttaaattacatgtcggcctaattctagagttcattttttttctaactaaaatacttttcattttcatattccaattaaacactttaaatgtgaatttccttttatatcctttattaatgcagtcacacgtcaatgtagtcacagctctaatggacttatttcaactaataaaagttaacgactactgcagaaaattcaattgcgtaatctacttaaggaatgggtaacaatgtaatttgtcatattttttttgtggaatttgctagaacaataagtaattttaaatcaaaggggtaaataaaataaaatcccttgccaatgtgtagttttactggtgtacatggtctcctcacaaagtccttgcccctatttcacgcgagccaacattattctgtcgatttagatttcgctggtgctatatatatattttgtagaattagtcaattcgaagtaatttataatgtattttttttctctctctctctcatgtggagcaaaccaagggcatgtgactttgtaacatgtgtggtctgccaccggccggttgcaatgggtgttgtttggttgcaaacttgcaagtgcaatacgcccgagattgcaatagctacttgttcttggcctcatttgggtggcttacgttgcgttcatttttcgaatgagatgattgcaatatgcatggattctccagctcttgtgcattggctttaacttgccctttgcagttgattagggccgcaaaatacaggagtgtgcgcccctgtgaatgtgaggttttgaggtgttgggctgtcccggttgcaataggtatttacgtttctttttctcatcgagagtaatcagaaacaccacggtcatactcacactgcacaacaccacacatctacatatgtggacgccctcggcatttagtgcaattgcaaaatattaaggaataattgctcttttgccactgctgggcgtcctatttggcaatatgccactgaaaaagagctaattgctccaatgccactagaacgagaaaaaaatcatttgagatgccactgccgttttgttccgtcgatggccgttaactgctcggtaaaaaaatagggccaactgttccaaaaaaaatattaagcatttactatatggggttaaaagttctattgaccattcaaatacttcatccgtcccattttaagtgtaaccataagttttcgcgcccaattttgatcgtccgtcttatttgaaaattttttataattagtatttttgttgttatgtgatgataaaacatgaatagtgctttactcgtgacttatgtttttaatttttttttcaaataagatgttggtcaaagttaggcgcagaaaaccattgctgcacttaaaatgggacggagggagtagttaaatttcctctcatttctacttcatccgtcctaaaatgtaagaaagtaggtgagactgattggaggaagtttccttcgtcccaaaatataagaaattaggtgagaatgataggaggaaatgtgtgattggttgaaaagaaaaagtaggtggaggagaatggttgtgattggtcgagatgaggaggtaggtggataaatagtttcattttgggacaaggtattgtgctagaaatagctacattttgagacagagtaatatgaaccctagatcgatccattcatgggcgtcgacggcggtttctgatgagtagggagttgtagctgcgtcctagagaacaagggcagaatggtaattaccccagtcaaacgtgttgactaacagaattatttgatcctaacgacagagtgccattttggcgtgcccaactgtgaaaccagtggcattctaccaattgaccaaaaaccagtggcagaatgacaaatacggtaaaccctagtggcatttgtgtaattggccctattattaaaggtatagaaaacttggaaagtcgactcatgatacccacaccaagggtcggttcactacaaccgctctttgatagtttcctgtctatttatatatattttaaaaaaaaacacagtacaaacgtgatgttgtttatatgccagaggaaacccaccgtctcttgtccgagtgcgtcaaatttgtacaatttctttcaagcaacatgtttaaaagatatggatccatattatttacttttgtgcatgtctgagttggttagctctgcggctgtactactcatctactcgtatctcctgcggtaatccaagatacagtgcatcttatttttctttttgctgatagatatttaatttcttttttcattgtaacaatggggtctcgcaaaaaaaatgtcgaaatacctaattggtgctgcctcgcaaaaaaaaaagtcaaagttaattacataaaaccactcaggatcgaacaaatgcatatcccgctgaattttaattttttaaaatgatttttcttctgatattattttccataattttggggattttatttttttcaacccccatttctcttctttcttcttgtttatccccaattcgaaaatcctacgcgcgcgggtcttttggacgagcaggccttcggaactacatcctctagagtatctgcacggggtagggaagcgtgtttctttgcacgactactctttgtttcgacaaatttgactacttcatctactttgtgttcatgttcgagatgtcgacgaaatagaatggcaacacagacactggcaatgctaatgccaacaccaaccactagtgcacctggatcaaatgtttctggtttattctctgggtatcactactacagaaacacaaaaaggatacggcactataggtgctagaatagctaaaccagcacctatagtgctttttacctctaacgcacgcccacagagcgccatcggctagaaccgacatctttgtgaagaaataggtgtcgtttctagagaaaaaccaaaacaaatactacatgtgctgatttatcaagaaaaaccaacacctataatttattaatctacatgtgctgagttaaataggtgctatttaattaaaaaacagacacccgtaataaccaagctgagccgagccggctaatcgcgagcggatatggagagggaagggcagagtgggtgtccttatccactctagtcacctccgccatctctctctctccactcatcacctggccacgagggcaccgcgaccagcgtcgatctgcccagaggcggtacgagccactgaggccaccgcgcacgaggtgctactatgggtggcgcccacagaggaggcggagcggcgccgacaatttggatctggcgtagatcacggatgggcgttagcggcttcccacggccgatccgacagcgaccacgtcggcggcggctttcccacggccgcggtggtggatgttcttgatgtgttcaatattgtattgttcttcaatgttgttgacgtgttcatgtgtttttggatgttgttgatgttcttggatgccaattattaatattgatggaatctgatcgagctgaagggatctgctcgtcaagccgctttttttattattatttttttgcatttctagaaactaaaggtgtcagtttaggaaccaacacctttgagtcctcctcaaaggtgccgcctactaggtgccggttagaaaattcggcacctatggacggttcccaaccggcacctattccattttctgtagtagtgctcactctagtgttgaacatgttacttgatgctataatctctgctggtaaggttgtgattaacaatagcttactcttttccatagttttcatatttattctcacgttattctcgattaaattatgccgaaatatagatcttcaatatactcgagtacggtcagtgtctcactatatctatcatatgcgaagtgagcatagctcaactggttaggttccttgtggtggaactagccaacccgggttcaaatcctagatttgccacggtactcgcatttacggctaattattcttttagtggtaggtgatgtaaccgttaacagcatggcacccatggtggcttcgtcattctcaagatatgccagcaagtcttccggaagtgctcaaaggggtagggtgtgcgtatgtgcgtccataggagttagtgtgcgtgcgttgtgagtgcttgcgtttgtactatgtttctaaaaaatatatatatatactttatagaatttgagaaacttcatccttttctttaccacttactagaacacaaaataaatagcaacctgtcggcgggcgtaaatggcaccttctgtcaacaagatttaatgcatcatgtgctgactcagatgattaatcatcctttaattagatagtactaatgtactgagattcctccgtttagcatgcatcttgttgaaatatagataccacccacgatgatgaatgtattcttttaattttatacaagaagtcatatggccatatttaaaacactgccagttatcaatgtgattataataaaaagctacaaagttaatacatgcatagatctacaaagctacaaagttaatactccctacgttctatattataacacgttttggcttgtttatctcttataatataatttccaatatacatatgaatttggacacatatatataaagcaaatacatgaattcgatcaaaacacataacgtctatagtgtgtaatgtgaaacgcagggtacaccgaaaggatcttgaatttgcctagaggggagggtaaataggcgttcctaaaaaattatcacaacttcatagcgtactagagagatgagaactttcggttcaaatcggaacttctggtatgggattggaagttctggtcttaacataaaagttcggcggataatggaataaaatactagctatgaacttgtagctcgaataaacaaaatgtatatgaatcaaaaggtggcaaataaggtatctaagcaagatataaggtcaccaactatattaattaagcatgcaagtagatcgggtaaaaacaagctcaagcacaatatgagagatggcaagaacgagcaaaccaagagaggagacacgttgatttgtttcccgaagttcggatccacggatcctacgtctccgtgataggttaaagcttgtcatatttcactcaaatgataggttaaagctttggtttgtctcaaggtagcactacgataggtcacttttagcaccgagacatacacaaacacatcaacgttgcatccctcttaatagtacggcattcctaaactcaaatgtaaatacgaagagaattataccaataggaatgctttctttccatctttctttccttatcttaagggatgccaatgccgaaaccgtttcaccatatattcttcaaattattgatgcggttacttctagtttcaaatggccttgcacggtccatcatgacaaagccgtcgctcgcccttcaccgctggatttggttcttcggcgccaagctccctgcttgcccttcaccgccacatggtccatcactaccgagcatctcttgcccttcaccatcttgccatagtagccactttgtatcccacatcttcaatatccccacttggtattttaggtgtaatcatatcacttgagtgtcaacaccttttcaatccttggaacctatttttctcattcaactcaatgaaatcattagtctcaaatatccggttgtcaacctctacatgttgaccaaccgatcacatgtataaaaggatataaataaatgaggagtattaaattaacaccacaagtgtcatatactcaaatatatgctcaaatgtaaagatcccaattaaatgaaagtgaatagcatggatcgattacatgcataactaaagtatagatttgctccccctaaatgtatgcatacaaaatgtttgtgtgaagcaagagtatgcataaaaagaatgaaacactaggagcctatcctatacaagaatataagtcatttatcaaatataggcattaaaataaatgtataccttaatcatcttcatgttctcaatgtaaagagactaaacaagagaaaaaggctcaaacaaaacattagtctcacatatatatcattattcacatggaaatattatatatgaacatatcaatatgtacatggagagaaagattgatacatgtagcttgatctccatgcttttcatccttgtgatttaggtccaccatcaatgaacatttctatctcaactcatagaagtccgggaatcacctttcacacactccactttcatatccacatgagactaggcgaagaaatgcttataaaaaaattagtctcacataattggatttatcattaatcaccaaaaccaaattaatggcacatgaactttcgtacacaaatacattggtagttgtcctttgcataatatctctattcagagaaaataacgacatgctgtcagtagttaaaccggacaatatatactctactggagaagtgatctttgctaggtcatgcaaaaattacattagacccggttcgaatagaaaccgggactaaagaataggtttagtcccggttcaaaagcccagcggcactttttgatctttagtcccagttggcaagtcccggttcaatagccacaggtcatgtcaagccctcgaacaaacattagtcccggttggtaataccaaccggggctaaatatcactcttccaagcatctcacgcgctctctctcttccttgtctccttggcatccgcacaagcttttcactccttgtcttcctatcttatcccctctcctcctccactccttctcctcctcctccactcctccgatccactcctcctcttcccctctcccggcaacaggccactcctcttcccctctcccggcaacaggcggtggccttggagggccatagcaggcggcggccgggcggagggcagctaggcggtggcaacggcccggaggggtcatcggtggcgcttatgagcgggctgacgcggcgccggagacgacgatgcgaggacttgtgttgtttttctgatgccattgtatatgtgtggtgctattgtggatgattaattttgttgagtatgtgaatttgtgatgctaatgatttgtgaatttgtgttgtcattttgatctgtgatgtttatttgatttgtgaatttgtgatgtttgtgagtttggcatgaaatcaatatgcaaacagcaaaaaaaaaagagacctttagtccaccaaccgggactaaagatgagcatctttagtcctggattgggcatcccggttgcatacccgggattaaaggggttgcaaataggaagtattgtgggtttctccagtagttatataattgaacaagtgaactgtgatagcgcataagtaatttaggagttggtgtgaaatgattatcaacatggaagtgataaaaaaaatttaaacatggaaaatatatgctatgtcatcgagttggcatgtatgcctctaagattttaccatggattttgtatctttttcttcaatgcatatgattttgcagattttacttcgaaatataaggcactattaatcattggttctaaggccgagggctacactagcatgagataggtcatctcaatcgggcggaaaccatcatctgcgtcgggaagggctcccgtcacaaaccaaaagtcacagatgtgagaagtcatctgtatcgggcatttagtcgtcacagatgacagttatctcaaacgggccaaaaatggtgcccgtcacggataggtttgacccagcagatgagtcaaaccaggaccaaactagggcccatcactgatgagatcatctatgacgggctcatacttcaatcacgggattggtatgattcccatcacagatgactcactcaatcgggcttgtttttaaccccgtcacggatgactcatctatattgggttttaatttaggctcgtcacggatgatatcatctctatcggtcttttatttaagtccatcacggatgagtattttacaaaaaaaaattattttttggctagcctcaggcctttgctagccatgcccgctgaaaatgacagaagaagctatatatattccttttcccaacaaccccgttcgcacatccattcacaaatcaaacattcagtgatcacatcgacattcacacacccattcacatatatatgtctgagacatatattcaatgatcacacatccacattcacatatccattcacatatgtcattcacatccattcagcgacatgcatattcaagagtcaagcatcaaaaacctgcaaaaccgagttataaattggaacaaatttataagtgattagcattgcaagtatatatagaaacgtcagaccgcattgtattacataatatatatatatatatatatatatataaatgtttaaccattgtaaaatcacatgtatttgatcgagagcgttcaacccgtcttttgtctttccaggaatatttagcagtaaccattataaaatgaatggccaaggattgatgctgaatgtagcaccctcccgtagctctagaggatcccgctactcctgaatccccttggtgtgccttaactgacaagtggccctatgagtcgataagaaataaggaagttactggagtatttgccatcttttaaaataaaatgtgtatacgcttctagttttgaacatttttactgctcaagaaaagaatcaattatgtttgagccactcatttgtactagctcggccagtgacaaaacaaaattcaaatggcaaaacgaaatatatatcaaaatcgagagtagaaaaaaaaacccatctctgttttcgtgtgctcagtggatgttcatgttgttgtatggttaacaccatgtgccaatatgcacacgctgatcggcaactatttcttgtatgaaaatgacacagcaagagcgtctctctcgttttatggcaatgttggcttcatgtttcaataattgaggtgattgcgatagatgcaagctagattcttctattcttgtgtgcctcatctgctattcccggtggatagggccgcctgctatgcacactctgatgaatgcggggttgaggaattgatgatgacagctcaagggactgtggaggattccagttgcaataggtgtaaagttagatggcttttgagtaatagtgaagaaattgggccaaatgatttggttcgagaatttatctgggcatgtattgcgttcagcattatattgagctaggatgacttcatattcaactgcagcttgatttggaaaaaagatcctacccaaatacctataaatctcacaacaatttaactaaatgaggatatcgtaatcacaaatggatggcatcacttttttctaaaagcaaacattttgaaatgtgattttaagattaattttagtcaagttatttagtcgtcatctttgcaaccatgaaaaataaaagtggcaaataaccccccccccttccaaaaaaaaaataattctaaaaccaaattctataattcaaaatgagatgtggctttttaggggaaaacaatgccaagtgggattgtttaattagtgttattaatcaggagaaaaacatgtgtagtttatcttaagaactagaagcacaccgtgatttagaactatctagagttaaaaattctcttgaaatacttgttcttcaacctacaccatgatttgctcttataaaataaatttcataaactcctagatattgggtcgtccgtaacataaaaccccaattgttgtgttttattttaagtaacctcatattttggggaaaattgtttcaagaaacatatttgtgtaaactactcatattttaatataatttattattagttttaaaaaattcacatttgttgactcaaagtacatatacctctactttatatttttttctcaattttgcactgcacaattttagtgcagtgcacatcttaagtttttgtgcagtgcaaaattcttttggcaaagtttcgtttggcatgtgtaccagcagccttgggagagtcaggttctcaggttgcagagaatggaagtaaagcatagtgttagttatctgtggaaaataccctggcttcttctggacagttgtttaagaacttgattacatctgttagtgaacttggcttacgtccggttggatgtagaggtcggatttatccccttttgttaaaaaaaaaatatgtcggtgaacttacgatcagacgcacattcctgaggtccattggaatcctgatctcaaattacatggtggactcgccacctggcacagtgtaacatgtgcctggaagggttccaaaatgccgaagataactactatctccatctcataatataagggattttggaggaatatgacacatcataatagtacgaatctagacttgtcacattcctttaatatcccttatattatgggacagagtgagtatttggttattgtggttattggccttgttgagtcgtatccacatttattttttttgaaagtaaagagagatttcattaatgagaaaacagagggttacattcctggttcaagagatcaagaatttctgcaggggaacacaatctccagaccgtattagttcctgatcccattaccagttgggctaaagcataagctatcttattagaatctctctttatcctgtgcacttgcacctgagctaaacataacattgccgctttaacatctgaaattatgccactccaatctgctcttgagacattggtcgcgtttaactcagcgacaacacttgtattatctgattctaagataagtggcatattcacccattcagtagcaagccggataccttccagacacaccaaggcttcagcttgcattgctgagctgcaccgtggtagtttcttacaggaagccagtagcacgaggcctcgacaatccctgattattatcccagcgcctgcttcacctgtgtcctatttgaaacctgcatcaacattcaacttggctacacctttggtggagtttgccacttgcttttcgttcagctgttgttgtatgtatgtctcaacaaacattggtccttttcctttcacatcatcaggttgttgccgagtcattagagtgcaatcttcgtagttcttcaaaaagtcgtatccacatttagaagcgcttgaacaaacaagtcaagttgaaaaaagagtaaaaaaaagtttagaaaaattttgttcaactggtttccgatggcaaccgctcggttcaaactgaacttatcatatttactttgcaatctatcaaaacattgttaggatatgttttgccatcgatccagaacaaccctcatacactataactactgtctcagtaacacgtttattacattccaaacacacaaaaaagaagtctcctactacgtttgtcatcttctattttctcttctcatttccaaaatatggattaaaagatattcattgtattattcgatgaattattttagaagctataattctactaggaaatattagttgaatgtatagctataattcctttttttattacataacagatatagataaatatctagctcaaagagatggaccagttgtgtatcccactcaattatagctacacatgggagatctaaaagttgctacagtacaatgccaaattaataactatttgccttctgaatatagctaaagctattcaccaaatgcttattgttttgacgcatatgaaaacttatttgaccatgcaagagatactatggaagtgagctgatgaaggaacagggatcaggaggactggggattgcaactgcaccatcaagcatttgtgtcacctttagcatgttaggtcgcatgcttgggtcctcctgaaggcaccacaatgccactgtcacaaatctttccaccttcttaatattgtagatcgcctcatcatcgccctctaccagcaaatcaatcctcccagaccggtagcagtcattggcccagtaagtcactatcgtctgttcctcatcgacaacctctagctcgacattcctcctacagcaaacaagctctagtagtatcactccgaagctataaacatcaaccttggtagagatcccaatgttcttgaaccactcaggtgcaacataacctcgagtaccccgaataccggtgtttgtccttgtttggtttgtcaaaagaagctttgctaggccaaagtctgaaatcttggccacaaggttgtcatcaagaaggatattctgcggctttatgtcacaatggatgatttgcttgctacattcgtcatgtaagtagagcaaacctcttgccaccccaagcgcgatatgaactcgggtgttccaatgtgggcgactattgtcgaacaaaagacggttgagagggccattggtcatgaactcataaactagcagtctttcggctccttcattacagaaaccaagcaatctaaccaaattcttgtggaatgtctgcccaatggtctcgacttctaccatgaactccttctcggtttctggttggagcttgtcaatctttttcactgcaatgttggtcttgagttcatcctccaactggcccttgtacacaacaccagaggcaccggcacctagaatctcatggaagccagccgttgccttctccagctctttgtaagtgaaggtcttcaagggtagttgggatttacttgatgcttgtgacaatgggatattcttttttgtggctattctacagtaagtaccaaaaaggaaaatggagatgagtgcaaagttcaccaatatggaggttccaagaatcaaagaactccctaggacccagtgcttcctgttcctcttccatttgttggagcttgtactgatcatggattgcgaactattgctacttggcaccttgagaagaacggtcctctggacatagtcagccatattcccatttgacaaagggagcttcttcttccagcaagtgctggtgctctgattgtacaccgccatggcgcagaagcagtcgatcacacacagccttccacaatcatcttgtcctatgggctcatatttctcatagtcagacagtggccaatccacaccataaattggtctcagctcaaactgagcaagtgccgttgcctcatccaagtcgcagctatgcggttgaaagtcttgcttacaccctttgtacttcttctgctcatcgaagaacttgtaccatggtgggcattggcagcttgcaatctgattcctggtgccatcaaaggtgcagtaactgttgaacccacagacgccactgccaacatctgaaactatggcatggcagatattctggggctgcatgctcactgctgtccatgtctcaccacctaggatgcctgcattcgctttcttcgggtacacatattgccggaaaacaccgtcagggtccagtgtggcgcgatggaagtagtctgccattgatccaattcctgcacctgatgagatgttgatctgtgtaccatctgtcagtgcaaagtataccttcccagtctcactgaataccaactctgagccatttccagtcgtgtcagtggaccaatattgctggtatttggatccagagggaacagcaacaagatacagggcaaggtttccatcagtttgcacatcaaggagaaaccgaccactggagtagtcattgatgtcgagtcgggcacggagtgacttgttgcgagtcttgttgcaaggtatcacctgagtaggcaagatggtgtctgacggcatgtcaaaggtctgccactttgtcgtgccgtctgcaccaaggagcacaaaattgccggtgtcgcgcatgctagcatatgccacactggtaacctggggattccagccctcctgaccagaccggtctttcagtgagagtgcaccatcattagtgagttggagaaaagaatcagatggcacttctactatcgatggatcttggtcagtatttttggcataccagacaactgtcttatcgctaatcttgttgaaccagacggcgatgaggtagaaggaggtgttgccctctacaggtcggaagccaaatgcgaagtcgccagagggtgatagccatgaagaggcaggactctggggtgccaaagtggagcccaatgtgatgttcttctgagtttgtgcacaagttggggacagtagctgcaacagcatgggaaagagtagcagagcaaccattgttctttgcttcaggctcttgcttcctacccctgataacagctggtgagctgccaaacttgtgtagttatagagctatcctaacacttgtcatggaaaggtcttcgtcaccatggaattctacatatacttgactaatcaagcacttactggaatttgccacgcagaaagcagcaatagggaattcgtgtcacgatagcagtaaatccgtagaaattcttgtccagacaaaaacaacaggtaacagctagtgagaccaaatagaccaaggcatcaagctagtcaattctggccattagtagcaccacggggaggatttgctgtcgtcgacattcttgctgaagtagacaggcttgacaggtgttaactagctatagattgccgagaaaatgtttttctaccctacacttcagggcagaagaaatgtttgcatacattgaactcctctaaaaaaaaatgaagcagaaaaaatgtgtgacatgtgtctctgaatcttttgccaattgcataatgactatcagtatcaggtctgagtaacaaatgtttgtactaaaacagcttagtatgcgataaatttcaggcatgcttttgcatagattatgtcaaatacagtgtaaagagtaatattttggtccgattttataagttcggaagttccctaggtcacttcaattctacatgatgaacaataagtagctgtatttggactcactagtcctgggatatttctatcatataacgaacttgaactgaatcacagtttactgaactgaactgaaaacagtaacgaatcgaagtgtcaaactattgggctctacaagcaattcatcaaacaaatcgtatgcattctcgacctaacgactccactgttggcatccaattcactgagtaaattaacaggagggaatcaggaatcaccactgaaccagtactctttgcagaccagttggcagttgccggcttgctgccgctgcgagttgaagcccctcgcccgtggcctccctccccttgccgtcgccgcggccggcggctccgttccggcggatcggcgcgcgccgccggcgatgccatgcatgctacaggctacggccgctcggctagggttggtctctcgctctcgctctccctctccctctccgagacgccgtgcctgccgcctgccgccgacttgacgagtctgaccatcggcgttgggctgcctgagcgagtgagcgggttgaggattagctaggcagttaacagctcattcgcccttcgctctctagctcactaattaccagtttaccacatctttagttagatattctctccgacccataatataagatattttaggtgtatttaatgggaataccctggatcggtccctcggaggagggagaaatatcgggcgctccctccccaccccctcccccgacgcgcgctgcctgcccctgggcccaccacatctctgccctcacctgccacttatctccatcatatactccattgcaacaaattacccacatattttggaaatattctattaaggaaatttagtttatttttgttccaccgataatgtttcatccagtgcactcacaatgtttcactatgtatatatctaatgttgcagtgaactgaaatactctattgcaacaaatcacccacatattttggaaaccctctattaagggaattcgttttattttttgttcgactaaaaatgtttcacctagtgtactcacaatgtttcactatgtatagatctaatgttgtagtaaactaaaacattctttcgctatttgttgaaacattgtttttatataaggtgaaacaacacccgatttaaacgggtgaaacattttcgatctacgtagtgaaacaatttcgatatacctggtggaacatcgtgtaacatttaaaaataattcaataataagctaatttttttatcgaaatatatccatgtgtggtcttgtttttaagatttaattgcaacaaatttaatggtgtaatcggatcatgatttggataagtagtttaagagaaaaatcaatttaaagttgttttgcacgtatacgtggcgttgacggcgctgacgtcgtgctgacgtcagtgcccgattttaaccccccatcgggcgcccgtgccgaagtcattcccgtatgtaacacatactagtataataaatctggatagacatatatgacacatacaaactagaacaataaatcttgacatatgtgtcacatcttcccaaaatcccttatattatgggtctgtctagattcattgtattaatatgtgtcatatctaccaaaaatctcttatattatgggtctgtccagattcagattcattgtactaatatgtgtctgtcgcgtcctaaaacgaccctaaaatacatcctctaaatgatgcctagaataattaaaatacttgtgaaagccttcaaaaattaaaatgtgcaaagttaaaagtcaattaaggcttggaggatttttgtatatttcctaaaagcctaaaatgtgtaaataaattttagtggaattttcagagcataaataataattattaagaaataaacaaagttaaaaaggttttataaaaagaaaaccctaaaaatcccccttccctctcttgggccgaatccggcccatctcccccccctctctcctctcccccgcggcccatccggcctctccccgcgcgcgcgccgctgacgagcgggcccgcccgccaccctcgctgacgggtggggcccacccatcatccccttcctcccgctgctcccgccgcctcgcccgcgcctagcgccgccgccgccgcgaattccgccgcctcccgtcgtccccgcgtgaaatcaataggagggaattactccccgtgatcccctctccctttccccccattttcccctctctctccctcattcaaacgggcggatttgcccccgcaaatttcgccggcgccattgatggcggccggacctcccggccggtttccttccatccccggccgccctctctcccttccaaccccatttaaaccctccctgcacctccttcgcccgtttccaccctttgccgtgccctctcctcgccggaatcgagctcgcgccgtcgccctctctctcctctgtcgccgacgaccttcggccggctctctccgctcgccgggaccgtctcccgccccagtgtcgccttctccggcttcgccgcaccgccgccgtccccgtccgcccccccgtcgagctcgccgaccgccggagtgccgccgtccccgtccgcccgagccgcgccgccgccttcctttttcgtcgtcgccgtcgacctagggtgagccgtggaccgccgtctcgtttccccctttccctcccctctctcggccgccgctccaccgtgcctatggccgccgccggcgaccataggggcgcgggcgcgccgcctcccgcaggccgcgccgatgtggccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggt

SEQ ID NO: 74699 - DNA, 6614 bp, Oryza sativa
cagctgccgctcaagactacttttgctagaagctgaacagaacattgttcatgccgatcaagaagctcagcatcaggaagaggaagagcttcacatggtggatgatgcaacaatgaccctcgagcctatggatgaggaggataatggtttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagctcaggcgctgttggagaattgtgaagtagcagaggcagtcaatgaaaatgtcgatccagccacccaagttactggctcatctaccccagaacagggcacggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaacaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggcatggatttcaggaaggtgctcgaccagaccgtccgggagatgtaagaatcagaatttttatttctccttctccgccccttttctcctcctggtgtactcctatcttgtaaagatatttttcttcttgtactttcagaaggagggaggtaaatcttaaggtgctcaaggtgccggaaatcgagcagaaggtcaaaatttctttcgattttgccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgtttcaatcattacaggcgttggctgtgatcgagtaccttctagctaatggcaccgaacgtgcagctgatggcattgttgacaatagctcacgaattgcagtatgggtccttcgctagtttttctagacattgatatttcattgtttatagtacttgtcgtctgatgctgatttcttttgggaagaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtaagacattctgtagcccattagcgacattattgcatttcttgtacatttgatgcttacttcttttcatgaaccattggtctaggtattttggcttatcatcaactggaataacgcacaaatcgagcgcagcatcatttggcagtggcagctactcatctggtagccactatgggagcacaggaggttcaagggaggtgggatcattcaaggatatacacacaggcacagaatggaaaaagaacaagaaggaaacagtgtcaaactacagcagcaatagagaagggtctaaagaaattactaacagtgcaaccagttataagtcaaaaaagagtgaaaggcatggtagaaggtacctcccagttctactccgtctttttcaggttttaccatcaacaatagatagtagtggtgccttgaaattatcaagttattgagcaatgactttggaatccaatcttaagttactaaatctgatacttttactgtgtgcatgaaagaaatcaaaattccttaacattacactcgaagttatctgcaaatattagcaccacatctgaagccccaagctcaaagaaaggggaaaatgaggatgatgatgatttcaacccacgaggattttctacatctagtaagtatttatctgcagtatcttaaatattcatttgcatttatgattacaatggtttacctttttgttgcacacgtaaagttctaaggatttattcttgtttgaccatagtcatcatgttgccatctggaaattcacttggctgtatgtttggaactcagctggaacaggtaccacaagatctaatcacctggatctctttggtccaagcttgatggatgatcttgttgattctactacatccacttcaacagcaacgccaaatgttagcacacctgctgtgccagaggttgatttatttgcagatgcagctttccaatcagccaatgctccattggaggcagcaacggtttctcacactcaggtttatactttactaatagccttttttttaccatgattcatttttcatatccctaaatgtctgtgagaactacttactcaaatatgttaccaagaaagtggaaaaataccccccttaagattcataatttgcatgaactatattgttgaaacttgaaacttcattcattatatgtttccgtccatgtattttcaaataaaatacttggggaattcgaaatacatgagttcattattctacaactcattatttattttcaaatttcaatgtaggacaaaattgatttgtttgctggcagactgtcttctgctgattcatttacttcagacacagagttctcagtacgcggtagtcctaacaagtcatcggagaaaaaaatgtcttccgttgtgcatccttctacttctgcttttgatcccttcaaacaatcttttgccacctcatttccttcagattcagagttctcagttcatgatccgacaagcaaatcttctcaaggaaaaactcccacaccagaacattcaagtacagcagcttttgatccttttgctgcaattccactgaagagttttgatggatccgaatcttttggaacattttcttcgaacacagcctcaaacattactgaactgccacgggattcttctgggggtcccaaaagttctgaccatggtcctttggaggatgccaattttgatgccttcacttcacacttgggatcttccacaacaagtgcaactgagtccatgaataagcccatcaaaaagcttgggcaggactcgatgtcagcatcaaaatcagttgcaaagaaagaaacttttcaggtcaaatctggcatatgggctgactctttgagccgaggattgattgatttgaatataacttcgtgtaagtatttttgcactttttcctgtcatgcatgtagttcaagttcggtagatgcaaagtagcaaacataaattgtaatatgtatgtccgaatttgcaaggttcaattcattttagataatggatagaaattcggcctctataaaagtaaaagattcctagtgaactgtatattagattattagtatccttacaataaaacacaagcataagaataggaagggtcatcaagcacaactcaaaaggctaattatcctaggtgctaaaaaggaagacgcatcatagctcatactgtattgttgtaatatgcagcacaaaagaaggtcgatctctccgatgttgggattgtcggaccgctgagcggcggatctgaggataaaggcccgggggcgacgatgggcacagcaccaggccttgtcagttctagttttccatctaaaacagaaacatccagtggaagcggtcattttcagcaccaacagtttggaagctttaagtgatttttatccaggatatgtcttttgttctatggttcttgcagagtacttcttggagcattcgtacagctccatgcctataagagtaaacgtgtatatagctaccaaactctgtgcgatgatcaggagacgtgttgccaactaaccagcatcttctctgcccttgaggcattaatatttttttacttatggcgaaatggatatgttttgtgtacatgagtaaagaaccaatgccatggtagcaattgtaaaaagggttcatcaattatgtgtgatacacgctcatatgaattttgaaaaatgaataacgcaaagcattctggatgctggcagtggcaaatgttttttttagcgaaacagtacttggtgtgcccttttcattgatacagcgggaaaaaaaaactgtaccaaagccaaaactttacagaaagaaaaatactagggatgatctgtgtttggctactgccaagacccaagatttgcccgccttcctaattttcgccgctagggaccgtgctaagagttctttatgttgaaacactctgtgaaagagcatgtagcctagtggttgcagtgacttaagtagcatccgaaggttctgagttcaaatcgttcttaacttaaaaaaaaaaaaaaggcaccccaaggtcctgagttcaaatctccgtaactaagttcctatttttttaaaaaaaaactgaatatatctggttggatatagaagtcgggtaaaaaaacttttaaaaaaaatgttgaaacactctgattcctttctttccatatctcctaagcaacacggacggtggagactcttttcttagtcatctctaaggtactggccaacgttgtcatatctttctttccatatctcctaagcaacacggtggagactcttttcctagtcatctttgaggtactagccaacattgtccaccaagtatggatcaaatatttccatatctcctaagcaacacggaggagactcttttcctaggcatctctgaggtactagctaacgttgtccaccaagtatggatcaaagtaacggagttccaacttattggcttgataagtgttggtttctcgcccttcatggcgtggccctggctctctctctctctctctttcttttttttttgggggaaggggggatagcattggcccccccccttttttggggttttggaaaaaaaggggttttaatatgttttagctgtttaatgtaagatatatttgaacaatatgccactgtaattgatcagacaatacttggtcgattggtcctaacacaaattttatttcgattagtgtcaaatgaattgtcaaatcaatccaaccatccttaacataataggattgcatcaaatcatagaaaatcaattgtgctcaatgcatgtctcaacctagtcaaagtttgattccccaatcccaaccatcttaacatcaaagaattgcatcgtattagagtaaatcaaatcaaatcaatcatgccctattctcataacatagtgggggtcgaagtttcccccaacacccaaccatccttaacatgtactcgtagtaaatcaatcttgtggggtcggagttcaattccctgaacccccaacccatcgtcaaataccataggcaattgcaaatttactacaaatagttattacaaaactgccactagaaaattata

SEQ ID NO: 74700 - DNA, 7057 bp, Oryza sativa
acaatgtggtagcatgttatacaactattagcattaagtgttctcagaatatcatatagctgccaaaaaaaaaacctagaaaacaaagtgcatcaactctaacaggtacctccatacctgagaatgtattttgtgcgggtgctggcgcaggagtaggagaggaaggagatatcacgggatatggttgtccaggaactgcacatgacatagttttacaggaatgaagccaaaaaaaaaaaaaaggtaaaagcaagaactatgcccaaaagaaaccttacaagctagaagagaggtatccaaaataacaaaataaaacatcataaaagaacaaagtggaataatatcattgtatttgtaccaaaaagggagtgctatacagatatgaatgataacattgaacaaggttaacccgcaaaaatgcaaaataagaaaataagatgaagcacctagctaaccaaaaaggccaatattgccaaatattaaacgtattgtggtccttgcctgtaacttagggtctcattctattaaatacatcaaacagatagtaccttatgtttggtgacaacacaatttggttaaattcttagtaaaacttagaagcatggcatgtgtttcgagtacaatcattcgatatcacaatgtgcctccttgtttgtgccaaatttgtctgtagcagcacatcatcagatgccaccaaccagtctaggaatgaagggattattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgtgttcatgctattaagttgcatgcaccagccagttgcacctaaaagcctaagctgatagggaaaggcgggcaattcactttatacactccaacacatgctccttcctatctgaggtgatctcaagcaagaaatgaactgttaaatccagttcaatatagctgattactatgtaatgggcaagcatctctgttcctccctcattaaataacgctgcatctataaattattagaccaattaatttcaccatgttcatgaaataaatggtaaattctcggttcagccaaaaagaaaaatgcagtataccgtgtgtaaatagggaagtttgattgatcaaattgccggagtgaatgatcgctaaacatttgttcacctgagttgagtgggatgtagtacacctttcccgtggttataggatcagggccggccatgccattggcggcctcgatggcgtccatgctggccccgaaccgacttgatagcgattgcaccgtgtctccgtcgacgccgacgtagctgaggagatagttccaggggccggatgagcagccacagagcaggtggagagccaccacggcgccggggcgcggcggccgcagagccggtccgcccggcggcggcacggctagccccgcgtacgccgcggcagccacgtcggccgccgtggcgttcgccgtcgccccggcggcggcggaggggacagtgtaggtcgtattggcgaggtatgtgcgggaggcgaggcaggagcagttcttgcggacgaacgcgtacccggggctggcggccgcgtcggccgtgatgtcccccggcgcggcgtcgaacatggactccagcacggaggcgttcgcggcctcgccggccgccgggaacgcgacgaacgccgtgcagacgcgcgagagctcggagcaggggagcggcgccgaggcggtgacattgccgggggcggcgtcatcaccggcgacttcgccgggggaggcgagcgccaggaagatgaggaggatgagaagcccgggcgcgggcgggcggcggcggggaggcggcattgaggggggctagggttctgggctcgaggtggcgaggtggtggtggtggggcatggaggtggcagtggcgagcagcgagctggatgcttcgcgtggtcgggtcactggagcacactctgggggacggcgcttttagtaagacgacggggttaattagcaagcaaagcccgcaccgcacgcacggccatgggtactggactactagtagatcactgtctccttcattccttgtgtgttatgcccatattgcccttgcacgcatcaataatccgcccgtttttgcttccgtcggtctgggaggtggtaacggataatggtttacgacgcctcaacttgttgagtgctatctctgtttcaaaataaatttactttcaagtaaaatacatcagcggtccttaaaattatcgtgaggtttcacttaggtccacaaacttgtaaaacgcacattgagatctctaaacttggtttattgtatcatttcggtccaaagtctcgtttgaccgtagtcttgcctacgtgacacgccacgtggacgatgacgttgaattttttattttttttctcccttcttttcttttttttctcccttcttcattttttttctccggcggccgctgcaccgcgagctccacagcagcgcctccatctccttctccatcagcctccgctccgctcgccgcagctttgccacccgcttcctgtgacctcgtgtggcctcctctctagctccatgccagacaccccgctgtcgtcttcctcgtcacggcgacgatgcctaaccctccttccagctcgatgaactcaccgtcgtccgaccactcctcttcctgcagcggcttctcgacctcgatgatgacaacgacaacgacgacgtggtgcgaagctcgcgacgttcattgtgccggcggagatctacccagcgaggctgcgtgcgacgagccacgggatatcggcggcgtcggggaaggtgggcgcgatcatcgggtcgttcgggttcctgtacctggcgcagagccctgacccggccaaggcggcggcgcacggctacctgccaggcatcggcgtccgcaactcgctgttcacgctcgccggctgcagcttgctcggcttcctcctcaccttcctggtgcccgagcccaagggcaagtcgctcgaggagatgtcacgcgagaacgaggtcggccagccatgatccacccgttaattccaccagcatctgtatgcaagatccatgcatatgcacggttagtccactatgagatttttgttctcttttttctagaatccattggaagcatatgttttcttctctttttttttctttttggggtttagagcggtgacaattagaggcagtatgatgaaataatggccgccaattaattgttgacgacaatgtagtttagcatcaggtgggtcatataatggacgatcattagggttcatgctgattctgtttcggcacgagggatcctcgggttcgctccttttttctgttgatgatctcctccaaaaaaacaaaacagaacgcatctctctctataatcaaaaggattccagctcgatgaactcaccgtcatctgatcactcgtcttcctgcagcggcttctcgacatcgcctttgtctggcgaggaagccgcacggccgacgccatcggtgtccgcgaaataacccgaagcaagacgagtcgagatcgacaatgacaacgatgacgacgacctggcagccacctccatcatcgccgtcgccgccgctgcaatggtcggcgtcgcgtcaatagatggcaaaactccgagaacacaaccacgagacgacgtcgacgttattgcgtgcacaccacttgcgagacagagagcgcgcacgtgcggtggagaggtggaagaaggccctgacaggtgggcgccggccctcagcggcagatgggagaggagggaggcaaagtggaaaaaaatagagaagggagaaaaataaataaaaattacatgtcatcgttcacagggcgtgccacgtaggcaacatcacggtcaaacgaggctttggaccgggatgatacaataaaccaagtttagagatctcgatgtgtgttttacaagttcgtggacctaagtgaaacctcatgacaagtttaaagaccgctggtgtattttactctttactttttatattttacacgtatgaatacaaaactaaaagtactttatcaaatctcaatagaactatttctcatcttatcttcttctaatacaactgtttcctattttcacaaagcatgatacaatgattactttaaaaatttattttttaaaaaatggaagtaactataaataaatttaatatcagaccgaagaagtaaaaagcttaacataatgatgatcattgatcagggggagcgaaatgaatgagcttccaatgtaaattttctttccgcaaaattttattttgtaatggttcgttgtcgtcttattaaccttacgatatgcaccacaatgtgtttttaacagtgaaaagaaatatgtattcccttcgtttcaggttaattataagatattttaagtttggtcaaagtcaaactgctttaagtttgaccaaatttatagaaaaaagtaatattttcgacccatgataaatttttattataaaaatatatttaattattaatttaataaaactaatttaataatataaatattattatatttgtatataaatttagacaaacttaaagcagccttataatctaaaacggagggagtagttgtgatacagcaacattggcgtgtgttggtgttcaaaatcaaaaactaaggcttagggtagcatctctggataaattactactggaagtgtggttatattacaaaaactggatcattggatgatggatccaactatcacaacatcgaaaatccccccggttacatctatcaacaaatgttggtttctgacagttcccttcatatcgatcaatcgtccgattgcaccaaattaacaacagtgataaaatttggtaagaactaaagataggctagtaagctacgataatataataaacttaaaacttactaacaaattatggcatgtataatatcgtctttcatgataatcttctaatgcgaattaaacaggtatttgattaattagttaatcaatatatatcataacaaatataaaaaagtaaactcgggcactgtaaatatatccattcctaagatcaaagaaacttcggggagcgacgtgggaattgtaaatctaccctgcgcgtggatcaatccacgtacaaaacaatgggagcagggccaaacccaggaccgcacaattaacgagcctccgtttgtctttgatacactattttcactctttgaaaaaggttagcaatccaaaagctcccgatgatcaaagattccattagccggctagttagtgttccaaattaaagaagagggggtaacagggtagcaactgtaatgctgcctcttcctcattcggacacttttgcggtgagtattctatcccccacggcccacgtattatatgctgcatactgttcagtgatgttcaccgagagagagagagagagagagctactgctccatccactgtttggtttctcttgccatctctctgcgtactgctacgattacaggaggatgtactgcaacttatggtaccctgagcaatgaatccaccatgtacagaatgaaatcgtttcgcagttacaccggcactattgcactaaccattaattagcagcatagacgggctgagtaaagcagggtagtagtactactgcccgcaataaggcctggtttagttttcaaaaaaaaaaatttcaaaaagatcacatcgaatttttaacacatatatgaagcattaaatatagataaaaacaaaaactaattacacagtttatatggaaatcacgaaacgaatcttttgagtttaattagttcataattagtcataagtgttacagtaacctacgtgtgctaataacggtttacttatgcttaaaagattcgtctcgcggtttgtaagcaagttataaaattagttttttcgttcgtgttaaaaactctttctaacattatcaaacatcccatgtaataccaaaaattttcttttcaaataagacctcggtggtagctgggcgtcgttatggcctgggccgagcggcaacgaaggccgatgtagccaaaaggccccgcacgtgggggtggccgacagctggttgcccggtactactaccatggaactatggcagctaacgccacgcgaggagggagccccgagtgggcgaggaggtgggtgccgtggtggcgcaccgccacgccacgcgacgccactgccagcgtcggtacagacaggcgagaaaagaacgatttcctcgctgagttgtctgagcgttttcgtacgagcacatccactcagatctcccgggggtttattttaagcgcctcgcccgcagctcacaaagcctgccgccgtgcgtgcatgcgggctgcgcaccagcaccagctttgcgagaaatataagatggttttcttgattatacggcggggtttgcgtgtgctacgtgctgtccgaatatttccgtggatacggtggatgtatagtggttacagtattatcccgtactactactactgtgtcctactgtccttgtttagtactccgtaggaatttagggcaaagctcaacacagaaacagaaaagtaggtgaccgaattgacgcacgcggtgctgttgctgttgctgaacgttagtaaggccgagtttagttcaaaactttttttaaaaaacttttaacttttttatcacatcaaaacttttctacataaacttttaattttttcttcacatcgtttcaatttaaaccaaacttttaattttgacgtgaactaaacacaccctaataagcagtcccggattgaagtggaactaaattggcagtgacacctaggggggacaagaaaaatctcgcctcccatgtcgtgacagctgtgccaatgcttaattcatgcgtcggtaatgcaaa

SEQ ID NO: 74701 - DNA, 3452 bp, Oryza sativa
ctcttgcgattgctttgaacaaaagatgcaaatatggggcttacacaagctgcactaataaattttcctatagtcgagatgtatttgcctgagcgagtgatgcggcaatttgggcttcgccaatccattccaccaccttttcgacctaccctacaggcgctgcatcgtattagtcgacgtggcagagaacgtgagaactgggaagagacacatcatgagtacattcaggaatgggaagcccgccggcagcgcatatttccagagtcagagcagtatgacccatcgtcttatgaggagtacctgcattggtactcaggagttacacggcggtatcttgtaccatcaatcagtgatgatgtggaagcaggaccttcattacagcctgatgattccattgatctgcagtatcaagccaaggctcctatgatccgcaaagcagtaagcctatattatctattcagttcctatgcagtttctgtagttgattggacctaaatttgtgtcagatataagttgtctttgcgagacttcaaatagtttttacaatcactccatgcataatttaactaatatatttaactcgaagggtctgctgattgttgtaggttgataaactgcacggtatggtaaagaaggccaagatggccatgacatccacagctgatacaaccaaacaagccttggtctttgagtttctgcatggctttcaggatgttctccatgaccttggcgagatcaaggaaaatggtggttccgctactagtccacatgttgaatcagctgccgctcaagactacttttgctagaagctgaacagaacattgttcatgccgatcaagaagctcagcatcaggaagaggaagagcttcacatggtggatgatgcaacaatgaccctcgagcctatggatgaggaggataatgggttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagttcaggcgctgttggagaattgtgaagtagcagagcagtcaatgaaaatgtcgatccagccacccaagttactggctcatctaccccagaacagggcccggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaccaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggcatggatttcaggaaggtgctcgaccagaccgtccgggagatgtaagaatcagaatttttatttctccttctccgccccttttctcctcctggtgtactcctatcttgtaaagatatttttcttcttgtactttcagaaggagggaggtaaatcttaaggtgctcaaggtgccggaaatcgagcagaaggtcaaaatttctttcgattttgccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgtttcaatcattacaggcgttggctgtgatcgagtaccttctagctaatggcaccgaacgtgcagctgatggcattgttgacaatagctcacgaattgcagtatgggtccttcgctagtttttctagacattgatatttcattgtttatagtacttgtcgtctgatgctgatttcttttgggaagaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtaagacattctgtagcccattagcgacattattgcatttcttgtacatttgatgcttacttcttttcatgaaccattggtctaggtattttggcttatcatcaactggaataacgcacaaa

SEQ ID NO: 74702 - DNA, 779 bp, Oryza sativa
gagatcaggtaccgctaaaagtatgggaatcaggtttcttcttctattgtgggacaacaaacaatctatccccgtttcaacatctgactaagtaaacaaggattagccacaatcaccatcaattcctacacggaacgccccccgcgtcgggcgaatcggatggggggttttgcagcgggaaggatcgggatgggagggtgcggtaccttgagagagcgcaagtggctcccggcgatgcggtacatctctgccgtgcgcgtcgcggaggcttggaggaggcgaccggcggagatgaggggagccgccgccggggaggtgggagacgcgggtgcgaccgtccggtgcggcgcggaggttgagctcggccgggtggagacgtggagtggtcggatccgaactgtgcgtaggttttgtgggaatgggaaggctctggttttgtgggcttggtcatgacgggcttccatagaatcataggccgaaggaataagttcatccgaggtcccttaattttacaacaaatccgattttcgtccttaaaccccaaaaccagatacaaccggtccccaatctgtcaaaaccggtgcccttggcggttttgaaggcggttttagctgatatggcgccatttgactaggtctccgtcccacgtgacattgatgtggcgatgaccgtggcaattatatctcagaaaaataataaaaatcatgggcccacatatcaaccacacaaaaaaaatctaaaaatgatggggcccatatgttagctacaaaaataatatg

SEQ ID NO: 74703 - DNA, 9765 bp, Oryza sativa
cgtccattaatgaagagaaatcaagttgaagggaagagagaatgagtccccacacaaaagaaagagagggagagatggtgcatgtggtatccccttgagatataaaaagaggaccttgtctacttaaagaaaaaaaaagagaagacgatcccagaacgatcgggggctggaaggggggatgatctggagagggtttttagaataagagctctctggctctccagctctttgtaacttcttcatacacagattcaccagaacacaggagtagggtattacgcttctcagcggcccgaacctgtatacatcgcccgtgtcttgtgctttttccactctcgcgaactttccacagactaggagcttagaatctcacccagggcccccggccgaactggcaaaggggggcctgcgcggtctcccggtgaggagccccacgctccgtcagcgcggctgccacacttgggtgccagtggtagccacccttcatggacatgatgccgtggtgaaagaggcgagcggatgagactaaaacagcggtggcgggcggttgcctgtagcctgcagcgtagatgtgtttaaactagaatgctctcagcccatagctagcgcagatgtaaaattgattgtcgcaggtggatatttggctccgagggtcatacccgcctagaaaaataaaagtccaatgtcgctaaaaaatatttttctagtagagtgtgacgccacgtcggctgaatagaaaagcaggcttggactccagtggtggcttacccctatccaaacaatcacgcaggatgttgtagcttttcagcggccacatttcgatggtgatttcccttcctagacacagggattgagaaggtcaagcgctttctagtttagcaggcgacccatcaagtttgtggtattttttgataggggagattctttattggtatgaaatcattgttctatatatggaattttccgggagataaataatctggccgacaaagaataaaatgaggaggaaaaaaagaaatagagaaaaattggggagaatggcatgaaatcaaacgattcacagtcctggtggcatattttgacatgtcttgcgaattgagtgacaaatgcgcaaagcatatcatattatcaaatttgttaagaggagtgtgagataggactggaaatggggaatagtcggaggattagtagtatgatccattagtatatggtagtatggtagtcacacatggatcatatcgtggcagtcatcaaattccgcgcgagaggaaatgagcgcggtggcacagcgagcagcaggccttaacgagcaacaggaatacaggatagcgtgaccgatatccccttcaccaagacaccgaggctgagcctgtcagcgtgcaggcctagaagagcatctcactacaacaagcagggctataattatctgaaatttaatactcctccgtcctacgatacaagtgattacatcattttttataagaaaaagatgaagaaaaaaaaatgatatgtgatggtacaaaagatgatgggtgaaacaataaaataatacaaaagttggtaggtagaggaataaaatggtataaaagttgataggtgtggataataaagtactatcttgaaatcctaaaatctcttatattttagaacataataaaggtgaaaatatcttattctatgagatggaaggagtattctgcttctctgattctccaaacaaacctccggttgttgtgttctgtctctggctaatctctgatcttgaattttgctgtctatatttggcatgagggtcaacaatgcgatgaactagtaaaatggcaggatccatgtgtgtataactgaatatacatgacaatttaaccggtgagaggatggtgagttgtggtttgctggtctatggttctatatatgcgtctatcatggtgttctccgccatcaaggatccatgtgcaagtacatggagcggtggcacgaattggtaacgcgatctcgacgggatgggcagcatcgagctcaggacggtaagagggtggcaaagcgctcgcgacgggaagagaggtggcacagcgaaggaggtggataggaaaaaggaagattcgatgataggggctagagtaaaaggcattagcgatgcacggacttgttaagtgggtataatttagtgtatgaacttgtaaaatgctcattttggtgcatgagcttgtctggtacttgcaaattgaggttaaaatggtatgacaagaccgatttttttatgttgaacattataaattataaattaatatatcacgtatgtgcaccatagtagaaaggtatatttgtaaacttagttttcactttatctttctttttgtcttttttttctatctcttgcatcattacttgtttttttatgcaatcattatgtcttattatatgtttatccatcttagacacatgtttacatggagtttaaatcaaggacaaaatcagcaagattaatcttgccgtgcaattctgaccttgtttgcacacaccaaacaagttcgtgcatcaaaatgagcgtaatacaagttcatgtactatattgcatccacctctcacaagttcgtgtaccgctgatgcaatttactctaaggaataaattgccctcactgatgtggtgggtaattttctaaagtagtataacattgacaaaatacccatataaatgaacggttagattacatacatactacctatacccctactcctattactagaatgatgcactcttaaagaactctctagttaatgttgttgtgaatgttcaccatctaaagatagcaagagcacaagctagaaaaaggaagcatttagaatgaagaacttaattttaactaaaccactatctatctatctttatatactaaaagtccattaaacttcctacaaacgcttctaagccgccacgtgttattcctataaacactcctcaatcgccacgtggcattctaatatatcagtggacccactatttttaattatactagattatctttaaaaaaataccacagcccacctccctccctctcccaccggcccacactgcaactacatacgtacgtacgtacacgtagtatatgtacgtttcctcctctaatacttcctctctcctattctctaaaaaaaaacctccctcactccttcctatttaatcctattatattctatagctaacaattttttaatatagaaaaaatataaaagaaatgaaatatcttactgtgcattttcacttaagttggtgaaacctactattttaaacattagatttaaagatgtacataattcaaatcaatgaatccattaaatctatatttaatgaaataaacaattttgaacatagatcgttattgtttgcatggccaccaaagaagaaggaaacataaaaaaaataacaatatctattaattatgccatcttgaatcatttttacataataaagattgattaaatgtcctctataacgctcttaagtcaccatgtctcatgtctcatgttttaagtttagacattcaaagaaaaaaaataaaacatgtaactatgggttttcagttaaatcggtaaatccactgttgttaaccattatatcttgcagctgcaaaaggtcgggtcttgaagataaaaaaaaatggcatttcagaaaataaaaaaaatcaccagtttccacttggatcgtttagaaagactagaaaaacgaagtccctccaccatcaccttccatcacatgagtataataatgctcgcctatttccatgtctcgctcgagctctacgctattcattcctcttcagactcccctccctattatcagctatatactaaatgtgcaacaaccaataattgcagatattgacaagacaataattttaagctatacttataattaaaccgatccatatgcctatattttggcatttaagaaatattgtcaatatctatttttgtcattatacatcagtctagaaacaggagtagagagcaaaataaaaacataaaaaaaatataaattcatgtttcaatcagtgttcttaatgatggacaatgcaacttttgtatggcacccgaatcgccattaaatactttaaaataattaaaaaaacaaaactataaacatgaataactaaaaatatacatttcactcagtacataagaaaaaaaacagctcaaatgtgagtaggccaagccactacataaaaaaatggactaatttgctaggcatgtgttctaaacaaaataagtctactttattgttagatgatgaagatgactataaataattgacggggagattagtaaaattgcaatgctaatgaaaagattatggagtaattgtacttttgaagtgcgataaatgttcttttgtttatataccacccttattgtgtatgaaacgctttgttttacaaccagaaacaccgttagtaattgcaatgcatggcaacataagttacgctttgtttgtaagggtagaaaattaactggattatttatatcataatttaagactaagatatctccaaaattcctacaaacgctcctaaaccacagtgtggcaacctacaaacgcttctaagccaccacgtggcactacagtaaattagaggcattcctaaaaattttgacaaaaaaacaaaacaagtaatcattgattttcattaaatttggtggtaatcccccctcctctccccgccacgtggcctactcaactacttcctctgtttttcctcttttccacctatttcatctcttatttttatgctttattagttagaaaatcaaaaaaaaaattgtgtcgaagaactaagcaaccataacatctaaatcatacaactaatttttatctgcttatatctttaaattatgcatgactaagtttaaagtttaagaccaaatttcattataatgtaatttgggttatattttttgattttttgcgtgtcgttcaagcaactataataataataataataataataataataataataataataataataataataataataataataataataataataataataatatatactggattttatcatcctacataacttcataatgatcaaattatatataaagtcataaaagtaaaatgaaaactatgagtaatattcccaaaatatattagttaggaagcaaaagttattctaaaatgtaagaaaaagcatactaatatttgattcgttgtaacccataaaataatattataatcatctcctatcattcaattcctccatcttctaatttttaactaattaataaaaatgattaataattggaaagaaaaataattataattcttaatttatatctgatttttagtttattttagttattgttttatttatagttaaataaatatataagatccatattagccatattttactgtataaaaataaaaatttgtcatttgatcatagacaccaatcctttgtgtggtaaccaaatagcaaaaacaagataacattataaaaaaatgacaaatgtataatatcacaagtacatcctctgtagcgcacttaagacatcacgtgttacgtcttaaataaaaataaaatcttagaaattgtaagaaaaagattaaaccatcagtttttacttaaataggtggatccattatttttaactaatagatatactttaaaaaaaatctgaaaccgcgccatgtgttacgtcttaaaaattagaaaaaaaaatagaaattctgagagaagtattggattattgtttttcacttaaatcatttagaaaagaaataaaccaccactacacttcaccctcccccgcacatgcacacaacacaatactaccggtccccttttctctcagcttgagctctccccttgaatgttctttatagcgagaaataataaaaaaattaaaatatacatactgctttctaatctagctatttttgtattcataattgaaccaacaatttgaagatccataatacctatatttcgaaatgatataaaataaaacaagaaaaataaaatgtcaataaattgaactatttggttccaaccagaaggactaacttgatggtgcaattaggacatatttattaacaataatagttatttaggattagttgaaaaagccactaaactttcaattaaacaagacaaaacaccttacttttaatttacacttaatttgttagacacgtttttccaacaaaccaaatctaactccataatgaagagatagataattgtttatatggatgtattaaatattatatattttagaagctaacagatagattgaaaaaattatctaagcaatgtcgatgaaaaaaattatggagaaacaatacttttgaaatatggcaggtgtcattcaattgatattccacgtatataagtttttcaaacacaatttataatacatgcccgcgcgaatgcgcaggctacctccctagttgttttaaagggagtaatttactatttaactattcagacacactcaaactctaatttaactctcgcactcaaattaacaacttaatacatatagctatatcacaaccctgatattgtccacatgctaactcacacacacgaacaggcaaactaacacaaccatactaggcacacgttctaccgaggagaaggacttcaatatgagtcatacttagagagacatctcttcatcctctgtttcacccaattccacaactgaatggctcatctgaagctaagcgtcctcttgcctatttggaatcttcttcttcatcaccaacaattaatgttgtgcataaatggggaaatgatcctaagtggaacattattgttattcaacacgcaggtcttgatgcaatgatgccagctgtaagcatggaggaagatgaacccttcctatccgtggtgcggatcctagctagctcctctaggggatgcttctacctacagttgtgccagctcctccttcaagtgatctatctggttttgtcctctgcagatcttgatacacttgtcattaattctcctattcatgagccgctatcagcctatcattacatcagtccattgtccattgcactcaacatcctcacaaagtattgcatactccgtccgtcccaaaatatagcaaccgagaactagattggacatcacctagtacgatgtactggacatgtagattgctatattctgggacggaggaagtagtagagcatgtccagatacggtactaggtgatgtcccatctagttctatattgctatattctgggacggaggaagtagtagaattgttctccgtctctggttccagtaattgttgtactcatcattgtgggccatagatggatcgtaacaataataggtgtccctcaagagctcactatacctatgacaaagttctcggatggccaccaatgccacctcttgatacatatgggcaaaagttccttcctccagtttcgaagatcatgaacaagatgccttaacgatcacttaattgtcgccgtcagacgaacataacagttattgacgatgaatatgacccctctcatttatgtcaggggcaggggtgatgcgtttctacttggggttagcttgaatcctatgtgcagctccgtaactataccaccaacttcgaacaaatggatagtctcattgattgagttaggttaactgaaaatacagaaataactgaaaactagtgaaaataaaaactaaaaccagaaagcgaaagtaaatcaaacaaaattcagaaatatcttttaaagttttcttattttttgaaataaattatttttcagattttaaataatcaatttccggaataaaataaatccttttccagaataaaacattttcagattaaagaaattaaatcttgtccttttcaaactggttgattttttgaaacgatgggtcttactgtacgtacaaaaccaaaaaaaaagttcttttttcaagaacgtgataatactaaaagcaaattaaggatcgtacggtaccaatttctaattaattttttaagaaagcataaacaggacagtaagaagtacattactatttagaaggaaagagtatgcgcggcaccagatttataaaagaaaaatgcaaaattttatttctttagaatattttctcagaaaaagaagaaatcaaagaaatgatgtatatatactattaaagaggaatggagaaaagcggtcctaatttttcaaatctttttggaaaggcttctatatattttcatttggcttaggctaaagccaaggagcctctcatatcaacttttcactcccgaaatttttatgtataatttcaaacacttatatgtatatttaactctcgttcaggaattagtcgagataagtaataaacaatattaacaacaggtataagtgtttaattatgatagatgtggataacctctcaatcgtaagagttctaagcagtggaaggaaaaaactagcataagcgacgactccactatatggacagcttaaccaggaacagcatatggtagcttattataagaggagcatattgtatactcaacaagccacataacaaatataacaaatatccaaatatgcaagtgtatatcatataacaaacgagagtatactagggctaatttgaacaaatagcatttgataatcaattgataatacaaaaatagttgaataattaaggaaaattaaaccagcactacataatctaacctggttgcacgggcccaccgtaaaaccttaccctgttgcacaaacccaaaacgctccataggcggagatatcaattaccagtggcggcgaatctaggatagaaattgaggataggctcaacctcaaagtactaagttcatgaaaactaccgttacactagtttttcaacacatacatgattaaaaaaatgatgaaatagaagtaccttgccaacgggaaatgagtgattgcatatttgcatcaaagcatcaaccatctaaagtgagcagccacctatgcatataataatagcaaaattagtgacaataggaaagtaaaaaaattaactaaaagatttggccaaccactagtctacaaatacctgcaattgaattacgaggcaatgatattctgcgggttttcaatgcttgaaatctattcatgattgcatcatcatcaatttttttgaatatttgaggcctttttggttgatttttactctcatcagttgaaagtttaacaatgttgttttcttctccatcgctaatctatcaataaatcaaactatcaaatagtgaggctcaattctttaaaatcccatcatctagctgctgatgctgcttaaatcaaaagaaataaaagatggaatgacagtgattgactcaccgcgctggcgcgctcggcacttggatttggatcggctggatcgctagcgcttgctgctctgctagttgctgccttgctgctgctttcctatggcctacccagtgcgggagtgcccacgccgcatcggtgccgccgcttgcggccggccttcggccgttcggcggctgcgcccttgctgctcgcttttgccgccgcccgtcgcaactcgcaactcagccgccgccgccgcccggtctcgtcgtcacctggtagggttggggaattggcttgccgaattgggggcgtcaccgcatcaggcgttgcttctgccttcgtctatgggctgggccatagttgagcatttgggcctaatctttttccagcgctgcgctgcgtgccgcttcgtct

SEQ ID NO: 74704 - DNA, 7068 bp, Oryza sativa
aaaatcagagggtaggctagagcctgatggagcctaccccttaaaatcgccactgtcaattaccgattttctgctgttctgtcggtgattttgtttccaacatgagatgcactacgatagtgcagtgatactgagtacgtggttttggtctcatgtttaatcctcaaatcgctcatgattttttttcaaagaaatatttagagaaatgtatttcccttgatcaaatcttctttttttttcaaacgtgcacggcgcgtgagacgagagaatattaggtactaccaaatagtgctatgctaccggtgctgtcaacccttaaaatacatttaaaagtcacaaaaaatatgaaaaatttctgagacgtgcaacaccataacttatagtatcacacaagaaatcaactcaaaattcgctgtaatcgtgaagaaacaaaaaagataaactcgttccgtaaatagtgctcaaacagttcacatcactattcacaacagatttgtcttttttcttcttcacgattacaacgaattttgagtttattttttatgtgatactacaagtcatggtgttgcacatctcagaattttttttcatattttttgtgacttttaaatgtatttttaaaagttggtaacaccggtagcatggtactgtttggtagcacctgatattctctccgcgtgagacagagagaaggggaagaaaaggaggactccgtgcttttaaggtaggaataatcacaaaataaatattatttagcatgcccatttaaacaaggaaaatcaaattaaatacagaaacacatttttaagctttttattttcgaaataaattagttttcagattttaaataatcagtttttggaataaagtaaatccttttccagaataaaacattttcagaataaagaaattaaatatttctttttcaaacttgatgatttttgaaaacaaaggacagtacagtaccaatctttttcatgaacggtataatactaaaggagaggatcgtacagtaccagtttttaatcagttttttagaaagcataaacagcacagtaatagaagtacagtactcctccttttattcgttttagcgttgaaattctgtgccaaaaatatttgccttcttaagttacaaagcaattttaatcactacctaaaaaaccatttttgcatatgctcaagacctatatattttttcaaatggttcaaccgtccgtctattcggaggggcttgtaaaaattgctatttccatgcagttggtgcaccccaagattgaattttcacatgtgggtggttatctcgtcttcatgcgaaaatgaaaatcaaggaaaaaataaatatcccaaaaattccatccactgccgctcgtcatcgccgtcgccgaagcgctgctcctcgtcgtcattgttacagtccgccgccgctcgtcgtcaccgaggcccggcagctcctcgttgccgtcgccgcgcgggaggaggagctggggatccgccgccaccgagctccctaccatcggatccattgccactgcgtttcccaaccgccctttccattgccgtggagctccccacctctcctgctttgcttggccagccgctccctcctagcggtggaggaggacaagctgaggagcctcccgttgctgcccctccccacacctccaccacctcagtcccaccttggatctgtcccgactagatccatggtcgacggatcgatatctgccgcctcccggtcacccccactccttcaccggctgctccgctcttgcgccctgcactcactgccgtcgctcccaccgttgtctgagccggccgtcgccaccaccaacccaagtccgccgtcagggtccaggaggaagtgggagaggagggttggagtggaagagaaaaataagtaggcagagaggacttgaaatgagtggggagagaggccgtggaaaaacgagaggagctcatctggtcaaaataccttatattttgggacagatagagtatgtgtgtgcggaggatatacgatgaagggtattgtagactaatttaaataaagcattttcttaatatttgagaattgtaaaataattgaatatataagcaatagtaaaccaatacttaacaacctaacgcggttgcacaagcccaccgtacaaccagagaaaatatgtattgcaaatgtagtatatagacatgtgagatttgtccatattactacaagtaaaagttttactctaatatttaatcatgagtaaaaattttatggaactaaagttttaatctggtgatgtggacaaatcttaaacaaagtgtccatttttagatcattcgttagtttctgggtttgcgatatatttttcagcacaaccttacctgattgcacaaacccaaaccactccacacccggagtctactccatacccagagatatcacaaaaaataatgtttagctctctcataacactcaccttattaattcgaatagttttactctaaaatcagatatgtgcaaatttacacacaagatacaacttcacgacctgttaccatatgccttacaatatacctccgaaatgaattgtcacaaacctgttagcattacacaacctaacatgagcacacctacgtcagcttatcttgccacttcttagtctagggcctcacatttgatcatgttatatataccacaaagtcaatttccttttctacgtacgctaactcgtgattagtttggtaaatgttttacaacagtagctcgtgaatcggtctttaatttttatgagctagatcatcgaaaccgtcaaaaccgtgtgctcataacccaataattaagcatagatgaagcattaattatctttatgtgaatctagtgtttttaagcatgactaattaagtaaagttaaaataatctagccaaaacattataaagttctaagctagtccaattataataccggttagaaagaataggtgatcaacaatcaaaggggtacgtcacacgcgtgaacttagatatcgtgagtattggtagaagatatcgttagttccaaactaaatcttgtaaactttatgtacacactgttgtctggaacttcaggattgttaacaatggaaaagaattgcacttttgtcaccattattattaggagaggacacacgagaaagagacagggatcgctcccattaccatctactactaggcatcaaacacaactaatacacacagaaatattgaacgattgttaattagagctagccatggacaacgctcgagagagtgaggatgagcattgcctgtacgcgcaggagctcgtgttcgcctacaaccgctccatggtgctgcgagcggcgatccagctgggcctcctcgacgcgctcgccgccggcggcgacgcgctgaccaccgacgagctcgccgggaaaatccaggccacggacggcgtcgcggtggatcggattctccggttcctcgcgtccttcgacgtggtgaggtgctcaacagagacgagccccgacggtggcgcggctctgatccggcgctacacgccggcgccggtgtgccggtggctcaccaagaacaacggcgaggggtcgctggctccattctccatgtttattatcgacgaagaccacctattgccctggtatatacacattattcctataatcctatttacgattgtcaattgaaccaaatggtacatcatatgcgcgaagtgaatttataatttaactggttaggttccctatggtgtaacatctcatcggagtttaagattttgacatgagtgattgtatttacgctaattattttctagtggtaggcagtaacctaccttcatattttctagtagtagacggcaacctaccatcatagaaagagatttgctccggtctaacaaaaagtaccatgaggtactggtacctcgagatactttttgctggatcgaaccaaatctcttataatacatcataagcatatgcatatccatgtaggcaacacatagcggaggcggtggcgagcggcgggccggcgccgtccgagaggacccacgggatgccctaccacgagtacatagggaagaacaagaggctgggcgggctgttcgaccacgccatggcgcagcactcggcgatccgggcccgcaagatgctcgaacgcttcgaaggtttcgatggcatccagcggctcgtcgatgccggtggaggcgacggatccaccctggggatgatcacctagcggtataagcatattaggggcatcaactatgacctgcctcacgtcatctctcaggccccatctcttccaggtatgtgtgatcgagattttgtgttgactacaagcattgatcagtttgcacgacgaactgatctctactattataaaaattgaatatgtttttaccggtattttggtacgtcatctgtgtatgagctgatttttaagtttgtttgcttttggaaatatatatccgtaattgagtcggtttttaatatcgcttacttttgataatacataaggaatcatgtaagaaatctgttttcaaatctaaagaacttttaactagaaaaaaaaaatcaaacgatttacaatatgaaacggaaggagtaactaaataagtgtgcgcaatatgccctggatgttgatcttatattacaggcgtggaacatatagctggagatatgtatgagagtgtgcccaatggagatgcaattcttttgcaggtatgatagtgtacccactctatatataccgcttcttttgatgacctaagtttatgactagcagaatcatttgggttgttatatatagcagggtttgaaatttcggttcaaaatttacaaaatttcgacccccaccggcatgctcaaatctcacttgaaattttcggttttttgcaattttttgtgaatttggtcaaattttattcaaattcattcaaattcagtcaaattttcaaataattttggctcaaaatttcggtaacccctgtcataaaatccaatttcaaaatttcaaacctgatatatagtcatatggaaagaaaatgtttaaccaaatacaatttgtgacgcatgaaattttgagagtacaaatacaataaaacaattgattctagcgttgtacgatgtctcctatatatggctgtgaaattgggacatttggctagtagaaagaaagaacgttccataaagatggaaataatgcagaattaattcatacatgcatatacatatgcagtggatgctccttatgttcagtgacgaggactgcatcaagatactgaagaactgccaccaagctctccctgaaggcgggaaagtgatcattgtggaaggtcttctgccagagaccccaaatactactccagctgcgcaggattcattcaccatggatatgatcttgtttgtcctcttcaaggtagggaagcacaggacagagcaagagtttgcaaagcttgccaaggagtctggctttaccggtaccttccggtcgacctacatattcttgaacttctacgcccttgagttcaataagtagctacacctataaaacagtatggtcttgaataagagttgctagctcgcgtgtgtacttatgtctctctatgatatgtttatattccaatgtatgtccctattgtgtcactatagctaatctaaatgttaatcttcgatataccatctatatctaggtttccggtggactttcgtccgtcaccccctgtccgcttcgtgatcgtgacatcggtttagatcaggattcaccgctggcctcaatgttggtatggactctgaatcaaacacaataaaatcagctagaaggagtccaaggattaaaagttcgagcaaatcacaaagcaatacacaatatccgaccttgattttcgtcttgcccatgacggtggtgcctctgtatggtggcggcagaatcgatagagaagatgatcacatcggtgaaaagaacgtgatggcgttcactgctccgccgccaacgtgtgccgccgttgtcgaggttgttgccacatgtgcctgcctgccaccccacctcaatgcccgtcttctcgtcaccggccgggagaggaagagagtaggggcgccggcaagggaggaggagagaagggcccctgcgcctggacgacatggaggaagcagaggatccaacgacaaagttaaagacgacattggagggaggcgatgccagtggagatggagagagctagagggaaagaggtgtggtccaccttctacctccaagccgggcccgggccccgattcacgcatgcggtaaggattcgttttttcagtcgctaggctgatgatccctagcgcgccaccatgtcgatctgcctccccatgcgtttcctactccaatctataccttcttaaaaattacgtaaggcttccgatagtccgctttgtccgtcatcatcgtttgagtctgagttcgtctttaacaaaaatccccgagcagatcaaccgattgctcccaatccatttgcccccaatttccaaaatacatgaatcacaaaatcactcaattgcaatcccaaaccaaaatcaagaatcctccacaaaatcaacatcccaaatcaaaaataaaatccaaaacctaaccctagccgcctcctgcagtcaccctcctcgtggtcactgtcgccgtcgtcgtcgtcgtctgccgccgtcgttgtcgtcgccatcgtcgtcgtccgctgccgtcgtcgtcatcgccgttggcgtcgtctgccaccgccgtcgtcgttgccgttgccgtcgttgtcatcgccgccttccgccacgaccggctcccgagccagccttccgccgctctcggcagcgtctccgcgccggggatggggccgacgccgccaccgccatcagatccgctgcgggagggaggcgagaggggtcagagggagttgccgccgccggatgcgtccttagccgccaccaccgccgccggatccacccgcggtcgccgtcgccggacccatcgcgcgagggaggcgagagagagggtgagggaaaggacggtcgggaggaagagggggatatggagcggccccgctg

SEQ ID NO: 74705 - DNA, 18049 bp, Oryza sativa
tccatggtagtgtcacgtttttgcggtgtccctcagccaattacacgttttttgcgtgtcctgtagcaaaatttgccttttagaatatagcggcctggtttagttaccaattttttcttcaaacttttaactttttcatcacatcaaaacttttctacacacacaaactttcaactttttcgtcacatcatttcaatttcaatcaaacgtctaattttagcgtgaactaaacaaatccttagtattgtgttagacatattccagtcaggaatgatattatatgttactttgccatgaacataatcttatttctatcagcagaaatggatcaaccacatttcttgtttctaattacagtgacatggttaaaacatataatcattttgctcataacaagccgtttattagtaattaaaattaactttacaaatataatgtttatatatgtgttttcagtaatttagaagtaaatacttgaataaactacagcgaaaagaacttccaaatcaacttaaaataaagttgtaaaatttaaaattatacttatatttacaaaccgaaggctagatgatggggttgaatacttctacctaagttagaacaagtttataattgcagtagtgcaatagcatgggttaaatatataatgctggattttagtgaggtttgcgagtatgtaagtgtggtgtccgcgtacatatgtcttccatattggaaaaaaaataaagaaaagtcaaaacaggtgttagtacaatgtcattcatctgtcctaaaaaagtccatgttcaatatcttggatgggcttacattctttcctatccaatccaaggaacactgtaggaagtgcacaaaagttgacttcgattttcgagtttgacatttctacgacctgcaaaatgcaggtagcgagacaatatatttattgtataaaagagtagaccgggttttcatgatacacatggatatataatgcgaaggataaacaaagtttgattaattagcttactgctgtacagtcctaaaatatcagtataaattgtgaacctgttttggtctccttaacaattttgtactactaattaatgcacatttctctctgaccaattattcatatgaagccaaacactcaatgcgacggtgccggaccaagtccttgcagggggtaaggtttcacaggtgaccctagcaaaatcaagtactgaaagcgattgtgggtttggtagctcgtcgtggcctcgtgctacgcgtttggtaattggcagggcacggatggctgagataagctaacgccaccaaacttgtctacacatataactacctagttttgagtctaaatacctaatacacataaatcataacatgtatatattttgcctggaaaggtaaactactcctgccatgatattaccaacttctgcagatatattacaacagtagttggagttgtattttaaagaatacggtatgctttttatccaatacaacatgtttccctaaaccggtgtgatagctgtttggcgaagtcgagtttcacaaatttatagtctcttttggaaaaagaaaaggaaattaattcgtaggacctataaaagcttgaacttgttttataaaaattatgtaaaatttctgctgtatagattaaactaaacctagggaacaaattaaaggaaaagtgaagacaactctacgtaaaatgcaccttgctagctaagagacggtcaatgttgacgcttaattagcttaagctacttcttgatcaaatgcttgcacgcatgagcaaccgtttaatttgcacttaatctgctgggatgcgctaactaattggtacaccagtttggtagctagagcacgcactatacgtaattaggctaaaatatatatagtcaagtctctcttgttataacgcttttattgctgagattgatgcaccgactgaacttgaacgaacagtcgcaggaaccacactaccggctaatgctccgatgatcgagcatcattagtcaaccacgtacacggcctacttaaatgtagacaatgaaatggcagggaaaaataattttggtgtccttgcaaattgctacagcgaaatataaagcgttctcaatgcatcgagacatatatacatattcatgcatgcggcacataatttaatttgggggccgttgaaacagagcattcttacacaagaattttgctggaatgttatgacaagcattttgttttttaatccctccatactcgtaaaaaaagtcgttttggacagcgacacgatctccaaaacacaattttgacttcttgtttctataaaaatatttattgaaaaataatatatgtatacttttatgaaagtatttttcaagacaaatctattcatataatttttacattttcaaactcaacaaattgagagttattcataatttatatttccaaggtttgacttaaacattgtcctaaacgactttctttacgagtacagagggattagtacatattaagctcagtgaacatttttttttcgtgtgcaagattaatgcttgggctctttattttcagcttccctatcggattactgccgttgattatactcctcgcttctaaaaacgtgagttctcaaaagaaaaaaaaaacttttattgtgttgtactatttagaccgcttattctaagctggtagtatttgttcaactattttgaaatatttaatatctctaacttaagtagataattaacttgtggttgcaataatctggttcaaaccgcagagttatttactacccaaatcgatgtgtaatctcctgggagttttacctggttccttgtccgaggagactgcaaggtataagaacgtgccctaaaataaaaggcctttcagagggatctccggccggttgcatcagatacttggccccatgggacgggacaggggagatccctgggattaggtgccaagccgcggccgaatgacttgcaagtacagcgtctgttcaagcaaagcatttcctcgttctttagatgggctattttgggtgtgtttagttttttgggtgtaaagtttttagagtgtacggatatatatttgaagtattaaatatatactaattacagattctacctgtaaactgcgagacgaatttattaagactaattaatccatcattagtaaatatttactgtagcatcacattgttaaatcattgcgtaattaggctcaaaagactcgtctcgcaatttacatgtaaactgtgcaattgttttttttcacatttaatactccatacatgtatcaaatatttgatgtgacgtttttggtcaaaattttttgatctaaacaacgcctttatgttgtgtcccgtggttactatgcaactttgtcgagaacttttatggttctttaaagtatctcctaaaaatagtaaaacaactagtactattactatctccgttattacaaaataaattaatctaacacgagatatggcatattctattactacctccgtcccaaaaaaattgtatttctaactccaaggctttgtcccacaaaaattatatttgtagccatgtggggcccagcaaattgattgatctagataagattcctaatgcaagcagcaaatttttggtgccaaatccatttggcgctaaagcatgtaatttggactgctaatgcttgtaattaagtatgctgattatatgggttaattctctcgaatttccttttaatcattttgtatatatggaatgtgtgcatgcagtgggttcattaaataaggccattgtggtcattttccaatcatactgttttgtcctaaattaggtagaaatgtaatttttatgggacggagggagtactatgaatttggacaggtgatatatgtcttaccgttcatagtactagtatatgctacatttcgtactatattaacttattttagggcagagaaaatataacttatcatatctagcgagcgacaactcatgatgatactcactccctctgttacaaaataaaccaacctcctatgagatatgacgcatcatatacgatgaatatggacatgcttatgttcagattggttctttcaagatatgtcacatcttataccactgtaatagagtgtctaaattttgtattatgatgattccggacacgcttacgataatagatcaggctgcaacaaagcagatgcagcaccaataataggaagttaccacggcaacggaacaaacatttgcccggtgtccggtgatgacaacgacgacgatgattgatcgatggtttctgaatccgtgtgcacgcacgcgtccacgtacgcaccccgcatcatatagcccacaccgtacaggtccacagcacacaagtgacacaagaagtccacgtcgctgtagccgccgtggctacctcgccaaagcccgttgcgacggaacagacagctacggctaactaacgtacccccccccccccccccctcttttcgtctcgatcgaccggcaccgcaggaggaccaaccgaaaaactgctgcaccctccgttttatattatattaaatgtatttttattggtcaatttgatcaagattataaaaaaacttagcaacatatttattaaatctaatattaaatatatatttcgatattatgtttattttgtactaaaaatattattatatttttctatatatttatttaaatttaaagaagtttgaaaaaaaattataatataaagcgaatggagtacaccgatagattcaatatggagtatacagtttgcggactttataatcacgttttagagtcatgacgacgcacatgggcgatggatcggttggccacggccagatactgatcagattccaacggataacgcacacgcacacgcacacgcacatatcagagccgagctgccgtgtggccgatgccttctcctcctccttttcttgggtcatcgatcacctgcccattcgacgtgtacatgtatgaaagggaggattgaatgattaatggtcacttaattaattaacagtggtgcgactatgtaagctgatagcataacatacactgtatcaaagctgtcacgctgatatatcacatattccatccgtccaaaataaattaatttaaaatatagtagaatattatctttctatgcaacaaaacctgaacagtattttagggcctattcattttgatgaaaaaaaacttattaaattttagcatcaattttggtaactatactaaaattttagcaggatttcttatatagttaccaaaatttgacagcaaactaaatgtagccaatttttagcaactttaccaaaatttggtaatgttgaaaatgtcatcaaagtgaaacccttatattggtttattttgagataaaggaatagtatgcctgatggctggctggtaacgggcaatggatggacccaagcaaaatgagaggctgtttctttcgtgaagaggaaacgaaagaaccttattcttttttactctttccttgtcatgggttcgtgcgttcttcctgggccggggcccttgcgtgcggggcgagacctcttcgcttccacgcttccgtcccctgggaaggcaagggcgcgcggacagccgcgtttgacgccgcacacggcacatctgcaatggggattgggaaggcagcctcacgtttgcgacgacgacgacgcatactgcaacacaagttgtgggaaactagtaaactgctagcgtatgatttggccggggaactcgttgaccaatgaccatatctactccctccctccgtccttaaaaaaagataaaccctagtttccacgtccaatatttgaccgtccgttttatttgaaaaaattataaaaaaattaaaaagacaagtcacacattaaatattaatcatgttttatcatctaacaacaataaaaatacaaattataaaaaaatttcatataaaacggaccatcaaagttgaacacgaaaacccagggtttgcctttttttgggacggagggagtatctgtttatctgataataaagcaacgtgtgcagtacaaaagaagcatatgggcaagttccagtagattcgcttactgcacaagtatctgtcgttctcaggttgaaactgaaactctgatgtaagagtcatacaaacaacagtaaccgatgttatttctgcaccgagatatctcctcctcttcttctttagttctgattaatttcttcttgtactaaaacagctgctaggcaaagtcagtgtcaaattgtcaattgtcaagaacctgcacatattgtcaagcagattttaaccagagattccatgtggtccatattgtcatggatcgataagcgcaatatccaaatctctccgcaccactctttttagtttatcagtgggcagcaaacggcaacaacagcagatagtgctgaatcgatcgatgatagatagcctgatagacaggctaatgattctggggctgggagtggagcagagcagagttgggagacacaatccgagcaaaaacgagtgacgatccgtcctacatctacattcggatgcacgcgcgcgatactattatgcgaacagaccagaagattaaaagtggtctttgtcatcacgaagggcacacacatctggtccatggattgtgggagagaacgttctagctaggcccagcacgcatcattgattagtgcagattaatcatattgtctcgcattgttcaatgcactgtgtgtttttcctgtatctagcataaaaacacgatgacttttgccatcgttgatagtataaaatatctttgggcaatttgacatcaagagcactgtggacgagtctgatgtacgctgtagcctgtacgcatggcattttggtcctcaacttttggcctcggaacgtcagggcagtacctttgggttagcttaatccaaccctagctagctagctactctatccgtccttaaaaaggaaagataatttagatagagattttacatcctccagacaacgaatctatatgtaagattgttcagattcgttagtataggtgatgtcaaattctcacttatatccaaatttattattttagatggtgtcaaattgctatataaatttgtattatttttttttgggaatgaaaggaaggagtagtacagattgacagattctaggccgttttttctcagcattttctgacgatggaccatcgatcggtctcaccgttcgcctgtgcggtgtgtttgtccgagtgcgtgtcgcggtcgcggggatcggcgccggatgctgcgcgcccgacccatcaatggggtcggacccccacctcgcgtcttcagtgcagtggcgagagaagggaaggcgagggaccatgatggcggccgctgccggagtctggccgggtgcgaggtgtggtcaccggggcgaatgccgtaatgggctaagcctggacagtacgtgtccttgtcgatcaatgtgtcgccgtcgcacggggggctaagcgagcgtgttggtgccgcgtgtcgaggtagattttgcatgtgttggggattcatcgatccaacggccctcgcgcgcgcagttcatgcatagggccggcttttcttttttccttcttcagatgatggctgaaccagttgttcatgcataggtttgatttgtgtgatgcgagtatgcaacgtgaaggattatattgcgcacatctacactcactaaagactaaatcacctggtttcacaaacaaagtcatataacttaacttaagctcaccaaatagatgatgatggcagaacacacgcaattagagaaatgagaaaagaacatgtaagattaatgtaaagtactcggagataagactaaagacttggcagatgggcctaattttcaaattaatacaactcatatcagtaatacagggaagaaataaattcactttgaggacagcgtgagtcgcacatgtcagcagccaactttcttccttctttctctccctttcctctctcttcctcatctctttcctcaccctcctccttcgttatctctaaaacacacatcgacagtcgacctcctattcgagcttttctctgacccctgtggggtcgccatcttctccgatatgcttcgtcgcccccgcatttctatgtcttttttggttcttgatatgtgcgatttcgttgattcttgcccactactgttggttgctgcagcggtggcaacgagcggcagtcaaacaccatgcattcccgacctccttcgcatcccttcgatccctcgtcgaacactgacatagggaggaagagagagggccattaaatagatccagttgctcagaggacaccgccgctaaggctgcaaccatcgtcgaccccatcaagcttgctagcgatctccctcaccgtgctcaccgttgacctcttgtacatgcctcctcaaggaatcccaccgctcgccttttgccacaacccaccttctttgtgtcaaccaccgtccatctctacaccacccgccttccaacaacctagcctggtaagagatagggaagagggggagagaggaggaaggagtggcagctgacatatgtaaggtccatgctgactcagctaggttgattgtaatcaactggtcacattggccaaaaccgggcactatactgctctaaggtctctgatacaccagttttataagctgagggacatgttatatctggtattgcggtttgagaatgtaattcgaacttgacgtcaagatgaaggatcttaagtgaacttattcctacagggaatcacccagcccaaaaaattgggccatctggcccacggaggtaacctgcttcccaatttcccaaatctccgcgtcgcctccacgcgaggggctcgcgcgcgcgccttccccatttccccttcccgccacgccgagttaccgccattgggactccgactccgacttggagtcgacatgggagctccttgccctacatagcggcgtgggcctctcgatccccgcatccattccacctccgcctccgcctccgcctccgcctccgcctccgcttcttcttctcctcctccgacgtagcctgcggcctcgtgctgatggcgacggtgtcctcctcctcctcctacgcgtcctgctccgcctccgccgacgacgctttctactcgacgtgcttctgcggcccgatggtggtggcgcctccgcctccgcctccgccgcgcaccgccgcgtcgccggagtacaccccgtctaccccgtggcgccgggccgcgtcgccggattacaccccgtcgactccgtggcgcagggccgcgtcgccggaccacgccccgtccccgccgtggagcccttcgcgccgcgccgcttcgcctgactactcgccgtcgactcctccgcgtcgcgccgcttcgccggactactcgccatcgacgcctccgcgccgcgccgcgtcgccggattacaccccgtcgactccgtggcgccgggccgcgtcgccggactacgccccgtccacgccgtggagccctccgcgtcgcgcctcgtcgcggactactcgccatcgacgcctccgcgctgcgccgcgtcgccggactacaccccatcgacgcctcctcgccgggccgcgtcgccagactactcgccgtcttcgccccctcgccgagctgcctcaccggagtacaccccgttgagccctccgcgccgggccgcatcgccggactacaaccccagcacgccgcccccgtcgcctgtgccgtccgatgcggggtctcgcacttctccgccgtggcgccgccaccatccgtacctgaggagcggctccagcgccgcctgctcgtcgcgcgcggcgcgggtcgccggcggccggcatcaccatgtcttcctgtacggatactaggcgtcctgtaatagggcagattcatagtttgggttcttgatgtgagtgtgactaatgtatggcacaaaattatcttgtgcttcatctagtctttgataaatcgatctttgtattatatcattgatgtaaattgatccaattcaataaatatctgataatttgttgattttcctatcaattaatctgtgtctgtgattgatgattctttgtttgatcctctgatatataaactgaaatttctgttcgtctttgatgttgatctcaaattgtacaacatgtctgtgactagtgtaattgatatgtcccttgaaagaacttcttctttaagttgtgctgcctgtagtattgaatcatcgatcagttccagagtagaatatcaggctagtttcagataatagaatttcagactagtttaagataatagaatgtcctgactactgtaattgatatattatttgaaagaacttctgtagttgctgtgcctgtattcttgtagtgcagtttcagagtagaatctcaggctagtttcagataatagaatttcagactagtttcagagatcagaatttcagactagtttctgtctttcagaggatatattcagactagttttagagaagataacataatttcagactttgctacagacccactgttctttgtgacataaaaaacaacagcctgacaatctgaatatctgacagagtacattgtttccataaagggcgaatttagagctaacctccatatattggcagtaaaactgaactgaaatccttctcaaacagaattacggcaagtctgcaacttaatcccttccatccaaatgaacccttggagagttcagcaatgaatcgttgaacttcacagttaagaacaagtagcacctaacagcatggaaatcccttcttacgcctaataccctcgccaatcgactccttcatcgacagcatgatttccaagttccaaccttcaaacgaaaagcagtttgataatctgtctgttgctcaagctgtatattgagcattcccatccgttcgacaacacgaaagctctgacattgctcagattgcttcctccatgcgaacaagacaatggtcatagtcatagattcagcttcgttttcttcagaaatagaaattcaggttcagcttcatatttcaggggcccttgactacatgaggcccaacacaaatggtagcctggtaggaatggtcaagatgacaacagggaatcccagatgtccaccccaaaaccaaaacattcactctctccgttcaggttcgtaccagaatgcagtaatttaggatgggtatatccaggttcctaccagaatgtaactatcaaaggatttattaagaaatttcataggattgaaatcctataggaaaatatcctatttgggcctttgattcaaatgattggagttttcgaaatcctatataatttctatggaatgactcattgcatgtaggttttggagaaaatttaacaagaggtccaacctcttggaaaaattcttttgagtctttttctttcatccgattcttgcgtttttcctgtggcccaattaaacgatcattcatgtgttttacaatcctctattttacacttcacatttctgctcgaatattgtgtttttctattcatctattttttttcattcctacgatttaaaagggccctgaatagaggacaataccctaacttccatccatgtattgattgagtttggtcttaaattttataaatcgtcatgaaagtttgtaatttttctttaaatgtaagaggtcacgaaactggagtacgggggtcattgtcttttgccttgggccaaatttgctacaggacactcaaagtgagacacccaaaaaatatgtatttgcttgtggacactgcaaaaatatggtaattagttgctgaacacccacctcattattttattattttcggtggtaatggagaaagaaacattggttaaagacaagtttgcccatggcccacttgtcaatctctctttctctatttctatgttcatcttcttcggttcttcctcctgcgtgcgtgctgctggcctgctaccttcgcaggccaccgcgtcccggtggatgtgctgccccccgacgggaagctcctcgcctcgtttcgcacgtcgcttgggtcgttcctcgccgcccaccgctcgccgctgccgcgggaggaatgtggccggcgtgatgagggacctcacgggcctcctcgggcaccattacctgacctgcaccgtggtcgggaacagtggcgtgctcctcggctccggccgtggcccgttgacgcgcacaacctcgtcattcacctcgacaacgcacgcgtggcggagcagcacccgcgggagaagaaaagagaggagaagaaagacacgcggcatgtggccgctcaagctagtgagctttgttccctcccgaccgctcgactcgatggctgcttcctgcgaccccatatcggctccactcgtcgcgccgcatgacgagagtggagcctcccttcacaaagccggcgacgaagcaaagatggtgacgcggtgcgcggcttcctcgatgatgccgatgacgtgctgttcgggcagctcgccgcagagcacgcaacgaggaggcggcgtgcttggacgcgacgacgtgggcgggccacggtgaggtgatgaggtcgacaaggcgggcggcgtgggagcgcgacgcgaagaagtcgagcccgccaccgccgccgcgcaccgcgccgacgcggagggcgtcgccggcggcgccgccccgtcgtggccgagccgtcccggctcgggccggccgccgtcgctctctgctccacgaagaagaagaagaagaagaagaaggggaaaagaaaagaagtgagaggaagaacactgtataggggtatttttgtaattacacaactctttctctctcaattttgattggaaataataaaataatgggaggagggtccagcagctaattaccactttttttacattgtccacgagcaaatacacgatcttcggatgtctcacagcaaagaccgtaatatttcgatgtactgtagcaaattttgccaatgccttgggcctctgcaactggatccagtcactgggacgctaccacttggtcctaccgccgtggcgctgccggtcgggatctgcatcgcttgcatccgtcgggacatcctcatcaagctccagcccccaccaagcttgatcccgagaggcaacaccgttgtttcatttactagccgtctctcggaccaaccgcgccgcctcgagcttgaactcctcgttgctcagagctcgcgcattcaccagtagcggctgccgcatgggggaggacggagaatgacaaaaacaaaggtaggtgagaggcagaggagagataggaaaaggagaagaagatgctcacaagtcacaagtgcagcccactgatttttattatttttgactgactggattgctcgtatgatccaaaccgctttggattgactagggattttctttgtccggtttaaaaaattcggggtataaattgtttgatttttttagttaaggataaaataattttagaggtaattcagatctcttcttaataaaataatatttttaaagatatatctcagagaccgtgtcatcgtcaaaaacattagaattatagaatcggagggagtatgtagtatcaaattctatacgaggtttttgaaaatgcatctaggcccctaatgattttgatgattgattacaatgcgattagagaggactaacatttttattcaagcaaatgtgaaggttgttaaatcctcaacgtgttgtaatacaatgcatatcctgtgaatgcgacatcacgatgcaatgcggcaatgatcaaatgttatattgtatctttttcctcgcattgtgtcgcaggaaagtcgtactattaagggggatgatgcatagacatataaggagtgatgtgtgtgctcaaaatcaatttctcttttggagcgttctggaaattttcggaagttccgaaaagaatttggaagttccgaaaatacacaggaccgtttgagagctctctggaaattttcggaagtttcgaaaatgattttcggaagttccgaaaatacacagaagcgttttagaaattttcggaagttccgaaaagtgcgttgactttgattatttctcagatctagaattttcggaagttccgaaaattgtttcggaagttccgaaaattacttttattacactccaacgggcagatttgtgctgtgggtataaatacccacctcccctcactttgtgagggctgctggtttcattctaattatttgtgcccttggcttgctctctctctagttcatttgagccttacttcctcgattcatctctccacccgtgtttgattccgatttagtgtgtgtgtgagagtgtggattcgagtttatgtgggtgcttcttgtggtctttgtgaagatttgtgagcacttgcataatctccgggagttctttgcatcatcttttactcttgaaggttgaggactcctagacggctaggtgtcactcccgagtcaccgatctacttgtggttggccgggagaagtttgtgaaggccggatctcgcctccgcaagggaagagatacctcttagtggaaggagtgcttagtgcaacctcttgaggaaagggttagctaagacccggctcttagtgagctcctcaacggagagtagaatcccccaaggatttgaactccgggaacaagtttgcaagcttcaccttggtgatatcttttcatccctctcctctaattttgcttgcttgtgccgctattggtctagttgttgtatgtgcctttcttttcatgtggtagtcttctagatctagatacttctgtttgtgtgcgctcctctgtgcattttcggaagtttcgaaaatcctttcggaagttccgaaaattcccacccaagttccaaaaattactgcttccgcttttcttaagtttttaaattggcctattcaccccccctctagacctaattgaccttttcagtttttacattttgatactatagggagcagtttccttcaactagttgtactactacttattttgagatgtagagaggactatgggtgtgtatagttctttttgtgtaaagtttttgaagtatacataaacacatttgaagtattaaacgtaaactaataacaaaataaattatagattccacctgtaaactgcgagacgaatttattaagcctaattaatccatcattagcaaatgtttactgtagcatcacattgtcaaaaacatgacgtaattatgctcaaaagattcgtatcgtaatttacatggaaactgtacaattgttttttttcacatttaatgttccatacatgtatcaaacatttgatgtaacgttttttaccaaaatttttggatctaaacaaagcctatattaacttattttgggctgaattttttacaatttgaccctttgcaaaaactatttttacaaataaattgttgccaaaacttatttaaatcacctgacgctgaacttagacaactcagcgccatatcaactgacgctgaatgcaatggcaccgcggatgggagactaagtcagcgtgccaacgcatattcagcgccacgctttggcgctgaggtgtctaagttcagtgcctgaacaaaagggttatttttgaaataagctttagcggcggttcatttgtgaaaatagtttttgcaaagattcaaattgtgaaaatttttgtattttgggagtatagactagtagtggacgtttataaacaaaatcctccgctaaatcaccctcaaaacctagatccctgtcttgtcacggacaacccccccgccgcagagcccacctcctccctcccctctctctctctctctcctaccctaccaccatggcgtccgccgagacccccaaccccgacgccgaaatccccaacaccgacgccgccgccgccgccgacccagctgccgccgccccagctgccgccgccaccgaccccgccgccgctggatcgccgtcgcccccgctcccgccacgcaaacgccgcctctcccctacgccctcccccacccgccgctcctcccgctcccgctcccgctccccgcgccgcggccgcagccgcagccgctcccggagcaggagccgcgggcggagcgccagcccgcggtaccccgatgggaagcggaggcggcacaacgacctcaacgtcgaggtgtgccgcgacttcctccgcgacaggtgcgcccgcgccgacatcgagtgcaagtacgcgcacccgcaccccaccgtcgccgtcgacaggtaccgcccccccaccgttcccggagatctcgcctcccgctcccccccccttcctgcggcgcccgtgtctgattttggggggttttgtatgtgcagggacagcaaggtgacggcgtgcgcggactcgctgcggaacaactgcttccggggaaggacctgccgctactaccacccgccccctcatatccaggagtatgcgatgatgccccgttgctgtttgttccgtttgcattgcgtgcttttgtcgacgagggttggtagcgtgtatggtcttatgttctagagatgcacaagctgctgcaagtccatttattgatgcaagtcgattaatactcgattagtgcttccaagcatacagtcttccgtttctagttcaattcctgaaatattaacagcatcatggctacatgagatcatgctctactgtgctatctggaggattaaattagctgcctgacattgtttttttacttgtgcttctgatggaaatttcttggaacaatgttttatgagccactttctgtattaaaattccattatcgtgtttttatgttctcacagtttttatatttcatgggcatgtgtacccatgattccctcggtgtgttgtataggtgttctcacacattttatgtgttcagagtttggctgtttgggagaaaaacttgttttttctactttattctctctgggtaaattgatattattttgtttttttgaacattatgtttactctcacattcaggggcgaagccaagatttgagattaggggggggtgtgggggtgaggataagccatgagaccaaataactaatattgatagcaaaggaggtcaaatagtcaccgtcaataacaatcaatgcgtaaactagtcctttaaaaaaaaacttgaattttagatctttaataatatcattgaaagattgaaactagcctttattgctaaattctttcaatgtaaactattgaataatctcacaaataagtatcatctattttactttgaaaaagatgagaaatcacaaactaattttgtatatcatgtttcttgctaatgtttttggacttgctaactaactaaactgataatactttcaagttacacaaataaactagatgaatacttatcttaattaaccttaatatagagtaaaaacaggggggttgtggtggtggtggtctttggatagcggggtgttggcaccctccagcacccccctagctgcgccactgctcacattacgtagctctttatttgacacacacacacacgtgtatgtgctgggtgctatatgggagaagctttagatttctaggttaaaggagacactggagtggaatgatgcagaatgctgaaatgggaatgcactgtattttatgctagtttgcgattgaaaagaaaacttatatttgaatgttgatggcttgttttgtgacctatgattatctctttggaggcagggtagcatatttttgtaaatgaaatgcaggcattggatgcaaccagctgatcccaactttcttttgtttcttttacgtaggtcattattgagatcaattggtgtggaagacccaaaggtgaagatggtaagtttctcctgtttaacctttcatctgttcatcaatcatgcatcggtttgtcatttctctaagtagttaatggttttttactatctattgtaaagctaattggaaaggttgtttatctgcttcaaacaagaaaaaaaaggtagctaattggctgatgtcgcatggtatgtccataaggaacaagtaatcttttttgaaagctagaacacatagaagggctgtaaaccatctatcacctg

SEQ ID NO: 74706 - DNA, 587 bp, Oryza sativa
tcaaaagattaccatagggtgagcctaatcacggtatatctggttgaccgcatatacccgcgggcacgactacccgaatagttttactctgataaaaggtgtacacctgtacccacaagacacagccccacgacacgtttccgtgcgccgacatgccaccacgacataccggaaagagcccgtaacaggacccttcgcataaccccctctaaccaagcacaccacacctcaggtttcacccccactcctcgcaaggcagcggccagtcccctctcgtgcctacgtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacagtaccattagaaccaacagtctaaacattaatagg

SEQ ID NO: 74707 - DNA, 660 bp, Oryza sativa
ctacagctattagaacctaagtatcatgtgatacctcgcaagtatcacatgacaccacacaggaatcatccgacaccgtacctataggtatcagaacctgatatcgtaagtatcttgtggtacctggtaagtatcacttgatacctcacgagaatcatctgatgcatcgcatgtatcgatgaatatcaagtgatattgtcgtaggctttccggaccttccattatatttgagggatgaagtgaataattcaagtcatcaaacaaacataatgaaacatccgacacctcgagagaagaatattggagacattgctgggcctttaacctgccagtcaacttcaacctgagatgtgcccgtcaaaccactcgaaggcggcgaccagatgtgttacacattcaggagacttgacaaaaatggctaaagatctacaacatctcaaatattcttaactcatactcatgtgaatctagttcccaggatgtgcaatagattcacactttcatctcaagcatgattatacatagcaaacacaaataagatgaaagcgattataaactacatctactttagttacattagccgaccggccaaataaatatatagaacagcggaagcttgtctacccaatccacaagcacaccgactaggggtttacccca

SEQ ID NO: 74708 - DNA, 15656 bp, Oryza sativa
  unsure (1)..(15656): unsure at all n locations
ttttatcatgctaggtaagaaactgagttttcttgttgaaatgatgaatagttgctctgttttatatctcttttatatgggttcacgctagagtactctctcaaagattgaaaaaaagtagccacatattatccgggaacctgaggtaagtgggctgcacttgctgaactaagtctaggttgttacaagatatgagagagtaataagagctgctatgatcccgttctaagtttgacttaaactccggatgttttattttccaaaataataaactttgaagttcctcatttaatataaattcctaccagagccaaaaatattcacattgacaaacattatacattttggttacttgcaattccattgaactttgtcaaattcttgtgacttgtgtagatacttttcatgctctatgattaagatcatacacccacatatatgtacatgctaaactcctacactaggagctagcatttattgattccatttatccacaccaccatcaaaataaattctccatgcttttatgtgctttcttctcctaaaaagaaaatcctttccgagaaaaaagagagaaaagggagggaaagtcatggttatgaaaataataaagttatgctccctcaattatgagcatgatgatggaaaaaaaagagaaaataatgtgtagccatgccctctccttacttataaaagaaggatttttggagaaggaagtaagcacaacggagaagcattttctttatttttccacatttcatttccaccatatatcacacacacacacacactttgcacgatcttgatcttgagtatgtctagtcatctactctagtataagcttttgacttagtaataaatgtgaatacaactatgtcatgtttgatacctaccaagctccacatattaaaccttagagcagaaatcaaaaaggccactttggtgaggaattcatatttttacacttgagtgatcgagagaatcatttgaggaacttgattttcttttgaaaaatcattttaaaacttccggaataaaagttgaataaagattgagtgcttagtgctcaatttactattctatcttttaaccgctcaagacaagataaagtagtgtttcgcaggaatcaggtgtaaaggtaagccacagtgataaaattattcgatctaagagagaatacacataccttgcactggtacatttgaggatatacaatatagtagtagctcctgatcaacaaccaggtctttgttcccttttgtcctttactctgttgacggtcgttatagatcagtttcacccgtcaatattacccaaaataaaggagaactagttatgcttacaatgcatattgtgttagaataaaataaaatccattagtatatggtttacttaccccttgcagagaataagtacaaaatggcggagaatcgacatcaaaatagatgatcaatcaatcggacgatgtcgagaatcagatttatcaatgaatggcccaagaactaaaaaatgacacgaccaattgggccaaaatttacaagtttgaagtaagctataggggaggaggccacctgccaggaactgggctggttgggccaacccaggattcggccgaacaagctgcagcgccgatggatgcagggtttggctggacggctgtgattgatccccaatgacggttggtgggtattactgacctttccaaccgtcattaccaacctatataaacccctcactctctccatttcaagacacacctcaagcaagctctctcatactctctcaagcttagtttagtattctcaagctagtggagtaggaatagaatagaagtctgagttcggaagtcttcggaagagtttgggtatggttctagtagctctcatttcttctttcgtaagacttgtactttatttagccccagttgtatggtcatgacggactatcgtaaagaacttggtagtcaggggtggcttctcgaagtaccaggagggcatcggaaagagggcattagctagttaatcttatagctaggatgtatgtataatatgtatactagaagtataggaatagattcttttctattttctttccacttagctcagataatttaatatgagagtgagtagtcttatccttgtgtgtcactctaccctatgcttatcttaacccctgcttagacataattattacaagtaacatataaatattagcttggttctctctattataatcttcctatgggattaaacaaatacgatacccttggaatactctcgggtgaaatgctacaatagtacatcgtgctcttgcggatgaactctatgaccataatataccagaagtatttttgtgccattgctgagaattatatttctagtaatgtcgttaagaaataccaacagacatcccatataattacaacgccatcttcggccgtgctaccttgaacaaattcgaagctatcgcccaccacaacttcctcgagttcaagatgcctggcccgaccggagtgattgtggtcgaggggatacagccttcggtcgcagaagagggcgaagcggtggcaatatgtagagaagtgtacaatggtcaagtgcaagagggcgaaagagcaacacttgtgctgaagcagtcaccgtatgttaaggtgagcaaggtccaaattgacgaaactgatccaagcaagatgatctccctaaggggtgaccttggtgaagccgaagcaaaaaacatcctggccgtcatcaagagcaacattgatatcttcacatgggggccagatgaagttggaggcgtttcgccatatctcataatgaaccatttggcggtcaagccggacgccaagctaagaaagcagaagctacggaaaatgtcggctgatcgctagggggctgtaaaagcagaagtgtagaagttactcaaggccggcgtaatctaagagattaaccaccctgagtggctggcaaaccctgtgccggtcaggaagtcgaacggcaaatggcaaatgtgcattgacttcactgacctcaacaaggcatgtcccaaggatgatttctcgctctcaagaattgaccagctggttgattcgacagccggctgcgaacacatgagttttttgtatgcatactctgggtaccatcaaatactcatgaatccggacgacagagccaggaccgcattcataactcccaacggcaccttcttccacctcaggatgcctttcggcctgaggaatgagggggcaactttcgcaaggttgatttgcaaagtcctttgctcgcagctggggtgaaatgttgaagcttatgttgacgacattgttgtaaaaagccgaaaagctttcgaccatgtgtccgatctgcaagaaaccttcagcaacttgcgtttggcagggattaagctgaacccggagaaatgtgtttttggtgttagagctggtaagctgttcggatttcttgtgtccgaaagaggcatagaaaccaaccctaaaaaaatcggtactattcagcaaatgcagccaccaaagcgtgtacgaaaaatacaaaagctcccagggcaaattgcggctctcagccgattcctatcaagagcagcccaaagaggtttgccatttttcaaaaccctccaaggggctggcaagttcagttgtacacctgagtgtcaagccaccttcgatgagctcaagtagtatcttcagtgtccacctgcattggttagcccaacggcgggtagcgagcttctgctctatctagcagctttgcccgtcgccgtaagtgcagccctagtgcaagaaaccaaagttggccagaaaccagtgtactttgtgtccgaagccctggaaggggcgaagacaagatatatgaaaatggagaagttagcatatggtttggtaatggcctcaataaagctgaaacattatttccatgcccataaaatcatagtgccttcgcaatacccaataggcgaagtgcttaggggcaaagaaatcactgggcgattgagcaagtgggcatttgagctatctcccttcgacctacactttcttgcaagtctcaagttctggctgacttcttagccgaatggactctagccttcttccccgaacctgagccgatcaaccaaccatgggtaatgtactctgacggcttatggtctcacaaggggtgggagttgccatgatcctaacttcgctaggaggcatgccgatccgctatgctgcccaactgcagttcgacacaacgaacaataccatagagtatgaagctgtgttgatgggcctgaggaaggcgaaagctctaggcgtttggcatttgctgattcgcacgaattccaagctagtggcaagccaggttgataaatcttttgaggtgaaagacgacactatgaaaaaatatttggaggcagttcgctccatggaaaaatacttcactggaataacgttcgaacatttacctagagggcataataaagaggcagatgctctggtggtccacattcacctagggtcttttttgcaccaagtgtgccaaacctcattgaggacatcatggcaatcgaccatgctgagttgggcgaagacccaaaagactggcgaactccgtttgtcaagtacctaaaaaccggttggctacgggatgatgaagccgaagtaaattgcttgcagctccgagcagccaaatacatgctggtctccgaacagttgtattgatctggggttctacacctttgcttcaatgcctctctgctgtcgaaggtgaagatgtagcgaaagagatacaccaaggattgtgcggggcacatcaagtggcgagaactattgcgtccaaagtctttcggcagggcgtatactggccaaccgtcctcaaagtatgtgatgagcagatcaagaagtgcgaaagctatcagcggcatggccgaagtcagtccattccccagtataagctacaaccaatcgcaccagtatggcctttcgctagatgggggcttgatataatcggcctgtttcccactgtccgaaatgggtatcgcttcaccattgtggcagtagagtacttctctagatggatagaagcagaaccgcttagctcaatctcttcaacagcagtacataagtttatttggaaaaatattgtctgtcgattcggtgtacccaaagaattcatcactgacaatggcaagtagttcgattcttaaaaattcagagaaatgtgcgaggggctaaaccttgaaattaagttcgcctcggttacgcacccgtaggcaaacttggcagccgaaagggcgaacggcaaaatccttgacgcactaaagaaaagattggagggggcaccgtagggtatatggccagacaaagtgttatcggttcactaggcccttcggataacgcctacgagacctaccaagattagctccttcatgctcttatacggcgatgaggctatgatgccaagtgagctaggggctaattcgccaagggtaatcttctctgggggtgaagatgggcgtgaagtctcacgcgaactcctagaaggggtgtgagtcaaagcacttgaacacatggcgaaatacggcaatgacactttggcatcctataacaagaaggttcgaccgacnnnnnnnnnnnnnnnnnnnnttgtgctaagaaagaaggcgaaccagatggtcgttggaaaactgaagtcaaagtggaaaggagcatatcttgtcaagcacagatctagaacgggttcttttcagctggcgacattggagggcgaagagctaagccactcctggaatgccgcttcgctcaggcggttctatgtgtaaaacataggtggcacccattcaccagttgtaaatatgtaaatatggtgttgtaagccttcagcacgaaaatacaaaaaaaaggaaaataaaaaaagaaaaaaaaactagatgaagggttattatccattctggaggcccgaaccagtataaaaatccctgtgtgtttcgtctcttgtgtgaatgatgtcttggaaaaaaaaaacctctaaggcaaacacctgcttaacgaaaatgacaggggtgcgaagtgaatcggtcaaagcatcgctcactgaacactaaaattacaacagctcgttttcgatcatgcatcgatcatcgcattaatcggcttacaaaaagcacttagcatttttaaacgtttgctaaagatgagaccgaggtgaaagacgagagttgagaagtcgaacactcatcactaaaaatgaaaaagggtcgaagtaataagccctcaaacaaacgaagcgattaaaaaataacaagaggaccgaaacaggcagacctggatggtcgaagtatattcacatgataaaaaaaatactttacagatagattacaatatccggatcaggacattttcgccttacccctgttacctcagacgaacatggttcgtcatcgctacttattttatatattactctaaggggggaaggaggtgaaatgcacgccaaactataccgacgtcaagcaatagcagcttggcaattggtcatcttgaagtttcgccaaaacatagctacatttttgcggcgttggacatgacaccggtcgtaattttcgaaagatcggccaggatgtcttcgcatccagttcgccactttgacaaccacatagttatttccgttgataaccatttcacggtatacgggcttgcacgaatacctaatctttggtaagcccttaattgtgacaatttactcgtttgcgctttgccagtctttgaaaggaggctgaacgcattctttacgcagtggaacctgcgaagaatgtggaaatacatagcaaatcgccttaagaacaaagtcattcggaaaatttgcaagtttaaggcaagattctggcgaagatttccattccattcacataaacataaatgccatttcggctacataaaagcaaatcgccagcagcaaacaaaagctgaaccaagaaaaatttacatcaaaagaaaagaaggcctcacacctcacgatggtcttgcatatcttcgtctcttagtagttgcagtagtcggtcagggccgcggcctccttcttcgtcttttccaatttggcctttaagaccttattctctaccttcgcctatttaaaggcgtcggcgacaacctcattgtagggatacgcgcaggctatgataacataaatcaaaattttctagcacataaaccaggaaccatataagtattagatcatagatcgttaccactcgacatactgtgtccacattattaatttggtatctctataccatgatccatgagacatgatcatcaattaatacatgtgctgatcattaaacatatttgttccacatatgatatttgatcagggatcctttagaaatagtaacatacaacataaagagtctcatgaaaaaatcacatattcattaaccaataatgagttatctatttcaagaaacaatatcggataaatatgtaaacatagtatgtgatacaatcatctatatgattgcctctagggcatatcactaacagtctcccacttgcatatctaatacccattgccctagtgtgcgcctcatgcttagcctaagggagtggctttgtcaacggatctgcaacgttcaaatccatatgtattttgcatatcttcacatctcctctacccactatctcgtgaatgaggtgataccgccgtaaaatgtgtttggacttttgatgcgatctaggctccttagcttgcgcaatggcaccactattatcgcaatagaggtccatagggctggaagcactagccatcacacccaattgagaaacaaatttgtttatccaaacagcctcctttgctgcttcagaagcggcaatgtattcgggttttgttgtagagtcagcgactatatcttgcttggaactcttccaactcacagcgccaccatttaggcagaacacaaatccagactgcgatctaaaatcatctttgtcggtttggaagcttgcgtccgtgtaaccatttacaacgagctcttcctgtcctccataaactaggaacataaccttagttcttctcaagtactttaggatattctttacagcaatccagtgactcttacctggatctgattggtatcattttgttgcactaagtgcatatgaaacatctggacgtgtacataacatggcatacatgatggatccaattgccgaagcatatggaatcacactcatcttgtttcgctcatcagtcgtttaaggacactgattcttgccaagattaatgccatgtgacatcggtaagaatcatttcttagagtcttacatgttgagcctcttcaacaccttgtcaatgtatgtactctggcttaatccaattagcctatttgatctatctctatagatccttatgcccagaatatatactgcttcccctaagtccttcattgaaaaactatttttcaacgatgtcttaacggattcaagcataggaatatcattcccaatcaacaatatgtcatctacatataggattaaaaaccacctctgccagttgagctcattggtccacatacattagtatgtactagtgccaatagttcacttgccctttcactttgacccgtgaaaggtgcctttgtcattttgccaagtaaacaagattcacatgtctcaaatgattcaaaatcaaaagagtgtagaagtccatctctatgaagcttctccatgcgtttctcatttataagacccaagcgacagtgccaaataaaagtgggattcaaatcattaggacgttgccttttcgcattaatgttatagactgaacatccatcaagattcacaatgtataagccattcatcattggtgcatggaaatagaaaatatcattataatagattgaacaaccattgtccactgatctaaaaccataaccctctgcttgcaaacaagaagcagagataacgttcttacacaaagctggaatgcaataacaattatttaactccaaaactaatcctgacgataaagataatggcatagtgccaaccgcaacaacaacaactcttgctccattgcccacgcgaatgtccacttcgcttcttgctaagctcctacttctttttagcccctgcaacgatttttatatgtgagcaactgacctgctatcaaatacccaagaatcagtagaggaagtagcaagattaatttctataacattaatacctaaggtggaactctttccatcctgctgcatctgcttgaggtgctctaggtatttcctacagttcctcttccagtgacctgtctccttgcaaaagaagcactctgtatccttagcgggccctgtcttttgaaccttggtcttagagttgccagtactcgtgatctcatcagagtttagctttctcttttgaccagtcttcttgttattgggcttgcgcttatgcataaccatcacatggttagagtttttcttaatgctttcctcggcagtctttagcatcccatacaattcggccaaggtcctgtccatgttgttcatgttgaaattcaatatgaatggctcaaagctgggagggagcgactggagaaccaagcttttctagactctcggtgtacccaatcattttgatcacatggggactcactggtttaccttctgcaagcctgcacgcaaacaaggactttgaggtattaaacctctcagctcttgcttggtcctcaaacatgttatgtagtcccatgattatcgtatgagcatccaatgtttcatattgcttctgaagctcaagggacatagtagcaagtatgagacagcttatatcaagataatcattgcatcgcttttcatgatccctacgctgagcagtactagcattgttgggcaagttagctggaaaaggctctttaagcacaaactctttgtgctcttacctgagaacaattatatatatatatatatatatgcaaaattagcaccatgtctacatttaatcttttattaaacaatttaaaaaaagatactcccactatgtgttgtgaaacaaaattccctctagcaagatcctcattttattagtgtctagtgagctttggcatcacagctagacaattatcaaaataggtaagcaacaccttgctaattacatcatatgtgactcttgtgctgttggggtgacatctccatatagcaacccaacctatgccccaaggtccaaaaccgttttgataaccttgttaagtaaaccaataatctccccatatagatgtccgacatctatcctattttatcatgataaaaagtgacactctgctatggcaaacccatcacttataatcacaaccgtaataggtgcaactattagaaaagcataaattataattaatttttccgagggaatctatcctaccatgtcatataaaatatacaacagtaataaagtaagatagataaacatcatatgctagatatagaatcaaattctatttattaatataaaaaccaagcgaaatctaagggcaacgcacatgggggttgaggggggagccgtcccccgcgggtttcagggcagcgtcctgaaaaggtcacggggtacatagatctcatctacgattcgccatatgaaaaccttaatagggtaatcaaattatgctaaaaactaagtcaatctcattggttcatttttctcattggcgtgcagttcgagtggatatcgaactatccgatgaacacaatcttgcttggccgtggtgagtactagacattccagtaaagtcaccaacacatataccgattgatctcatcaacccatgtgcctattggtccattacatgttccgatcatccaagaactcaactactacataatagatctcatctactacgcccgcatatcaactatatgcaatgacctagatcataaactatacaaggcggctctgatagcactgtagggatacgcgcaggctacgatagcataaatcaaaattttctagcgcataaaccaggaaccatgtaagtattagatcatagatcgttaccactcgacgcactgcgcagcggaagaaagcgctaaggaggcgaagcaacccttgcgaagtagcgcgcgtcgatgtagaggaagtagtcgatcgcaccggctcgaccttctcctcctcgagcgttctcctcgccatactcccacgccgatcaacaccgcaaagcagcggcgcctctaccggtatccatacgtatagggacggaatgccacgcgcagatgtgctaccaaccgcgcgcggctagggttttgctcggggaggggagtggcggctacggtttctcacgtgatgcaatacgaccgccagtcacacccctcacgaatatataggatgcatgactcgggactccaaggcccgtaggactcctatttggatccctatccgaattaagctcatattggatctccatccaatccccatattctggcccattaagcgtgcaaccctgtaggttcatgtacaatcggttgtaacccgaaaactccttttcggtccacgtgtcaacagcggcccctagcagaatgtattgacccaccgggcatacataaagatcatatcgactgaatctctagtgtatacaagtatgaacccctttgcctcatgatttcgattaagctcaaggctagatatgtgccatcctctaatagctcaatcattcactcgaacctgtgatagattatataacttgtgattgactcctcaatcacctttggcatggccatgcacttccataatctataacatcgaggggcccagagatatctctccataggaaggacaaatcccatcttgattattcatatcccactacatgtttcatagcatacctgaaaactacttttataactacccaattacggagtagtgtttagcagtccctaagtaagttactacatatgttgggaaccatgacaatctcaggtctaacgattcaacaccaacactaaatgagatcactgatgacataacacatatggctcttgcagtgtcttatgttgggtctatccaacaacatgttccctaacatgtgttcacattattaatttggtatctctataccatgattcatgagacatgatcatcaattaatacatgtgctgatcattaaacatatttgttccacatatgatatttgatcagggatcctttagaaatagtaacatacaacataaagagtctcatgaaacaatcacatattcattaaccaataatgagttatctatttcaaggaacaatgtcggataaatatgtaaatatagtatgtgatacaatcatctctatgattgcctctagggcatatcactaaaactcatgttccaggtctttccgcccaagctcctccattgcctgaaggcggttcttgtaaccatccaggcgagccccgacagattgttcgatgctactttacgccgaaagagcctgcgagcaaaaagggggaaggtggcgaaaatatttagtgcaaaaagaacacttagtaaaaaagcgtgagaatgaaagaatgtgtactcgaagaagtgtgctcttgaccgacgtgcagccctcgtagaactcattgagatccatgaacgggctaggcccacccgccggtgaaacgagttcgttctcccccccccccacgatgaagggcataagctccgccctcaaaatctaaagggacaaaccgggggagggcggtgagggtgtttttagagtttgaactgtcgggggcgcgtttccctttcctnnnnnnnnnnnnnnnnnnnnntgcgcctaaaaagatcaatcttcgcaggcgacgcttatatggcccgcctgcaaagatgcccctatatagtcttcttcctccccgagccctgttcattctccccgacgtttctctctcctaaagtgacttaaatatagggggggaggttttgaacttcaaatcttcgggggatttttctacggtacttagatctactcatttccacactaggtatgcatttttaagcttttagaccttaatttgtgatggatttatgcatccaaaattttgaaggaagagctccatgttttttaattttatttcttgtcatatgtttatgttagatgtatgcgtaatacttgatgcctcttgttgtagtggtttaatgtggtaacataaattctcgttttttaatttttttgctatcatatccaccacctagttctagatctagatctagatcttgtcatgtatagagagagaaaaaaaatttaaatgtctattcattcggtgtaatcaaaaaatagttatagtattttgtaatatgccgatgatttgattttgttagattttcctaatgtactaatttggcatgtctgtgtaaaaaaattgaaataaactatgattttttattactttacacttaacttttagttaattagtttttaatagcgataagtttttcaataaaccctacaaatttggtattaattgtgcaaatattttatgtgtattttttagagatatagaaagtcgggaatggatgtatcattggccgaggtttttatctccatatagaaacgaagtggctaaatttattggtattgccaaggttcacgctgagaagaacaatatgaggaagataatttgtccgtgtgctgactgtaagaatgaaatagcctgggactttgacgatgcttttaaagtgaaggagcacttagtaactcgcggatttatggacaagtacgaaatatggacacgtcatggcgaagaacatgtggacgagcctgaaaatgtagttccgaaacaagttgaagacatggtgcatgacgatggttctgttgaggacaaaatcgacctagaggaaatgttacgtcatgcagaacccgaggtgctgatggggtcggcaagagggctaaataactttgaagctttacagaaggcagcaaaggaagttttgtacgatgagtcgaagggctgtgacagtgatttcacaacactccggtcagttcttgaacttatgaggttaaaggcgagacatggatggtctgataccagtttcgatagtcttttagaactcctgtagaaaatgctaccgaggcctaactcactaccatccaacacatatcaagcaaagaaactcatatgccccctttcacttggtgtggaaaagattcatgcgtgcgtaaatcactgcatactgtacaggaaagagtacgcttctttggatgaatgtccaacatgcggtgcaagccggtacaagtcgaatagcaatactagcctagaaccctctgaagcaactgagggacgacagagaaaaatcccacagcttgtgatgtggtaccttcctgtgaaagaccgcattacacggatatactcaaacccgcgagatgcggaactaatgcgctggcatgaagaagggcgcaagaaggatgggatgattcgacacccggcagatgctcgtcaatggataaactttgatgcgtagtatagagagtttgctaaagacccacagaacattagatttgccctgagtactgatggagttaatccttttggagacatgagcagttcacatagtacttggccagtgcttctcaccatgtataatcttcctacctggctttgtcaaaagcgaaaatacgtactactctgtatcctcatacagggaccccgtcagcctggtattgatatagacgtatttcttgaaccattgttggaagatatggccgatttatggaaagagggattgaaagtgtgggacgagtacttaagggaatacttcacagtgaaggcaatcatcttcgtgaccattaacgattatccaacaatgttttcagtttcaggtcaaattaaaggtaaaacaggatgtgtgatatgcttgaatggaacgcactataggtatctcccgggttccaacaagcttgtgtacatgcggcaccggcggttcctacgcacaaatcacaagtaccgtaagatgaaggcggagtctgatggtactgaagagactgatcctgcaccaaaacctacatcgggagaaaatgtgtgtgcaatgatagagaaaattgtttgcgagtttggaaaaatgactaagaaaccatcaaaggggataaagcgcaagaaacccgagaagaatacgaagggaggggatagtaagaagcaagatgacagttcgaagccagatgataaactccctcccccattcaagaagcattccatattttttaagtacctcctgtactggaaagatctggaggttcggcatgccatagacgtcatgcatctagagaagaatgtgtttgacaacatagttggaacattgttggacatgccgaagaagactaaagatggtatgcaatcaaggatagacctagtcgcgatgggaatcagggaagagttacaccctcaagaaggagaaaagaatggcaaagtatatcttccaccagcctgtttcacactaacacctgaggagaagaagtcattttgcaactcactccgtaatgtcagagtgcccataggtttctcatcaaacatcagtcgactagtttcaatgaaagatttgtcggtatctggttataattcacacgactgccatgtcttgctcaccgtgtttcttgcaattgcaataagagccataaaaccggagcatttaaaggttgctatcacaaggttgtgctactttttcaa

SEQ ID NO: 74709 - DNA, 771 bp, Oryza sativa
gtgctttcagaatgtatgtgaaagtgctcttgatgtgggattctgagattcagatagatggtgggggtaaggatgttgttcttgcatctatgcttgaggccagaaaccttgttgtactcagggtatgttgtttgaaaaaaaaaactcactgtcaactttttgttagttgtggaattttaatttttttttaatgtaactactacagcatgggtcagtcatatcttcgaatgctgctttgggagtctatgggcaaggacttcttaacttgactggccctggtgatggaataaaagcacgccgactttttctctctctgttttacaacattgaagtaagattaattgcatccttttgtaacatttgtggtacagtgtatctttatgctatacattaccttttgtatatgctagataatacctctattttatatgcactttccactaggtatccactaagtcatattatgctgggacaattgatatactatattccatcacaaatatattagtttcttataatttcttaaagaccctataacttacaaagtaaatgtttgagctgggttgcattcagagtttcagactgtctgcaccagaggggcatttttaaagctgtttcttaatataatctactccctccatcccaaaatatattaacctagtattacgattagacatctcctattattaagaatgtgattagctagaactaggtgccttttatcgttctgtaagcttggttcgctgttcttttgaactcgcagtgcccttt

SEQ ID NO: 74710 - DNA, 19059 bp, Oryza sativa
cttgattggtccaatggttttctattctcataaatgagtcctgatagatccgaggagttcttgagctatcaggctggatgaaatcaaactagggtttacttactagagaggaaacaagaagggatatggtaggggatctcaccagatatagggccttcgcggcgaagtgcagcggcagaggttcgtagacgtcgccggctcgccggaggggaagcacaagcgcccccctttctcactgtcacagtggcacagtcccacttctccgagggtaaagaggaggacaatttgggccgaaaccgtaccgggctcaattctatggcccaactgataattgcaccctaaatttttattttcattttgttggaatacaggattagagatgagtgtgaccttgaccccgggtacacttccacagtgaactactccctccattccaaatttttttacatatagtttttttagtttattcctaaatgatctatatatttgtgttcatttattaggtctattcgttatttgtgcattggagaggagtaaatgaacattgatgcatgcatccatgcacacatgtatttataacccacatgcaatattttgatttgctattggctaggaaatagtggggatggtgcatgcattgagtttgttgctagagtaaatatagtatgagagagttattagcttttcttgatcttggtgtacctatgaaatatgtaaatcaatttggaatggagggagtaacgctttacaaaatacagcacaacatgctgattagtctctccctcactctctctctctctctctctctctctgaaagatcacaaacatactgatcacttagctttcttcattatgtctatatgtatgagtttcaattgaaggatggttgaatcgaaaataacacaaaactaaataattcatgctttgtgcggttgtgcctagcaaaaataagcgcacgcccatgaaagagattccaaacaggagctgatcatcagaaagcaacagcacgcgttacttgctgagatcatgatgaatgatgatccagaactagttgacagaaatgtgcagcatgcaggagtacgaatcaaagaaccgataccatagggcatacactgaacagcatcatcgagaaacgagacagaagcacacgctcgcccttacaggataacagtacatgaattcgtctgaaactagaacattctgaaaagaaatggcaagttcatttagaaagcggaaaacggtaatgctactcagaatcggacccaaattgagttcctacgttcttaatggttattgtattcatcaaatggcttccagcaatgtctagcaaagtattgaccagttggcaaacatcatccgtatcctcgtacaagatttcagtacgcttcaactttcgacatcgaatcttcaacaggtccttagacttgctcgacttggtctttcttttccctatatcggaacttttggaggccttcgcagcgcacaatgatttgtataagctatcaaactcaatcaagtgagaataaaaataaatgaaggcaaatttaccttgcagcaccgcatagtgagcttctccaaattaggagacttcttaagaaggtgccacaatatcccgaaattgtcacctagatcacacttttccagcaacaaggttcttaggtttttgaatgtagggaattcaaatggtccctcatttggcatcacctaaaagatagaaaaatagaactcaataaacaagtacttgaaaccaacctgtttcattgtaaaatgaaagagaggaaacttataattttggttttaactgtatggcccaacaaagttactagcatagactttagagtgcagagtaatttcgttattagtgttgctctttttttgagcgaacatcgtgagtttgtaactcagctcgccttgctcacaagtgttacagaacaaaataacaagaacaaatgacttatttggaatatcacagcaaaaataaaactttgagatatcacagcacaaagaaaacttaattaccatctcaaagttttgtaaccataatcacgatgcacattctctaagaccaaaaagactaatcaggaccagggccagtgctccttgctggctttcatcggacaatagaaaaaactaacatacggtaagaaacacacactatagataacaatataattatccgatcttaacaagtacagctttatttagtactggatcagttgtaagaaaggtaaaatcaagcatcaagctagacatgcatcgaaatacaagctataagtaataatcaccacaaaagatcagatgtggatctttggtctaagataataagagttgcaagataaatacatatatcattatccaggatagaaaggcataccatcatattgaagcccaccagcacaagatttgtgacattaagtagattgctaagaagcgtgcattgcttgctgcggttatttttgtgagaactgtaattgttgagatgtattgatgctttcacgaggtaccgcatttggtctgaaatctggaagtttgcaaagctgagttctaggagcagagaagcaagattaggagcttctatagtcagcggaccaagagggcttggacttcccgccggtgatagaattggttcttagggtgaaccttaccaaaatttggcaatgcctaaaatttagataaattggtaacattgttaaaattttgataggattgataccaaaattctatacacactaccaatatttgaacaggcccatagatttttgttagaatgtggggttttttttgttcatgcctgattgatgatttgcagggttggcttattctgcatccatggcgaccgcgaggaagaggagctgtccagacaccatctccaccggcgaccgaccggctgagcgcgctgccggacgccctcctccacaccatcctctcctcactcaagggccgacagatggttcagacgagcgtgctctccaagaggtggaggcatctttggcgctccgtgccatgcctcgacatcgaccagagagagttcgcggccgccagtgagaattgggcaatctcccgaagtgaccttgaaaagtttgaggattttgcagataatgtgctggcctatcgctgtggatcgcccgcgaaattggacacattccgacttcgcatatgtgacagatatcattctctccgttcttcagatactgatagatggattcggcgcggcctcaagtgctccccgagagagtttcacttgcattttgattacagatatgactcctatttgcttgagatgcataagttgggttccaattatggctgcctcaccaagttgcaccttactaatgtttcattgcatgaatgcttcatggagcacatcactactgtttgcacccttctggaagttctagagctcaacagatgtagtctctatctccaagaaattacacatcccaagctgaagaatttggttctgcatgggcctgcagtgtatgatgaagacgaacttccagttggtgcaaatgcaaaatgttataaggagctaattatcagggctccttgtcttacttatctgaatttagtgcttccagttgacatgcgtcaaatttctttaaaggatgccgtctcttgtcagagcatcaatccgtttcagtgttgtctttccgtgcaaatgcaactttcttaacgtgttgtttaatgtgacaagtctagaattgtcgggtttccgtgaaatggtgagtcctctgtttctaatacatgtctcctgtaagcacttatgttagttgagcatctaaatgttttctcgctaactttccactcaatagatcatgtggcaaaaggatatggggtgttgagaaattctgagctgaaatagatgcacaaatgtctcaattgatctttagctagatgcctaccttgcttaatctttgtatcctatgggctatgtgcttttcatttcttgtaagcaatgcaactgcattcatcagaggctacaggctaacgagtatgtttgaatgctgctcccttcttcaccccttgtataaaaaaacatcgctcctagttccttcagttttttcttaggaggaattttagtaagcaatgctaatgctaaaattattgtgctctctttatttatgcttgctactaagttaatgcaactgcaacgaaacatgtatgcttctctttttctaaaaatttattggcaaccaactgttgcttagtttattaactgtaatattatcctaatttcaggtgcggctggagttcaatcaagtcgaattccatgcattcaaaaacctgaggaccttgttgctggatagatgccgtccgagttacaacaatgagttattgcgtcaccttctccagaactctcctaatcttgagaagctcactgtgcattgctgcaaggtatttctttgtatagtccttcagttcacagtaactcttgctgaattgtgtttgctgattaactcatatgaaaccttttgtctagcagttctcaaaaggttccctggagtggaggaaatcatcccagcataagaaccaggtgaactgtaggaagctgaagtctactgaaatcatatacaaggacattgatgatgttcgtgagcttgtcgatcttttgctggacgtctcagggcacctaccgaagaacactatagcgctcaccaaaatatgaaggaattatcagcctgaagccctgaacctgactagtcctcccactatctggtttccatcgataccttctatttgcagatgtactgtttattgcaaatctaatgctaaggtcctattcctgaatctaatctagatggtggtaggactcctaagcctcctgcatgtcttgtttgtgcatcgtggtgaactgtttagtagcgtttaattgcaggctcaaggagaccaacaaaagccatggaaggttttgaggtattatatattcatgggttgtaaaagctactactgactataacaaaataagtttgtaatgcctaagcaatttagccattatcatgagtgctgccagactttggtatagcctgtcaatttgacagtattcttaccaaaccttctgggaaaaaaaagaaaaaaaaagcatgaattgcaaaggtgctccaaaattctggtagcatatttctctcctatctacaggatatggtatgccaggtccatcaaagcccatggatatgtcttgttgagttgtgacttggtgcttttgccctccgagccgctgctccatgaaattcgattcaattgttagcaaaacgtagctctttcgaatgaaatttttggcaagtgaaatgccttgatttcactcaacgcgaagcttcggttcggagcatggccacatgtcctgaggccattcatagtttgtcctgcgattttaccgaatttcgcatgccagctagacgaagaaccacattagccacatacttcacaatgtaagttatataaagtgggtctgtcggtgatatagacccgggggtgccaagcttagaggggagaggccacccccagcgtccacgtggcgctccctcccgagggggtcgggcccgtggatgagtggcagccatccctttcgagcccccgacccctcctcgtggccaccatgggtatggggttaggtgggcgccccccagcgtccacctaaccgcatttaatgtgggcggagcaggcatagcacgccacatttaatagcagtttgcgatcggtctgtgaccggccgaatgacagacgggacggcgacaatctactcacgccctgaccatgtgttaggcagcgtgaggcaggtatgccccatcccatcatgatgatccaatccggagtcggcttgaccgctccggacgtgcccgagattgtgttcctggagcatgcccccaaaagtcctcatccattaaatagtgaatgacaagggcgccccccgtgtcagccgacatgatttgatgggccccacgcagcagccgacgtgcgaatagcttccgggttaaggcacaagacatgcatttaatatagagaatattttttctcttccctaggtagctttcgcagcacatgtggtaacctcttggagtataaaaggaggtcaatgcctagcgaggagggggatccatgggtcgaaggttggggctaactctagcttgtacaccggagattcagagactttgaaagctcggaaaaatcatcatacacaggaatagggtattacgcttcttgacggctcgaacctgtataacccccttttgtttcatcttcaccgaggggcccgaccccctctagaacacactacacttccttccatccaactcctcagttttcacccgatgccccccgccgaactatcagaggggggcctcacagtcccccactcgaggagttcactctccggcaaggtcccactagtatcatctttttcacttttttttatctctctttctctctcccctactttccccatcgcatctcctcctttccccatcgcacagaagctgccgtgggcgagggcggcattgggcggcaccaaaactggggcgacgatggcggcggcgggcggccagatccacccctcctttcctcccccgaagcagcggcggcgtcggcttcgcgggagcggcggatgggcggccagatccaccctcctcggtcgaggccgcccctctcctctcgttgcccggcggccaccgtcgagcggctgctgcacgggtggttgacaacggcgagcggcagcttgtatcggtttaaatttgtccgtaacgaccgtcaacaggcgtcttcattgatacggtttaaattattcttggtcttggtgaccaaatattataagataaccaaattgggatgaaggaaatatttttataatatatttgttttatgttgaaaatattactatgtttttctataaatttgatcaaacttaaaagagtttgaataggagaaaattcaaagtgagttataatatgaaatgaagatagaagtactttacgatatgcttttcctactatacatcatggctgtgttattttggagagattggaaaccctttccctccgtacgtaaaacagagcgatgaattaatgcatgattaatcaaatattagcttaaaattattgaaaaataaattaatattgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgttctggtggatctgtgtatgaagaagctacaaaagagctggagaaccagagagctcttactctctccctctctgatcgttctggatccgaaaaaatcccctttctaagtgggcaaggtcctccttttatacctcaaggggataccacatgcaccatctctctcttttttttgtggggacttatcctatcttttcataaacaaacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaacgtcatgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtctgacccctcggggagacaaagagaagggcggccgtatcaccctcgggcccgaccccccccccccccgagggggttaggccacgtgggtgatcgtgtctgtctcaagtctctaagtcatgatactcccggtcccatgtcaccgacagtagcccccggcgttacgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcttatccacctcatgcaccgcaaacgggcgaatgggattagtggaagcgtgggcgcgagaaacgagggggcaagatagtgggcgcgagaaacgaggagccgggcacagcgttggcaagggtataaagtcgtcgaggaagagatttgcttccttcctctcgccattattccccttgtcttcgccgcttgcgccctaactccttgtttcctgtgccctaccttcgccacacgcgctcgctctcaaacatctcttcttctggcatcatggcacggggctccgctccgcttgacggtagcgtgctgccgccttcccgcatcgtgagcgagagacaggccgggctgccgcgccgcttcatgccggaatctgccatcggccgggagatagtctcgctgggcgagggatgcccggcgccacgctacccggggcggtccgtcttcttcctccctttttctatggcagggctggttccgccattttcttctttcttcatggatgttctggagttttacgatctccagatggcgcacctcacccccaacgcggtaatgacattggccatcttcacgcacctgtgcgagatgttcatcggggtgcgcccatcccttcggctgttccggtggttcttcaccgtacagccggtgtcgccgccgtcggtggttggtggttgctacttctagccgcgggggccggtgctgaaccgctacattccctgcgtcctccgcaagaagtgggatgactggaagagcgactggttctacacccccctcgccgacgaagcgcgcctccgacttcggagccagcctccagcgcaggcctccagctggtgggcgccggtagatctgggagatggctatgacgccgtcctcgaccgcttggcgggcctgcgattccaggggctcacaggggccatggtgtacggcgactatcttcatcgccggatcgcgccactccagcggcgcgcccggggcgcctgggagtacaccgggtccgaagacttcatgaggacccaccagggggtcagatgggactgggctcctgaggacttcaagatagtggtccaacgggtgctgaatctcagctccgtggaggcatcccttattcctcaaggagtcctccccctctgcagcgatccagaccgcgcctccatcctgaccatcatgcaggcggtcggggcatcggaggagcgggctcctcgaggccacgatggcgcgggcgggagccacaggggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgctcggagggggccacaccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtcttttttctgtttcagcgagatcccgtcgcgtccctcccgccattccaagtccggccagtctgaggccgaggacccggcgaccacagaggcccggaggcgggaatctgaccggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcgacgacgacttccgaggcaactcgcgacgaggccgcgggcgcatcgcttgggcccactcccacgtgcgacgctcaggacaaaccaggtccgggggacatccccgagtctggcacgtccatcagcgggccaagccgcgcggcatcctcttcgaggcggctcttccccacgcctttcgttgctccactgagcgcagaaccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaagacaccctccgccttcaatacgggagctgggaggcagagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcatgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagcgcgggaggagcaggcgtgccgtaatctggaaggtgcccgcgccgagagggccgcgctgaatcagcgggccgctgagctcgaggcgcgggagagggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgtttcgggacgccgtctcccgtctagaccgcgccggccggcaggcgggcctctggggcaggcggactgcgaagtacgccgccaaccaggggggcctcgcccagcgcctctcggagatagccgggactctccaacggctccccgaggagctcgagaggacgattaagtcatcctcgagggacctcgcctgaggagcggtggagctcgtactggcgagttaccaagccagggatcccgacttctccccatggacggcgctggacgagttccctcccgggaccgaggacggcgcgcgcgcgcaggtccgggacgccgccgaccatatcgtccacagcttcgagggttcggcccctcggctcgcgttcgccctcaactccgacgaggaggacgaagacggcggagtgggcgacagtggcgacgaggctggcgacccgggtgcatcggagtgagcccccaggcccccgccaacctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggtagctctgtgccatcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagagcgcggctcggagggccgcgtgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggtgtttccccggttgctcggcttggcgtggttcggttcgcccagagcaccgctggcaactcctcgatccacgaatcgccgtgcttcttgaggatgttgaaggtcttggttttaaggcctctgaggatttccgcattagcgcgctccacttggccgttgcttctggggtgggcaggtaaggcgaagcagagcttgatgcccatgtcttcgcagtaatcgccgaaaagttcactagtgaattgggtgccgttatccgtaataatacggttaggtactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacgatcccaggatatcgagcccccagacagcaaatggccatgaaagtggtatgatctgcagggcctgggccggctgatggatttgcttggcgtggaattgacacgctctgcatcgccggaccaggtcgaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgttaggcgcgtccgtctcccctaaggggtcgggtcgcgccgacggctgggcaagcctttcttcaaagacgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacaaacctggttaacgaccagctgggagtcgcctaacaccaggaggcggcggatccccagtccagctgccaccctaagtcccgcaaggagtccctcgtactctgccatattattggtcgcccgaaagtcaaggcgaaccaaatatctgaggacgtctccgctcggcgaggtcaacgtgacccccgcaccggcgccctgaagagacaggaagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcctggagggcctcactaacaaagtagacgggccgctgcacctttcggtggggccgatcctcttcgctaggggccacatccctagggcgctctttgtccaagcggcctcgcggggtgcactcgtcttctgtgccgacgacctcggggtcggaggacgacaggggcggccttcccacagtggcctcggggccgtcctgggggtcgggggctcctggcgtcgtcggacaagcgggcaaagggccaactctggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcacagggtgggggtgcacggaatgaggattgtcctcatcgcgctccacaaccaacgccgcactaaccacttgcggggtcgccgctaagtagagtagcaaaggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacacattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatcagagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaacgcagttttttcctcatcctccctagccatgtgaatctgatggtaaccagagtatgcatctagaaaacacaaaaggtcgcaccccgctgtggagtcgacaatctgatctatgcgaggcagggggtaagggtccttaggacatgccttgttatggtcggtgtagtcgatgcacatccgaagcttgccgttcgccttgggaacgaccaccgggttcgccagccactccggatggatgacctcgcggatgaatccggcctccagaagtcgcgccacctcctcacggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccatccagaagaccaccgattcgtgtggtcttggacgggccgtcgcccagggcaacctccttgaccgggacctcgtcgcacgtgactatccgctgcctcggggcggcggggatggaggtgccaagcctctcgtcgccaccctcgggcttggacgcagcggcgaggtggtccgcgcgctgctccatacaagcgagcgcgactttgaggtcgccatggacagagatgggaccaccgaggcccggcatcttcatctggaggtaggcgtaatggagcgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgacccggcgtcacaccgataatcggctgggacagccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacgatgcaccacttgccagttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctaaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcatccccggcggcctcgatcccggtcgtgtagacctggagaaactcggcggggttgacgctcccgtcgtatttttcggcgatggtgggccagaaccttgggggccaacggacgttccgaaggctcgccacaaaggctctacagccgacaccaccaaccgggggcacggagggttgatccccgcgtccgtgttgatgtgacactccggacgaggaggcgccctccgttgcgtgggcagcacgtcggccattacgctggtgctcgatactgatgcgggcatccggccctccacgcagatcttcctgggtcggaggcgctgacgaaggagtggcggccgaatggcgagcaacagccgccgctcgccgcgccctccgccttgacgacacggagcgggtggtagcagcgccagaggtcttggtggcggaggaccgcccaccagcacctaggcgctgctgtgccgtcatgaccaagttggccacgtcgtccagccaacgttgggctggagactccgggccagggacaatgggcgggtgacgtaggagcgcgcccgcagcttggagcgcgccctggggcgtgctgccgtcgccgtagacgaggaggcgacgctccccatctcgccgcccttccccagcacccgtggatgtcgaagtcgcggatccttcgaccctctcgagcgcctcctcccgcctaggactttggcgtggaaggggcggtggagtacgagctcgacggcgtgggttcggctccccgtcgtcaccgctaacactcggagagaggctgtgcgcctttgcttgttcagccattgggctgaacaggaaaagcttggtgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgttctggtggatctgtgtatgaagaagctacaaaagagctggagaaccagagagctctt

SEQ ID NO: 74711 - DNA, 2108 bp, Oryza sativa
cactcccatccccttctataatattggattatctcgtgagttgatagggaacatatgccaattataatcctaacgacaacaatcggggtccctaaatgagtatggagataagtttatttcatatgtttatcacacaatcaagtgtaaatgtgaatctatttcacataagatggttgaataatattaaatagcaataaatatagaatatgtaatgtaggaaaaaccataagtttaaaacatgttgccatagtaatttgcgcacaaataaatgcatatgaggatataacagggagggggatggaaaaggcaatcttgttccctctgtgcaatagaggattttctagtggtttgacaaggaatgggtccctattgcaatacctatacaacagtttccttctccttttataattgctaacctgtttttttgtcgatggtaggaaccaactctccattggatttgtgagtagatttacgctagtaacatcttcttcttttccaactctgtggtgacaacaacaacactgtgttaaagttcaaataaatagagggcgaggggacgagggatgggagaagaggaactgaggaagagtcttacgtagagggatgccgaccacggtggtagatcgtgatgggcggtggggtggtcgaccgtgtggagaggaggggaatgagcgtggtaagtgatatatagggccaaggaaatccaattagttggtggtgagcggtggtagcatccggaaacgtggaagacactggtgtgagagatctatacgagaaactataatatgttggtggttaaattggaggtgtagggagtaggatgggagaggaatgggtggcaagggaagcatgaattgaagggaaccatgggataaagtataacggctatatcatggcaatgtggggagagtgatagagcgcgaagagagtgggttgctaggattatcttgaaagaatgtgagtgtttggaccgttggatggaggtaggttttctagtgtaataaaatgataccttgtttagatccaatcctggaatccgattagtaggcggtgagtagtggtagcttttggaaacacggaagagactagtgtgagagatctattcaaggaagtgtaagatattggtagtaaaattggagatgtatggagcgggatggctaaggaaggggtggcaagggaagtatgaattgaatgggagtatgagataaggtataacggatgtggcgcggcaacgtgaggagtgtgatagagagcaaagagagtgggctgctaggattgtcttgaaaggatgtgagtgtttgatccgttggatggagtgggtttgctaatgataccttgtttaaatccactcctggaatccgattagtacgtggtgagtagtgataacttctagcactacaacaaaaacgtcatgcaaaggcaatttttaaaatgactttaaaatcaagagttctaaagtgtagagacatcttttagaggcactttaaatattgtctaaaacgcttttaatctaaagacacttttagcacaatttattaaatttatcttgtagaggcacttttttcaacactttaaaatttgccttatgtaaaggcattttttgagacatttcaatctctatagaggcacttataggaaatttaatctaagctaattaactacataaaagtaacacgcggcacatatgtacaagtaataacatgaggttgagatggttagaccattcaagttaaaaataatatatgcaataagtctaaagttaaaggattggcaattgcaagggaagtgattttttttctttattacattggtttgccatggttttggaagattttaatgcctttagaaaatgcctatactctcttataaatattaaaaatgtgcctctatgaaagtgccagaaggcatagagacattttgtaaagtgcatctagagtattctagagacatttaaaaagtgcctcaattcactagaaagcatttatgagacatttttgaaaatgcctctagaatattctagagacatttaaaaagtgcctctatattattagagaaatgtctcttccatgcatttttgttgtagtgtggagacacgaaacacgctggtg

SEQ ID NO: 74712 - DNA, 661 bp, Oryza sativa
aatttgggagagagcttcaccactagcggcacaaactgttggaaactcgactcatgccacacctaagttatcagacgaagatggatttggtaatcggttgggagtacgggtcagtctaccaatagcacagtgctgctgctgctgctgctagcaccacaatcttggccaacccaaacagatatcaaatcagctcataatgtggacgtcacatacccaattgatgagcacagatgatgaacacactggagtatttggaccatatgggatcagaggaactgcaaactagtgttccaaactgtcaaacatgctactgtatttgcatccgaaagaaagaacatgcatgctcccactgatgatgcatatgcgcatcatcatgcagggattcaagattcacgccgcgtgcgatctgatccccaatcccccctctccttttgcagtggaatggaatcccatgcctttactcgcacgacgatatgccgctaatcaacaacacctacccactcttttagatctgtcacattaaagatccaagaccgcacggatcttgcctcaagacgactcttcgatcctaccaacccattcaaacgaaacgggcccgacctatactagtagaaatccgcgaggaacaaaaagaagccggtcagccagcgacaaggaggga

SEQ ID NO: 74713 - DNA, 1649 bp, Oryza sativa
tgctacgctcaacataccatactcttgagattatgacgacacaaattttcacaaactacaaatggagatttagcaaaaggtttgcttttaatttttacctaagcaatgtttggttttcactatgcttggttttagtttttccaccatctttatatatgtggtgctacagcttgaatggtgacctttgtaataagttatggcaggatgcttcgagctaaaggttggattaattttattatcataaaaatatttggattgaaagaacttggtttgctatcatattaaaatattgacaatactaaaatctaggcaaatattgattgatctgccattgcaaccatcctcaccactgccatatcctcccaggtcccgacaaccaccgtgagctcaaatgaagcttctgtgctggcgtctcgctccacgacggcgcacaagagcgacccgtacacaagatcattggaatgtgcttgctagccggcgacctcaagaagcagcatgggtattcatgacgacgaggccaataaggaaacgattgtaaaagttagtgttgacatagggacccaaaggaaaaattgactaatcaccatcggtgattgcgattctaaacttttgtgttccgaaggccgtattttaattatggactggatattgggtcctctacgtaaactttgggcgtaggtgatggcccaacaccctctttctcacttataggccaggcccatattccagtccgcatgcacgtgagagttttgttttggagggcccacctgattgtaatccctttccgaggaaatgggccggatttgagctggcttcagatgttgtgggccgaaaaccattgcttcctcgcttataaatttgtttaatctactaaaaaataccctgcacattgtaatggactttcttatagaaaaaaggtctatcaatccttacgcatattataccaaagcaaataacacttataatttttttatgatttttctattatacaaacatacctcatataatgcaatgggttaaaattgtgtccattatgtcatatcactttagactaagattttatatatatatatatacatatatatatatatatacatatatatacatatatacatatacatatatacatatatatatatacatatatacatatatacatatatacatatacatatatacatatacatatatatacatatacatatgtacatatatatatatatatacatatatacatatatacatatatatacatatatgtacatatatatatacatacatacatatatacatatatatatatatatacatatatatatacatacatacatatatagatatgtacatatatacatatatacatacatatatacatatatatatgtgtgtgtgtgtgtatgtatacatatacatatacatataaacatatacatatacatatacatatacatatacatatacatatacatacatacctacatacatacatatacatatacatatatacatacatacatacatacatatatccaaggaagttaattttttctttgcatatttccattttctttttggataatattaacccattttgttccacctttctaaaaaatatttcaagatgagcaatatgttctttgtaagtcctt

SEQ ID NO: 74714 - DNA, 3956 bp, Oryza sativa
  unsure (1)..(3956): unsure at all n locations
aaaaaataaatattccatactacagagtcatacaggcattaaaaaaatcgaagtgtaaaagtgacacacttaggaccatgttcaacaaagggcatgaagccattaacattggccacctttaggactatatgttgatatgttccacaaagggcatgaacttacggtggataaaatctatggcttgacaaatatcctggagggctggtgcaaacaggtagtctcttgtgggaataataaggtggtcaatcccatgggcctgcaaaagtaggacttgttactcgtcaggaggatcttgcattgttgattgcaaacacaaaataaagtgattgaaaatcccctgaatgaatcaaatgaataaaattatgctttaaactcaacgagaagatgtctgacaacaaaagactacatcatacactctcacaacgagtaaataatgaagaccaagtctttccttctgattgagtagcgaatcaaggttcacaacacaaatgaaatcatgtactaagctaggaaatcaagtgataagagattttacctggtataaagatgttgggaccagggtctcataagcctcattcaatgttacaactccctgaactccaagttgcttcaaacgtggaacatcacttgggaaaggaacagcacctagcaaaatatactgcgggtggagattggacaaattagtcggtgagatctttatagcacagactcaattaagagtactaaattatgtaaaacaacagtgtaacaaagaacggcaactaaagccatgtccacaaatccctccacatgccaaactaaacatcatatgagacttactgcagtctacactagtaatttaccaaagaacaggccgaaataacgtacgcacttgaagataattactcaaatttcttagacaaaatggagccttaatggaacaaccacaggaacacaatcactgctcacggggaagcgaagggtattacttcagggggaaaaaaaggcaatgaaactctccccgtaatatccaagcataacaaaaccaacccccaagtgaacaaatcccacagagataagtcaacagccaccctaacagtcacgagtaaaccaaaagcgaagcctataatcgcgcgaggcttgtagagagtttaatcacgcgagtcgaattcagacgcaaggaaagagggggcaaacccacctggtcgactcggtcccaccaccggaactccgcctcgaaccggttgcgcagcacgttgtagagcagcgtcgggtagaacagcaccctggcgccggcgccgacgagcgcacgcttcgcgctcagccgcgctaccaccacgccgccgcggacgctggccttctccaccaccacctgctgctcctcctccccttccgaccgcaccccgtcacactctcccagctcgctaatcctcatgcccctcctcctccttcccccaccagcttcaaccctagcgccgccgagacgactccagcgccctctcgcccttccagagccggcagatccgcagggggcgcgggagagaaagcgcgcggatcgggaggtggtgatggcgagttgcggctgcctcgcgggacgcgagaaatgggaagagcgcctgcgccgcggtgtctaaaacctcggtagaggcggatgcggaaacaggtggcaattttgctgaatcggagagagggccaggggagacggtctggtctcgctggttcgtggttttttgttggtgagagaatgagagatggaatttattggtggaggaaacgtggtgtgtgtgctctttcgcgtcaggcccttcaacagctgcataattgtgctctttgatggttggatggtttggtaggtgcaacaacaattcctcaacgcgcagcgttttgttcatgctattgaattaagaggttcattttctagagtacatgtaaaagattttcgtgtcccgcttgcgttaggagaagaaaagggagcacaacagaacccaaacataatggtacggagggaatgaagagttttttagaggtccatgctcagtatacttgaaatgtttaactgatgcgtctaatgttctccttctccatactccaagaggtactccctccgttctataatataagggattttgagtttttacttgcactgtttgatcactcgtcttattcaaaaaattttagaattattatttattttttctgtgacttactttattatctaaagtactttaagcacaacttttcgttttttatatttgcacaaattttttaaataagacgagtggtcaaataatacaaataaaaactcaaaatcctttatattatgggacggagggagtagttgtttagtggggattgagatccgatgcagacacaactgcaccataggactgcatgtattgtaaccgttcattttaatgatcaaaagctcatatttaccgctccactactcaaacagtagtacataaaacaatattttatactataacagtttttgctacattgccaagctaatatgtagtaccgtttaatttcaatccaatacagcagctgcaaattatttaagttacagtcaatactatgactgcagctgattcagatccgtttagtgggatacacagtcaatactcaatgacatgttttaattgtaacggaataacatcgagtcacaaaaaatacttattaatttgttaaaaataaaagaatatacaaaggtgccgaacatggtagtagacagctcttccaggggttgttaaggatatcttattaagttgagtcaatccgttctatgccattaacaattgtgtgggttctacaatatgccactaacaaatttagttctacaatatactaccgaacaatccattttctccttatatgccatcgttgttagtcagccattagttttattaaaaactttgtgcaaatacataagatataaattatgctttaagcacttttagtgataaaacaatcacagtaaaaataaatgataatcataaaaaaattaagtaagtcaaatgatcaaatatgtgtcaaaagttaaagacgactttcattaaaaaccagatgtaatatttaggctttgtttggctaatgagttagggaaataatttcctacccacaaaagacatctttaaattccaaccattcattatcccttttctatttaatcctaaccactggtggagaaagcctttttactcccagttggtaacccccatatagtcccggtttttcaaccgggagtatgaatccaggactaaagatcactatctttagtcccggttcaaatacccgggactaaagatcgatctttagtcccggttggtgttaccaaccgggaaaaaagagaggaatctttaatcccggttgataacaccaatcgggactaaagagagagtagcgctttttttttcttttgccagatttaatctctatattttctcccaaatctagtgccatgtatatccctaaatcaatccccaaatccccaattcaaagtaacatcccaaatcttaagttacttataaacataaatcaaatacatcacaaatcctaaaaaaatatactcaaatcaaatacatcacaaatcctaaaaaatacacacaaatcaaatacatcatagattatacatctcatatccatgcaacgaatcacaaaattacacatcccaatcaatcacaaattgtaaaaaaaaagaaaaaaaaagaaaagagaccggccggcagttgagagggcaaggccgccgccgggcgcacccccgccggccgccgctgcgcgcggcactgccaccgcccgccgcggccccgccggccaccgggtcggatgggaagtgaggaggggaggaggaaggggagaagggggaggaggagttagatctgtgaagaggaaggggaacagatctgtgaagtgtaggagaggataagggatagagatgggtnccgagcaagaaggcggccatggcatcgatccgcgcg

SEQ ID NO: 74715 - DNA, 6277 bp, Oryza sativa
tccatctgataaaagattttgttgttctggttctgctgttcctgggtgaatagacatttggtgtcgatccatattcttggcgccaaaaagcaggagctttccctctgctctgcttttgttcccgcgcgctttgccgctgagattctatttgctgattttttgggaagagaaataagtgattctgttgattagtaatccctaattaatcacaaatggtgggatcactatatgcagctgttgacagaaggatgtgtggcagggatgaaggcaacggcaatgtttgccgtcagccaaaacggcagacgatgtgaacccatccaaagtatgtctggtacgctatggaatttgccacagggagcatgggctctaggccgaataccaacaacttcaggtcttggaaatttcatttgagatacccggcagcatcgaaagcctattgtagggctagatgatccaccataatcccatccggcaaggatcttgccaaaagcaggcgtaaaacctgcagactccataagcacatcggagaaagtctccatcaaactccatcgccaaggagggaggaaggaagctgtcacccagtcgcctgggcatcgccccaaccctaacccaaaccctaacatgattacatgaaattagttagtattagattagaagggtgcgatctgtatacaagtacgaaagaactcagtttaaaggtcagctccgagtaaacttttgaaagttatgtgtgccaaaggttccatttggttagcttgctttaggattcattaacattttataattttcagggttatggataccacatacctaacagtagttaactaaatctcggtagtacccaccacataccatatcttatacggaaacaactttcggatataggaagagttccgcataaggaatgataaatagagttctacatggaaacgacaaggactactattcatattggtttccctagttctacttggacaaggggacacctatgggtataaatacaaggccccctaggaggagaggagacacaatcaacatacacagaacaacaaaagccacaacatacaagccaacatacaccaagacacgccgccggatatcgacatcagagatatgcctggactgaccctatccggtacctacagaggccagctgtagggatctagcgctgtctttaatctcgtcgggcacggattcgaggaggaagactaccctgttgtcgactaagtgacgatatttcaaaccactatgtcgacaacagatagataggctaccccaaatattgtactggtgtgattatggtgaataagagcaacgaccggcttcggtcaacaggatgtagggttattacctgacaattcaggggcccgaacatgtataaaaattatcgtctctgtctcttttacctaagtctcgtatatatcctggtaccaacgatccccatactatacaaataccagaatcgtgacatcaaacatcgacaataatagagattgctaaaggacgctccatcttgtttacaaacaaggtcaaaatgatttgaaatcaccacattaacacaaaacagatatctcccaaaaaaaacagagagagaagaaacctacatcagtaaccatgaaggatctacattattataacggtgtagaatgcagattgactgcatatatattatatttattgtagctgtcacagttgtgtgtgtatgtgcgtgtgtgtatatatatatatacacacacacacaagcaaaatgcccgtgcatcgctacgggtaaaagacatataaaatattttattaggctacatattgataagaaatttcaatgacaattcggatggataaaaaccactattgcatactgaaatacttgctctttttcaactcccgcgtggtaaagtgcgcgatctcctttttctaaaattatacctgggctcgcgtacaaagtgattgtgtcacgcgtagatgacatataggcagtcgagggagaagacgtaggcgctggtaccaacccatcactgattgagagaagggagaaccagagaagggacaagggaagagcaggtgcgttaagtgaatggcaaggcggataattcccttctaactgtcagggtccttaccgaagcgagttaaaccgttagatgattcaatcggacgattcaacatggtccgtgtaggcgacgaatgaaaaggagtgtgatgatcggaaaaatccgtttttttaagtaggaagggataaaagttcgtgtattggtactcgggcagaacatccttgaatgaaagaagcatcggcatgcatcaacaaaagctgcccgtcctccctgctcgcatctccttagcctagcccatctctcatccaagctaagtttgacatgcccgaggagatacacatgcatatgtttggttgcttacacgagagatacggtttggaagagattttgtttggatgattttatggatgatcacttctctttatttagttaggtgaggttatctataaaatatcatattaacatctgattcaattaattaggtgtactcttcaacatgcaaaatatgatttttttactaatgtgtaaatcattgttcccaaaagatgtgaaaaaaaaaccacatatacagtatgtgtgtgtcaaacctagctaatgcatcacagctagtatatgtgtgtgtcaagcagtagcagtaatctacagttaggctaatctgatcttaatgatcaagacacgcatgagtgagtaacaaaaaatgcattgtcttagaaaagtgggaactgggaagcttgcgtgtgagcgcctgagcggtaggagaagaaaaaaagaaaaaaaaaacagaaaaggagcgttgtttcctcgccgcccccgataattatccgcatgtgcagttagtgaaaaaaaaaaacaaaaaaggagcatcgttccttcatcctctttcctcgtcctcatcgccactcgtcattcctctcagctcgccgccccgattcatttgcttgccgccggatctgacgcctttggactcgtggccaacgaatcccgcggcgggaggaaggagagtgtgctgaatcccgttggattcggccgcctagaggccggcggacactggatccaaccgccttgaagccaaaggccgcccgatccacagcgcagcagtggcggcggcgacggcctcagcctagagctagcagtggtggtggtgacggcctcatcctccgacgagcagcggcggcctcccccttctccttgatggccgcatggtaggtgtggatcgaaggtgaccacggctgagagggagattgatgatggtgttggcggtgagtcagtttggttctcctgttattttgttgaatgtctaatatggcagaagaattttgatccgtgatttggttctgctgttgttgatgacgttgacggataattgaatcaatgtaaatttcctcttcttgatttctaaggtgcttctcatctttgacctgtggatgtggaattttttttcctaacttataaatgtggatgggggatttgggcaactgtggatgtgtgattcttcgtaatctgtaatcgtggatggggatcgaggggggggggatgtttacaagattgggttatcttgagggaattttggttgtaatttgtgtgtttatgttttcgattcggttagcttctcatacgggcattgagacagggaagcggggaaattcacatcgatgtgacggacaaaaacggattggctcggataatgtgacgattggaaaaaatatgaatcttttaattagttaagatatagatatagatatatatatatattttttcaatctttaacaataagcaaaggaattgcaaacatagtacacgttgagccgccgcagccgcacaattgtgccggaaaattcagttagttatatagtttgtctgccacttctaaccaaattctctacctaccaacatgctccattatccatagaaacctaactaaagatcacacaaccagcaaagcagcgcagtatccagcatccagccacaagaaaacatgacgagaacaatgctgacaagagcggtacctaccggagagcagtcgtcctcggaagcacaggcgcaagactttgacaagtgccaagactgtgatgtgccaaatagcagggaacattgcccccctagaaaaaaaaggtactacggagtagcagcagacaaatagtgacatggaacatggacatctttttattccgatcggagaaacaaccattaagtgaaatctcacgttttcagggttaaaaaacaaggacaatccgcacatccacatctctacactctccaaactcactatgcacacattttcttcccggtggcattgccgcgataagagaaagtagaaacatcactgtttctaccatgtctaacaggctaactgcctattattatctactactatgtacccttgattcacagcattgaaaactgcataaaagcctgctggtttacctagcaggcccgaacctcagcaaaccggcttggggttggctcacaattgttggtaagtttcagagatccaaagagacatgatagtcttctcatgatgggcttccggctgactatcacttccaacgacacaacgtccttcctggtatcggcataagtatcatatccctcgaggtccgcttctgttatgagtactgcgtcagtacacactgtagggctcgttggcctgggtaacattacttgacaaaggggtaaaccactatcttcgtaatcaagctccatggagtagtaatcatcaatttctgagttggtgatgcagtcatccccggcttctagaaaatggcccaggtttttactctgtattggaagacgcccggtggtgagggtactaaaaacgttgacagcctgcacaatcatgtcgttgcatgaagcagcttagcatttgtaggactgtagagtaatagctctcacttggacaaaatgcaataacaaaagacgtccccacacctgccactgcgatggtgccaaaagtactctaggcctaatggatcggacatgatctaatgctgcttctggactcatgctccgatatttaatctgcaagacaagtaatctgtcatcagcaaaatggagcgaaagatatacaatattgagttgctttaattattgtttatcctaccagataacacaaaacaatagtcgtgctacgccctcttccagctttacagtgaacataagtaatgccaccttctgatgcattccctgaaaaaaagagccaaagttaatatccagttgaggtcagcaaaaattgtctgcataaatggctacaatgcagaaagtgtgtaaaagcaggtttcctttcctgccagcagatatattaataatttcacttaataatcatggtgtatggtagtattatattgcactgacagctaacagatccttctcatcccatggttggaacttggagatgggatgtgaattagaacatgtcgctgcaacttaaatttgaacacctactacaccaacaactaattggccatgatcgcaaaccaaattccatatccattagttgaacgcagctatcacctgctccacaaaatcagagttgactgcaactagcttgacttcccttaatctgactaccggtagtagttttgttacctaaacctatgtcattgtttacatgcggaagaacaatatttcatactagtgttcgagaaaaaataaatattccatactacagagtcatacaggcattaaaaaaatcgaagtgtaaaagtgacacacttaggaccatgttcaacaaagggcatgaagccattaacattggccacctttaggactatatgttgatatgttccacaaagggcatgaacttacggtggataaaatctatggcttgacaaatatcctggagggctggtgcaaacaggtagtctcttgtgggaataataaggtggtcaatcccatgggcctgcaaaagtaggacttgttactcgtcaggaggatcttgcattgttgattgcaaacacaaaataaagtgattgaaaatcccctgaatgaatcaaatgaataaaattatgctttaaactcaacgagaagatgtctgacaacaaaagactacatcatacactctcacaacgagtaaataatgaagaccaagtctttccttctgattgagtagcgaatcaaggttcacaacacaaatgaaatcatgtactaagctaggaaatcaagtgataagagattttacctggtataaagatgttgggaccagggtctcataagcctcattcaatgttacaact

SEQ ID NO: 74716 - DNA, 28631 bp, Oryza sativa
aaacgacatatcaagacaaagtctagtatgtatgtgtgtacagctggactactatactattttaaagaaatactccctccgtcctctagtataagggattttgacattttgcttacactgtttgaccattcatcttattcaaaaaattatggaattattttttttacttactttattatccaaagtattttaagcacaacttttcgttttttatatttgcacaaatttttttaataagacgagttgtcaaacagtgcaagcaaaatatcgaaatctatattatagtacgaagggggtttaggttttagagtttagggtatagtactcacggtaagtttaaatcttccgtcgttttgtccaaccaatttattgacacgtttttcaataaccataccactatgatatcattgtacataaatcattgacatggcaactgctagtactaaccaaaagttgtcaggatagctacacctgagagaatgttagacgaaataagggagggaaaaagggtggcaagtccattttgagagtgcaattagaaagctgagtacattgcaaatcgacagcaaaggaccatcattatggacaagttctaggttgtgaacgtaaaaaggcctaatcaccaactccgcccatcaatgctttccaggggtgtaaatgatatactaaaccgcataaaaccacaaatcttttggattttttttctcatttcctcgaggccttattcgattaatttttatgagggagggattagagagaatttattccacacctattgtggtgtggaattattcctcccgtctttaatcctatctaaaccgaacaaggccctattgtggtgtggaattattcttccacagtcccctccaatatttttcaatccccttcaaaccgaacaagctctcacggctgccactcagccactcacatcttctaagggtgcgtttggtttacggtcaaggttagataggatatggcggtccataatttgctggatttgacgatccagttttttgtttggtggagtgagtatattgatccagttttttatttggttctagggatgaaggtggatttggtgatccaattttttgtttggttagagggagtaggatggatgaatggctgcaatcaccccttcattagagagggtgagtataccccttcaaaatcaccaaacccacaaaattatcaatctatatattaaaaaaatatagagaaataaaaaaatcataaacaaataaaagggggaaaataaaaaaaatagtcctcttctcgttggtcgtcggcttgctcttctcgccagctgccgccccgtcttctcgctcgccagccgctgtctcgtctcttcgctcctctcgccggccgccaccccgtcccctcattaggcggtgacaacgacgacgatgccggccgtctcaccggatccgccgcctccagatcccggcgaggaggagcctgggaaactacaatggttgccgctttcagatccggtcatcgtcatctacttccataccaccgcctcttcccactcgccaccgccccatcttcttgctgtcgtcgccttcggcctccagtctcgcggcaccctcttcccgccgccaccgcgcttgtgtcccgtgccagccgttgcgctcccgtcccgcaccggcctccgagctcgcctctcttgctggctgcgtgcttgctgcctcgctcgcaggggcgtgcctaggttatactacccggtgtcacaggacaccgggtagattattcaaatcctatataaattacactatattaattaatatattagtcaataattagataattagtatgtattggacccccggtaacttttattctaggttcgccactgctcgctcaagtcattgcggtcacgtggtgacggatgacacgagtcgagcgaccagcttgctcgctcgtccgccctcgcccgggcgctcgggcggctacttctaaggggaatattctcctccgggccgccctattctattttcgcccaccaaccaaacacaaaaaaaaaagggggccgccatatcctatccacccaaaacccaccatccaaacacaccctaagaaaatccactcgctctaatcccggccgtatattcccaatccaggcgaatcggccactgtaaccggaaaaaaacagttctatccgtcagatgccgatcggaaggccagcatcagcgctatacggtataggctcccgataaagaagacggccgcggctacgaggccgcatgattggatcggaccgcggcgagctggcgtcgccagtggcgtcaggcgcacgacctgccacctcgcacgcgccccgtgggacccccgcggtctcggcgtcgtctcggcgtcagggctcgcgctggccgacaagcgggctggtgttcacgtgggcccggctgaaaggggggctcctgcagctgggggcccacctgggcggtgtccgttggaagcatcccgttggtggatgccccgtgggcccgcggcggctgaggtcctcgggaagggtgacggtatccgtgggcgccaggcgctgggagcctgggattgggcggggtgtggggccacggcacttgcacggggtttgactgacggtgtggccgcgtgggaggcgatggatggattgttccgccaccacgcgagccgccgtgacgcggctgcagtgctctgctctcgcgtggttggcactcaccacctcacctcatattttgctgcttgcatgattggtttggaacagcgacactggcacactgctcccctgaatccctgaaccctgataggttttgctgagaaaaatatcactgatgctgaattgaggcttccatccgatggtccaataaaccgaagaataaaccaaattttaaattttcaaacttaattttaagtttgattttgagatattttcaacgtatatttttttcagcattggcttttaaattaaaaaaaaacacatatataaaagttttacctataaatttatttttattttctaataagccgttttggtttattagaaaaaaaagccaatcgattggggcctgacatgggcaaggcagtggtggtggtgctccggtgccaacccaaacgggaaagatccggatcaattttttttgctcgcgggagagttgcggtaatatgctctcggtaatgacagcgatcgcaatcgatccatccatactcgacgagttcacatactccatggctccatacttcagggttcacaccgagtgacatcacgcccgctcgtgcttcatgaccttcttagcattatcgtcttgcgcttgacgattcacgaccttgccttgcacgcaggcttgtcacttgtggcttgtgcgtagtggctctccttttcgtatagacttccaggcttccagcttcatgagacgaatgcagaagactatacgattgttttcttgtaaagtcgtgtttcagagaaataacactcagcacatgttggagcatgtagaggacagatactaaccatttgtaaattaaagtttcgtttggaaggctgtgtttagttcaccctaaaattgtaagtttggttgaaattagatgatgtgacggaaaagttggaagtttgtgtgtaggaatgttttgatgtgatggaaaagttagaagtttgaagaataactttgaaactaaacacggcggaagtgtgtttcgactgaaaatttcggtgacacattaaaagaaacaagcattttgtgtatgattaattaaatattaattattataaattttaaaaatacatttaattaatttagaaagaaacttctatatttatgatttttgccgcaccatttaacggattgtaaagcggtatagaatgtagcccaagttgaaataccaaaattttcccacccaagcatgtaacttgtatttcgttgggtgtttgtatgaatgttaatagccgccaaatcaatagtccattaatgttatattctattatctaaaaacattgtccattgatagcgcgagaacttacccaagacctaagttcccaatatgttagtagggtggagaaacaaaatagccataaatttgtttcttttgcccttttatataaagacacgtactatttaggttgtgtttagttccacgctaaaattagaagtttgaagaaattagaacgacgtgatgaaaaatttgaagtttgtgtgtgtagaaaagttcgatgtgacgaaaaagttgaaagtttgaagaaaaaagttggaacctaaacagggccttaatgtattcttttcaaatagtacacgtttgtatcctcatcagtttgtcaagagctgattatatatcaaaacgacttattagctataaaaaataatttatgaataaatattgacaaaaaaaactacattgaaaatactctaaaattaacttaaaattatgttttaaatttgaattttgacatcagctgattcattgtaggataaatcatgaggctcttgctaggggataaattaagcacatattctacacatgtcatattcagattgcggattccacttcaacatcttacgtgtactccaccttgataaaaagaacgtgcttcacgagcctacaactcacaaaaaggataaaaagaggcaaatactttattttacaggagtgtgacaagactaaaattacctaaaacgaagctgccataaactcagtgcgtgtccattccacgtacttttgaagaaaaagatacatctcttttttttaaccgggaaaaacacattcgctgcgaagtgtgtgtagtttaacttcttggaattaacacgggagttcggatttacgactatttatttagtggtagcatggtaggtggaatacccatacacaatgaaacactcacgatgacttcatcaattataaaactagaggatgccccgtgcgttgctgtgggacttggttaacatcaatttgttagataggaggtacaatctcaagaagaaacagaagaaacaaatagctttcttggagaaattctttttaacagctctatccaaaatttgtagataatttaggtagcacatgtcaactgaaggggcgttcagccataaagctcttttatacggattgacgggctggatacatgtagatgtgtgtggagatggaccaatttgttcatgtgggctacatttggcgctgaggaggtgaagagactcactcggtgactaatgggttgggctctatgctgcattccatccaacgtctgagaagcgatctaatgcattcatccaacggttcacaatttgataataatgtggaagcatgaggtttgagcttttggccttaactttataaaaagaagggatatgtcagtctagtcatccgaaggtattaataggatgtgatgtgcatatgtgcattgatagggtgagcgcgcgcatagtgaacgtctagatttccgtgtgtttctcaaggaaaaaaaaggggaaaaagcattagtttcacataacaccatagcatcatgtaacagaggaatgggctgaagtggatgtgcagttttgtactagtcaacaaaagccggaataagttcactttaggtcactcaatttattgcctagtttgaaattcattcctgatccacaatacaaaatatgacgcacctctcaactctcaaaaccagttcaagtaagatcccaatatgttttgaacaacagtttcaactaatgtggcatctacgtggtgttgacaaagtcaaataaaaccatgggacccacacgttagtgagtattcggttaaaaataaataaattgaagtgagacccatgtacagggtggagtgagatctgcaaggtgtctggagggaggtggtggagtgcaacgtcgtgtcttgttgcttctcatttgccgtggtggggcttatcgttgtccgcggcgttgccgacgccaatgctacaacaccgggaggaaggagatggacgagctccacgcccagggtacgggcctgcgggccctcgcccagtacacgtgcacacatcgggtcggtgaaggtgcgctggtctgtgagtgatggctgaggtgtctttgcggtgaagaacattgaggcggggcaacaaaaatagcacatcctctacagtccacaacagttgactcaaatctcttagcaccaattttctctccttcctcccttggctaacatgcacaagttcattgggaagagaaaagacaaaacaaagagagtagataccagcacggggctacccacatacgacaagaaggaagcaaccgtagggcggcgacatgttggcggcgttggggaccccgacaccggcggttgcaggcattgaaggaagcaggagcaggacccgaccgacggtaacggccatagcagaggctgaaggaggaccccaacgggtagagtcggcgattgcgccacgggaggcacgaggaggggcctactcccttggtcggcgacaaggcaggcggagcactgatgtagattgagagactcgcatcgaccacagcgataaccaatgcaactagttggagtcagcgttgacgagctgggcgacgactagtactcgagggtgacgacccaaatctagatcccgtcgagggagaagcgactaagagcaagtataatagtaggctacaagccggctaaatgctgaggtggaggagagaagagaggagagagaggagaagcggactgtaaacttacagccgacttggacacaagaaccaagaaactctatgagagaaataagtgggccctatattaattgtaaagagctaactattatatgggtaagctaagagaagactacacagaaccttctagctaacaggtcggctgtattactagccttgctctaagggaatgcactcaaggcatgtcggtcacggtaagtagggggactcagggtgcgtgtggagggcgacgaatgtgctatttttgctgactcaaatctctcagttcacatgtggccgctaacatgtgggggccacgtgggtcccactcgccacgtaagccaaaaccgatcactatactgctaagagaccaaagttgacattgcattatgagttgggggatgagttatatctgatatttcagttcaggcatgaattttagacttggtgacaaattaaaagacctaaaggaacttatccaacaaagccatcccttaactcttaaaggcctggtacgagtctatccagtgggcccatttcccaacctttcggcctaggaataagttcatccaacttccctctatttacaccgaatccgatttttgtcgttgaaccccaaaaccagatacaaccaatttatgaactgtcaaaacctgtgcaaacgaggtccctcggcggttttaaaagcggttttggctgacgtgacgtctacgtggcgatgacgtggcaattatatatcagaaaaataataaaaaacataggcccacatgtcagccacacaaaaaaaatcttaaaaaaggtggggcccacatgccagctaaaaataaataaatatggtgggccccacatgtcatctccctctccccactcggctctctctcttcttcctcgtcacgccgcagcatgccgccgccgccgacggcagccgaagcatgccgacggagcggcagctgcagcaggccgcgggcgaaggggcccacgaggagcggaggggcgagcggagtggcgacagcggcagggcgtgggcggagcgcctcctgcctcctcccgttcctccaggggctccccaacctcccgccgctccgcgtctccagcagcgcgcccgtcacgccgccgctctcgtcgccgacggcgtcgcaggcacccaagatcaggaagccggactagaacgtcgaccccttccggcaccccttcttcgcggtctccgcgccggcgagcccgacccgcggccgccgccttgagcacccgaacacgataccggagtgcgacaagtccgacgtctcgacggtggactccggccggtggttcagcttccagatggccaccacaacgctgacgtcccgcacctacaacctcgtcaacccggcctggtggattgggaaatttcagggtgaagtcttcgattcgagtccttcctgtgcatgcaagaaagggcgctgtgccgtgaggagatcctcagctttgagcatccatggggttcctcaaccttgtgggcaactcctttgggtgctcggcttccggcgagcggctcgtctcggcggccagggacggcgacctgcaggaggcgcgcgcgctgctcgagtacaacccgcggctcgcctggtactccactttcggcggccgcaactcgccgctgcactacaccgccgcgcagggtcaccatgaggtgatgccatttgtttgccaaactagctgaagtatcagtgtttctgtatagatgggtaaaagaactgcaatactgcattcacattttctgttgcttgcatgttcaaattgtttctctgttgctcgaatccgacgtcaagatcaacctcaggaattacaggggccaggtaaaccaagatttctggtacatttaattgtttaagtttcgacaaggggtgggtgatgccatgggagggcgagaggaggcggcgtggactggggcgaaggacggcggccgcacaggaggacatgtggggagagggagatgacttgtggggccggatgtaggtggcgacatcggtgtcggagtggccatcaaaaacggcgaagaggccgacctcgttgtcatcctaatctaggtggcgaaactcgggggcgacctcctcctcctctgggcaccgccgccgccgccgcccgcgccctgccgccgccgccgccgccgccactccgcccgcccctccgctcctcgtgggctccttcgcccgcggcctgccgcagccgccgctccgtcggtatgcttcggccgctgtcgtcgtcgtcggcatgctgcggcgtgatgagcaagaagagggagagccgagtggggagagggagatgacatgtggggcccacgggcctcaccatattatttttgtagctaacatatgggccccatcatttttagattttttttgtgtggttgatatgtgggcccatgatttttattatttttctgagatataattgccacggtcatcgccacatcaatgtcacgtgggacggagacctagtcaaatggcgccatatcagctaaaaccgccttcaaaaccgccaagggcaccggttttgacagattggggaccggttgtatctggttttggggtttaaggacgaaaatcggatttgttgtaaaattaagggacctcggatgaacttattccttcggcctatgattctatggaagcccgtcatgaccaagcccacaaaaccagagccttcccattcccacaaaacctacgcacagttcggatccgaccactccacgtctccacccggccgagctcaacctccgcgccgcaccggacggtcgcacccgcgtctcccacctccccggcggcggctcccctcatctccgccggtcgcctcctccaagcctccgcgacgcgcacggcagagatgtaccgcatcgccgggagccacttgcgctctctcaaggtaccgcaccctcccatcccgatccttcccgctgcaaaaccccccatccgattcgcccgacgcggggggcgttccgtgtaggaattgatggtgattgtggctaatccttgtttacttagtcagatgttgaaacgggagatagattgtttgttgtcccacgatgagaagaagaaacctgcatcccgatacatttagcggtcactgattctctctagcacttaccgttttcctgttaaatttattcagataacgcagctgaagtcctgtaaatcctttaaccaacatttttcgtgacggtgcgggatgctatgttgaatgcacggacgccacattttcttttgcctattgcattatattattttgactttttaagctgttttctttgcttgtctgatctgtctagaagtgttgggttgatgagttatcgctaactcaatacacatagtgcttatatcatcttttcagattgataatgttaatacgatattttgagtttttttgggtaaggttcacctgaatgtttaaaacaactattttaatgtaactattatactgcaatttgattccaaagggaaagggtgatgtatgacagtataagttaagctgcaaagtttacttctcggagatttcttttcgcaatatgatcttgctagtttggtttttcagtgaccactgcctccagtattttctgtaatttgtatagaatttttttcatgtgcaagtttttcagtttgagtaccttcttacttctaagtaatttcacctcatgttgtttctgccacattatttgttttcctttatttccataaaaccatatcatgtatcataaagacgcatctcttttgcttatgtggttgcagagatacagttatagtaggtttgctagtacaagtgttgtgaagcagtcttcaggtggtttgtttagctggcttcttggggagaagtcaagccaattgcctcctcttgatgtccctctcccgggtattacccttcctccaccactgccagactttgttgaaccgtctaagacaaaagtcaccactctcccgaatggcatcaagattgcttcagaaacgtcagtggtatgatggtatcactatatgccttcaggtgttttaatagattctcttttttctgcatcagcatgaaaagtaaattttttaggacttatctgcagagtccagcagcatctgtgggactgtatattgactgtggttcaatatatgaaacacctgcttcatctggagcatcacatctgttggagagaatggcgttcaagagcactacaaacaggagtcatttgcggctagtacgtgaagtagaagccattggagggaatgtctctgcatcagcctctcgtgaacaaatgtgctatacctatgatgcattcaaggcctatgtacctgagatggttgaagtgcttattgatagtgtgaggaacccagccttttttaactgggagattaaagagcaggtattctgtcattccgaaattagcatttttgatattctgtatatgttggcattataataatgatgtcttgttccccctacagctggagaagatcaaggctgaaatagctgaagtttctgataatcctcaaggtttacttctagaggcactccattctgctggctattctggggcactggcgaagcccctaatggcacctcagtccgctattcataggttggacagtagtatccttgaggaattcattgctgtaagattcatcaacttgccatttatattgtttttttgttagaaagtgcgtgctttgacatatgcttgcattgatgaattcaggaaaattacacagcacctaggatggtccttgcggcatctggagttgaacatgatgaactagtttcaattgctgagccacttctgtcggatcttcccagtgtgaagcgtccagaagagccaaaatcagtttatgtgggaggagactatcgttgtcaagcggactctgacgtgagcttttgctgctttacgctgtttgttgatgaggatgtgtatatgtacttataatcctggcttccttttcatgaacagaagacacatattgctcttgcttttgaagtaccaggtggatggtttgaagagaaaactgccatcattgttactgttcttcaggtattgttggcaaacatcaaatttaaccattattcagagacaaaactcaactatggtataccttttatgtagtttactgtctagtagactgccttatatgttcaccatttctttatacgcaatatggatggtcttgttattttgcagatgctcatgggaggaggtggttctttctctgctggtggtcctgggaagggcatgcattctcgattgtgtatgttgaattccacattcttgtcaatgtttcaaaaaattaagttgacttcttgtgccaatttcttaacattagcgtgatgctttatttacagatctccggatattaaacaactaccatcagatcgagtcattctctgcattcaacagtatctacaaccattctggtctttttggaattcatgcaacaactgtgagccccttatcagacatggatgatcctgcttttttttttgccaaattcaagaagtaaatgtagtttagtgtctgtctttttataccaaatggaatagcctactctagtagttattataatgtccattatgtgtatatctggtcagtggtgaacccagaacaaaaattgccgggggtccaatacattattacttaattattgactgatttaatagtttaggacataatttggttaggattgaataatctatctggggtcctgtgaccctgggaagctcaacataggcactccattgtatttggtagttgatttgtgtgcacaaccaacctggtctcttttatcctttctgcttctgggatttacacaccatcttacgcatggaataacttgattgcatgaggcctgtgatgaaaccgggcaaagcagccagtgacctttgtaaccaaaatagagaggtcaaaagttccttaagtaggtgaagagggagaattttagtgcctttattacggatataatagaagctagaagcaaccaatacttttgtgggatgtgtggaaagcatccatctggaactgtgagaagtattgtttgcatacttctctgtttagcagggtatatggcaaatgggcacatcgcctgctctactcatttgttttgagatgtttgttatgcattctaccttcactccatatctcctatcactatattgtacaacaatttgtaccatttttttcctctttctagttttccttggaaatgaaactgtgcaaagggagtgagaagattgactaaagccttgtagagacatcaatttgcatccatttctttcttttcattttgttgtgttcattgtgctattaaatgatagaatcacttgtcagtaacactttttgctactcctttcatgatatataattgacacagctttatgtcttgcaatcagagcccaaattttgcttccaaggctgtggatttggcagcaggagagcttcttgaggttgcaactcctggaaaaggtttgcttcttatttgacatattggatatttataaggaccatgcccatatatattttcctcatggctgtattttttgtgtagttacacaagaacagcttgatcgagctaaacaggcaaccaagtctgcagttttgatgaacttggaatccagagtatgcatttctaaccactacttgaatcctttgtgcttatcttttgtttcctgttgtatccttgacactttgttttcttcactgcaggtcgtagcatctgaagacatagggaggcagattttgacgtatggggaaaggtatggttgcaccagcattggtaacatagcaacaaaagtcacctcacatggttcttaaacctttatgtgcactagccatgcattcactatcatttatgagctatgattgtgcaatcatgctgtgtcctgacaattttaagaacgggaactttagcatgtcattaaaatcatagtgaaacctacaaatatatgttgtctattgagatgtcaccttcagtatttacacaagcatagagctttgatccttcaactgtgaatgaactacaacagtttgctttttgtgtagtgttcgttttttgttgtgaacatacatgctaagttcattctagttttaacatgcattactattgacatttctctatatactactatgaagagggagtatgtccgtttacttggaactcggaaaatccagtttgaataaactaatctgtatagccgcctgtgcaccgccttgctgatgtaatgacatcctgccaatgtatagcactccgagcaattgaacaagatgattcctctccttagcccctctcaatgtcgatcttctataattactacaatagtaatgtatgttttatatcccattgaatggcatggggctgggcaatacaaatagaccgccggatgtctatataaccgtagttgcatcaactattgcggaatgaggattgccaacaattttctgttagctagtcagtggtcatcactattatggcaatagaccgtcgttcagctttttacccttagttgtgaatctctaactattcagctttgttgggatcgcaggaaacccattgagcatttcttgaaagatcttgaagcaatcaccttgaatgacatttcttctactgccaagaagatcatttcatcaccccttacactggcatcatggggtgacggtatgttctaacttaatcttcatcaaagtatttccttgtgaggattatgtaatactccctccagttttttttatatgacgttggctagttcaaatttgaactagtcagcgttatacatataaagatggaggcagtactaccttttataaactaataattttggacttgtgattcactagaatgctttcttgcagttattcatgtcccgagctatgaatctgttagccagaagtttttctcaaagtaagcaagcctatcgcatggcttgcccccgacttctaaagttgcagacgtgtaactctactggtccttggccctaaccgctggaattcacaataataaattgtctagacttatttttcttagatattttaattttaagcaaataatagttactcaaacggcgatgatgctgactgtcctttttattcttttcctttattatattgatccataattttgcgtcaggctggaactatttttagttccgcggtggtgttgttgttttttgttttgttttttttttgtcgtgctgagcttagcacagctgagctgttgcgtatgtgtcgtgacttcaagtctatgcatgctgaaatcgtcttgatgatttttccattcatggtgagccgttcttcaatattttaactgagttccccaatgccattacgtattattgtcgcattttctccaaggctgaagcctgaaatacagttcttttcctttttacttgaaatctcttccctcgtttcgcatctgaccttctagtcttctagagcatacatgagccattcttccgtatcctcgtgtaattttctctgtgatctagagtagtttgtattaagatgtgactttatactttggtgtgtttgctggtatatgttggctgcgcgggtttcaatagctgacagtgtgtacgcttctacggttccattcgatggctgcattggtacggggtactctatctgtctcataaaaaaataaatttaatatagaatgtaacatatttagtactacgaatatatgtatagaggctgtattatgaatttaaacatattcttgtttagatttataataggaaaaaatacgaattaccctaaactatgacggtcgactgaattacccccctcaacaacaaaaccagacatttaacatctttaattttctaaaccggataaataaccccccttggtgctgtacaaggtggttttagtcctatatgatatccacgtggcaatgtattaatccagtcagcaacatctcaataaaatgaatattctaaaattaggtggtcccacacgtcatgctcttcccgtcttccactttcccctctcttcgtctcgtgcagcgcagacagaaagcgacggcggcagtggcgctctccagggcgggcgggggaagcggcggcgtccagggcggcgaccgcgccctccagggcggatgggggaagcgacagcttccagggcgggcgggggaagcggtggcggtgacggcgccctccaagtcggacgggggcagcggcggtggcggcggcggcgccctgcatggcgggcgggggaagcggcagcggcgacggagccctctaggacaggtgggcaaagcggcaggggcaacggcggcggtcgctgacgccgtcgcggtcttcttccccctcgtcggaaagctcacgtacgtcccctctaccggcgacgtcgtcgttgactgctcgccatctgccgttggggacggggcgacagcgacgcgcgggcgctgtcagccgccgagaggcacgatgtcccggcgttcttgcggctcgtgcccagcctggaggcccccgagctccccgcgccattgctcgccgtgcaggtgacgcggttcgtcggcggcggggacgggggcggcgttgccgtgcaacacgccgtgccggacggccagagcttctggcggttcatggacgcgtggtctgcgccggccctcggccggccatctgccccggcgccggtgtttgaccggtcggcgatcgtgcaccccatggccgctgccatggctcagcgcatcctccggaaagtgacaccagagctaccactggtaatctcatttttgtatgtgcgcatgtgcattttttatgaaaattcattaagtcatctgatttttagcgtgttctacagattttcatcgaaatttgtagctcctcactgcgaatttgttgaggcgaacatggcaacaccacgacacgactacgctagagctcgagcgccaccgcatcgccgacatcaagaacctcatcgtggagctcgacgaggccaccacatcccccgggcgggtgcggggagcagcggcggcggccgcagcgacagatcggcggcgtccccccgattccccctcccatccgcgcccaccgtcggccagagccaccaagccgtgcccgcagctgctcgcccattgacgcctaacaccaacgtcagagaagtgacagagaacaaggggttaatatgacatgtgggccctatattattttattttattttattttgctgattggatttccacgtcgacgccacgtgtatgccacgtagaaccaaaaccgttccggattgagtcagggtaattcgtccggtttcaatagtttgaggtttaatatgtctggttttgtggttcgggggggtggaggggggggcaattcatactgtcgtaaaagttcaggggtgtaattcgtatttttttctttataatactaagatgtgttatataacataatagatttgttttttatggaatgagagagtatgcgttatgccgcacaaattgtatatttccgctgcagtgattcccttcttttcttagcagtattgaatttgtcaatatgtccattcgttgaatcagaagtagtacttaatcaatgaatcaccgaaatgagcctttattctggttcccccaagtttttttgaaacgtccaatatatggtcctctccttgccttgagtttgcgacgtgacgacggcgcattgggcagaaagccgtcggctgcttaggacaagtactatgggtattcaagcacaagcctcaatatgccatataggactaaatagtaaggtggaggagagaagaaggatgagagagaaatagtcacctctcatgcaaggggcagcccctatacaaactttaataaacatgtgagagtgttagaaatattggggattgtgtggtagaggcaacctaggccctgtttggttccatgggctaaacattagccctcaccttttagccctgaattagccctcaaggatataaacaggtgggctattttttggctaaagtgaattagccccgctcaaaacattagcccctccaaggggtgctaatagggtaattttatgtggggaccataaaaagcagctctctctctccttctctctcctctctttcttctctctctcaactttttagtcttgaattagcccatggatccaaacatgccaccctaggctaatgcttagcctagcaattcatgactaaacattagctctcaaaattagacatgggctaatcttccaaacaggcccctattatacatatcacctcttaaattaattatatatgtcatgcatgaaattagatacggtagttacctctactataaaaattgcccttacgggagcagacccttttagcctttcttgttatctgtgggcgacgctacctggatttgaataagacggacggactgttagtataatactctgttaggatctaggatctattatattcgctctctttaccgatgtctagaaggatatgcttccgcgttctattcttgcgactcatcttctactacacctgaagtcttgattccagatggtggggttggcaccctattcctctgcttctcgacggtcctttgcttttcctgaacggagcgcgtgaaatggacttggctggtctgaactctgaactctacacgagcctgtgttgccccgtttaccccatccatgatgcgccaaaccgtcgaggcccaaggatgcacctcaaaacctactgcgattcataggtccaaacgtgtgaaatcacacatactatgggctaatagtaaaacacaagttttgagcttttctgaaagacagtgaggtgctgcggtaaccagccagtcggtgggcgctcatgtggcgagatgcgctgaggcgagagggacgcagccaccaatgaccaatccacgcgccccgctcgtgagctccactccagcgccgccaagtgctcgcgatgggcgcggcatctcacacctgtcgacaccaggttgggagttcgagttgggaaaacgcccggtggcccgaggagcagcgattccgcgaggacgcgcacacgctttgcatccgagagcagtgttgccatgacacgcgcgcgcgaatcaccaatgcgaatgaagaaccgtggcgtgggcgaccgtcacgttgttccctttggacagatgagcgctgatttgctgaccgtctcatctcattgccttctatgtagacaaatatatttggatgagctgatccaccatgacccttttaaccacacgacaatgcatacgcgattgtttgctttcgaacagcgtagacaatttttttttactggaggaacaacaatgtgtacaaatttgggctccttttattttaagtgttgaatctagagaacgtgatagagatcaaatgactcattttggtcatattatatggtcaaaactcaaaatcccacaattaaccatgacgaacacctgtcaatttcgatgtgagaatatcctcctgagctcaaattagccacccactattcacaggttgctactctgtgtcctaaacctgacacgaataagcgcctcataagagcatctccagcagagaccctaaatacaattcttaaacagtttttaggtgctaaggacaaaaaataaactccagcaaagcccttactatatgccctaaaataggaaggacctcaaatacccctccgcagcccttaggcctgggggctgtagaccgaggccctatcgccgtttttctacgcgggaggaaatttcctggcgtgtggtgtctgtcatccctcccgcggaatcgctgccacggcgccgatcttcgccagctcgctggttccgccgctcgtggccgacggtgcgaccatccagtacctccaccggccactgcttgtcgtccgcgtgcccgcttgcttgttttttcatggtccttgatcagttcgcacactgatgcactatatggtaaacaagaatgttctgaaattcatgaccatcagaaacatgttctaaacaatcctgctctcgattggtttatggctaactgtggttctaaatgatcatggcataaaaaatattgttctgttcctttaaagtttgtggtgcttggtaggttgagacaattaggctgcttgcaattatgcagtagttccttcaaagattattctgcagtgttgttcttttgtgtcagttgtgagttgaagtttaacttcaaggttttttttttctaggaggatttaagctctttctgaagtttctcagatagattagattggaaaaggtatagagttaattttatctattgattatacttcttatttaattgaactacgtagtgtcttgaatacttgccggtaggatttcactcccatgtttgagaattttgaatttgaattatgatatttaaaattatggatttgaatacaattgaattctatgcattagaaatatttgtatttgaattattactatgttaaactaggtgtaagcatagagtataatcagaaatacaagagaaaaagaaatgggggctaagaaatagggtctgctagtagagttggagataatttttgaattcttagtaaatggggacagccctcatttaacctttgatgactctaaaatagtgactactgatggagatgctctaagtcataacccagccatctcatcgttaatctctcggcggccggctggcagcagaaaccaccataccagaaaccgctcttctttccccttctccacgcttcgcttcgcttctctcctctcttcgccgagaaatatttaaaccgctccccaccggccacctcgtcggtttcgtccggtaagagaaaaccgtttcttttttttggcgaatcgcattcgcgcactaccaaacaccaacgcgagctcggaaagctactgatggcgtctcacatcattctgccgaaggaggaggaggcggcgctgggcgtggcggtggaggaggaccacgactcgccggcggcgccagggtaccagcatcagcaggggccgccggtggcgaaggcgctgccattctcggccacgtgcgtgcggatctcccgcgactcgtacccaaacctccgcgccctccggaacgcctccgccatgagcctccccgacgacgacgccgcctacgccaagctcgaggagggcgactacggctacctcctcgatgacgtcccgcacttcacggactacctctccgatctccccgtgagcgccgacacccctcctcttcccactcatccttgtctcgcgctggttgttccgctgccagattcgacgcctgcggtgaaaaaaattgcagtatgcagtgctgcttgagattttgatggttcttttggagacgcggatctcgtgaaagctttagatttagttctgccatttgtgtgaggtggagctttatttggatggttcctttatttttggtgtttttggcgtgtcatgccggggatgggttctggaatgagatccatttcggttgttctcagttcattagctggatatttatcaaacagaaaaagtcgcattagtgtaggacaagtacagctttggcgattcgtacctgcaattgaggttgtggcgtggatctcttaattacttgtgcttgtaggtatctggatggaggtttgatctggtagaaatagaatagaacatagcttcactttggaagtaacttctgttaattggctggctggctgccttccctggctcctataaatcagctacatgtgcatcctttgaacgtggaatacgcaacaactcatttgtttgccttcaattatattctgaaatgttgttttcaaggtgatgtcatgggggttaagctaataattttctcgtttactgtccctggcagacttttcctaatccactgcaagatcatccagcctattcgaccgtcaagtaaggcttctctttcggtttgactttgctatcccctttggtcaacctcgtcatatttattgtgaaatgttttaagctaaatgttctctttgtacatttaccaggcagtattttgtcaatgcagatgatactgtacctgaaaaggtgaaaaaaaaaagtctccactgatgttttgatgtgtagacgtaattctgaatgatactcaccctgatgttttgccatcacaggtggttgttcagaaggacagtcccagaggagttcacttccgtcgtgctgggcctcgtcagagggtaggatgccttggatatatgcctattatcatttaggggcatgcattacccacatttaggctgacacaaattctcaaatcttatcaggtgtacttcgagtcagaagatgtcaaagcatgcattgtaacctgcggaggcctttgccctgggctaaatacggtcattagagagttggtgtgcggcttgtcccacatgtacaatgtcaatgatatcttcggcatacaggtttgaaatatttccagctgacctaaataccaaaatgtattatgtggaatatcacttagtaggaattttgaatggcgtgttctgctgacctataatgaggaaatgatttcaattgtattatactcaaatagttgcaagtgcgatctgtgaattgtattatatttttgtgcaaacgactaatgtgaaatttgtgccagctagtagttttgccatgagagtaaaagactgtagcatgcacattggtgatgccaattttttaactgcacctttcctcttatttctaacatgctataagtaattctgtagaatggatacaagggattctattcgagtaattatcttcctatgacacctaaaagtgtcaatgatatccacaaaagaggtggcacagttctgggaacatcacggggtggtcatgacaccaaaaaaattgttgacaacattcaagatcgtggtattaatcaggtaggtgttgtaactatttttcttagtataataatccttattttgaattttgggtaaaatatgcctgtgtactttgtctaggtatacatcattggaggggatggaactcagaagggagcatatgaaatatataaggtaatcactatcatgagtaacttccatatcttgtagagacctccagacattgtcaaacttcttcatctgttcatgtgcactctggcagcaggaatttgttgagtggtgtgcatttggcttaaaaattgttgtatgtgcagtgtgcatatcattagaaactgagggaaaatattgttggagttttgtttttcagaactgatttttaatttgatttttccctttttcaattggcaggaaattcgtagacgtggtctaaaagttgctgttgctggtgttcccaagacaattgataatgatatagcggtaatttatgattacaagcgtttatttttgcctgcaaagaagcattacaactcttttgatactgcacaatttttctattaaagaagtactgattttttctgtacattaaaactcaggttatagacaagtcctttggttttgatagtgctgtagaagaggcccagcgtgccattgatgcagctcatgttgaggcttcaagtgctgagaatggaataggcttagttaaactgatgggtcgctatagtggttagttttctatatcagccccatatacgtctttgctgcagctgcattcttacatttctctgctcccttgtttctttaatgctttaattggataaatatgcacgtaaaactaagagaactatattttgcttatatactctaattcaagagaactgttcatgaaatgtttattttctgcctacagaatggaattcacatattcctcatgtgaatccatgatgaatttctaacttttttgttttagttatttcattatactgtccttattccttttctatggtaccttgcagggtttattgcaatgtatgctactcttgcaagcagagacgtggtaagttaatgctttatatctatgtcgttctttagtttcttcgagtcaaatattctgtgtattcatgttctgggtgcagtaatgcattggaccacctagcattcttcttctccacgaatggtacctcctattcattgggtttctctgtcttctataggactgctgcttaattcctgagtcaccattttatttggaaggggagggtggactgtttgagtacatagagaagaggttgaaagagaacaaccacatggttattgttgtagctgagggagcaggacaggatcttattgccaaaagtatagctgcagcagatcaaatagatgcatctggaaataagctacttcttgatgttggtctttggctgactcacaagattaaggtatgcactgtctatttacttgagtttgcatgggactgatccagttcgattttgcattttgttgatagtgttgcttcacatgcgctttatgcattcatcttttaaatttccactaaaactgcaagaatgcttgctgaacaccaatgcatgtggtatttgcttttgggtttggaaatataccataggaaaggtagaaattcatacctaagagcagcattacattaaacaattttaactataaaagccatactttttatatgttcgcctgttaaaagcgatgctttttatatgctcacctgttaatcaatagaagtaagtgtaggttgaggtttacgttttgtcagttcgatgttcaatcacagttaacatatttagccagctgtatctttatgtgagtgtggtcctgttcacggattgcattcatctcttgtatgtatgttctgtaattcataatagattaggtgcatgcgtatgtaaagcttacatggctctgtgctcagtgggtcagctgcctcggtgttgagccatacattgattttgtacagtgttagtatctcagtgacccattatgtttgtagttgctatttttagtatcttatggatttccaggatatcataaccaattaattaattacaagtttccttgaagatttctctgagattttttttttgcatgaattccttccaggattactgcaagaacaaaaagatggagatgactattaagtatataggtaaagatcttgtttttatgttcaattctcgatgcacatgcggagtgctagtttgaagtactactttttatatgtatctgagtatctccctatggaatgttgcaataacagcctgttatttctaatggcagatccaacctacatgatccgtgcaattccaagcaatgcatcagacaatgtctactgcacactgctggcgcacagtgccattcatggggcaatggctggatatagcttcacagttggaatggtcaatggcaggcatgcatacattccatttcacgtgagtacaaatttttgtattaccttaattttctccggttcccagattcaaacatattaccctcaacaattatcatgaattaaatattaccctttaacagttcgcatgacatcaatttttgtgttctgacaaacagagggtaacatcaacaagaaacaaggttaagataaccgacaggatgtgggcaaggctgttgtcctcgaccaaccagcccagcttcctgagccagaaggacatcgatgccgcaagagaggctgataagctagccagcaaatcgcctgtgccagttaacaccaaggagcacggagagaatgtaaagaagccggcaaatggtgagaaatagcatgcctttgatgattctttacctgtacagtagctacgctattcggctgaggccatgaaccgatcctactcaatttttgttttcgcggttcatctccgatgcgttgcaatggatacacgcgaaaaggatcttgatcgtctacgtaataaaaaacaccacctcatatttttgtatcagagaacatgtgtgtagcactacgcactttgcaagagttctgcctattatttcggtaagagaacttcttgatttttgtgttctgcaaccattactttttctctgaagctaagtttgttttccttaaaaaaggaaagtaaacaaagataagaatagaagagaagcttgccatgtttttttcaaatggccgtttaattgaagatggtcgtgggctcgtggccaactcggcaactacttcccagctgttgcatttgttcatcggaaaattgttgatgatccaaccatgagcctggcacgtcaaactttggccgttgacggaaatctgctcccgcctcccatagaaaccacggatgcctcctcgcgcgcggcgcgaaatcacgagttcacgactacacgagggccttgtggtcaccgtcgccggccaccgcgcgcgcgatctctcttttttccagccgccgtccatgcttctcctcgcgccgttgcttcttcagccgaagaagcgtcacgattcttacttctgcgcagttgatatgcagtagtttggccctcacatgctctatctttctcatttcctcgatcgctcacgctgttactcttttccatgcatgcgtgcgaccaggagaaggctccagcgacgccgtcgtccaagagccgttcgccaccacgcctacttcgccggctgccctcgccgccggcgccgtgtcgaatccggcgctaacaccagcagcagtgtccatgtccttctacgacgtgaacgctggcgagcagccgagccgagaggacgaagccccggaggaggtggtagaggccgctgtggcgaacggagcaccgacggccgtggagaagcataataagctgtactctcccgcagaaacgccggcggggagtgggacgcggccgcacccaaccgcggacgccgtcgccgagacggcgggggcggcgcccgatgacgtcgacgggtgcacgacgccgccgccgcggccggtgcacgactcggaggggtccgacacgcagagcgcggacgatcacggcagcccacagagggagaagccaaggacgacatcgacggccgggggcgtgaagcgggacgtggctccctcctggtcgtcgaggctgctcgcgttccggtcgttctcgcgggacaagaaggcgaaggcaaccgtggacgcgcggccgccggcgcacggcaaggcgcgggatgagggcgatgagcacaaggagaagggcaaggagaggcggaaacggttttggaagtgaaggtggcattgatgcatgcacagttgattttctttgattgatttgtttgcactccatgaaataagtgagggctgtgatagtgtaattgtgatattacagagtactaatatataatcattctttgatgcaatccgtgttttgtaatcctaagcctttttccactggtttggttgcagctatgttactctttgaacacatgtctggcggaataccagaacgaatcatgaacacggcattctagacgaatatatcgcagtgaaactcggagaattgctcttgccttctcgctagaggtgagtaccgagtagaacggtcgattcgtggaagcgctatcccgcgtaacagcgccaatgaccagcgtgtgtcgtccttcgctttcacttttcctttcccctccccagcatacatgtgtagtgctcgatcaggtcgccagcgaccagcctgatcaaggctgcaggatatgaaggtcactcgtcgctggacaagatgacagtatagaatttctacttttcatgatggtgcagggggtagtagaattaatctccgaacctcgccagccaagagcgcggctaactgaaagtctgaaaatcaatcaagcctcagagtcacactggcaccccaccccacgccgtgatgactaccttcccgtccccaccacctcctcctactccggcgaagcggctgcgcgacagcgcgaggagaacccgtccgccggcacggcacgcgcgctcgctcaccgggagcgtggcggatcgaagcggaagcgtgctgccatgatgtggtgggtgtcagcggcacaaaaacggtatgggcatttgcaaatttgccacctgttttttcaatattgcaaggataccactcgaatgataattctagtggtatttttataattttctagtggcagttttgtaataacgatttgtagtaaatttgcaattgcctatggtatttgacgatgggttgggggttcagggaattgaactccgaccccacaagattgatttactacgagtacatgttaaggatggttgggtgttgggggaaacttcgacccccactatgttatgagaatagggcatgattgatttgatttgatttactctaatttgatgcaattctttcatgttaagatggttgggattggggaatcaaacttcgactaggttgtgacatgcattgtgcacaattgattttctctgctttgatgcaatcctattatgttaaggatggttggtttgatttgacaattcatttgagactaatcgcaataaaatttgtgttaggaccaatcgaccaagtatagcctgatcaattacagtggcatattgttcaaatatatcttacattaaacagctaaaacatataaaacccttctccagcaggcgaaggctagcccccctcccccccaaaaaaaaaaagaagagagagagagagagagccagggccacgccatgaagggcgagaaaccaacacttatcaagccaataagttggaactccgttactttgatccatacttggtggacaacgttagctagtacctcagagatgcctaggaaaagagtctcctccgtgttgcttaggagatatggaaatatttgatccatacttggtggacaatgttggctagtacctcaaagatgactaggaaaagagtctccaccgtgttgcttaggagatatggaaagaaagatatgacaacgttggccagtaccttagagatgactaagaaaagagtctccaccgtccgtgttgcttaggagatatggaaagaaaggaatcagagtgtttcaacattttttttaaaagtttttttacccgacttctatatccaaccagatatattcagtttttttttaaaaaaataggaacttagttacggagatttgaactcaggaccttggggtgccttttttttttttttaagttaagaacgatttgaactcagaaccttcggatgctacttaagtcactgcaaccactaggctacatgctctttcacagagtgtttcacaa

SEQ ID NO: 74717 - DNA, 139468 bp, Oryza sativa
caccaaatgtctattcacccaggaacagcagaaccagaacaacaaaatcttttatcagatggatgtgagttgtattatgaaggatttcagcagtagcttcatttcgctgctagtttttggatgaaaaatactctatctgggacatagtagtagtgcagcaatgctatttttgtcaaataaatacttaaatattttataagacatatactattgttcaggtatttgaatagcttcttagtataacagaagcttgctttgctgtagtattttgctctgctctgctctgcttctgtcagttgatccatttcttggcgccaaaaagcatgagctttccctctgctctatttttgttctcgcgcgctttgcccctgagattctatttgctgattttctttgaaagagaaataagtgattctgctgattagtagtccctaattaatcacaaatggtgggaccactgcatgcatccgttgataaaaagatgtgtggcagggatgaatgtaacggcaatgtttgccgtcagccaaaacggcagacgatgtgaacccacttcggatcggttagcgtctggttttctggagatctgatctacagaagtttccttggaatgtttacgggggagaaaaggactcggttgaaaaaaatcctttataaggatcgatttgctaaggttttgatagcgttgcagaagatccaatccaaggagagggagatgcccgagttagcctacattgtcagagaggttgcagacttgctttctggaaaaagggagattttgctttggaaaattcattgtagccaaaatcttgttagtcatacgctagccattaagggccgctgtgagtccctttctagattttgtttagaaaatgattattcttttatttctcatcttgtaagcgaggactattatcctgagtaatatattccttttcctcgcaaaaaagaaaaactaatttccaggtttagatactattcaaagaaatgttcttctccgaatcataaatatttgatttttagtactatatctgaacaaacttttgaaactttaacaatcagtaattttttaaatatatagtttaaaacaaaaaagctatatgagtaaatcgcattggcggtacacgaacttatcaggtatgtgtaatctagtgcactaacttataaaacaattatttgagtaaagtgcattagcggtccttagacttgtagggttgtgtcatataggtccctaaactctcaaaatacatatcaggtcctaaaacttgtcaaagtgtatcatttaggtcccaaatcgatacatcccctctagaatcctacgtggtgctgatgtggcataccacatggacgtgacgtgtcctttttattttttttcttcttttatttttctttttcgttttcttctcattcttctttttttttcctttcttttgctcgggtcacagagaaaggagacgaaagggaaaaagaaaaagaaaaaaaatttaaatgggtcctatttgtcagtcaaaatgatgccacggcatgtccatgtggtatgccacatcaacgccacatagaatgctgaaggggttgtggcgatttgggacctatatgacacactatgacaagttctaggacttggatatgcattttgagagtttagggacctagatgacacacccctacaagtttaaggaccgcccgtatactttactccgattattttgttgtacgatcttacctagggtgcacgaaccaagattagaaggacattattacatggctaatcttatagattttataggtgttgattaggatactatgcaaatatatactcactctgtctcataataaaaaggattttggtggatgtgacatatcttagtacaataaaactggacagatagtctgttcagatttattatatcacatctatccaaaatcccttatattatgggacaaagggagtatctaaaaagtttgccttttaggtcctgttcgtttcttctaccatcataggattaaattttggatacttgtggcgcgcttttcaaactgctaaatggtacatttcgtgcgaaaattttctatatgaaagttgctctaaaatatcagattaatccattttccaagtttgtaataattaaaactcaattaatcacacgttattaccacctcgttatatgtgaaacacttaatctttatctttatcttcatcttcatcttctggagatttaaacaccaccttagacatgcatatattcagtaaaaagacaaaatgaggcgtagtgattatatagaactagacaaagatatgaaaaaccgagctatgatacatgggttagaaacatatgaaattcatagtttcaacgatgaaggaaagtagagatgtttataattatagcttgtcttatgcatactcactgtatgtgtgtacgtcacatcctaattaacatcaacttgataaaattaacattaccaagccattttggtccttgttcacacgaattagacaatttcgtgtatcaaagcgagcgttctataagttaggttaatgtactaaattacattcacataacaaggttatgtatcaccactacaatttactcaaactatatcataataccatcaactcatttttataaacctgtcttactataaaatcagtgcccaaagtatcaaaatttgaccataatttatcctaaatgtaaaaaatatctacgatcgattggagaatacatataccatggcaaaaggttcgagattcagatagacaaagaggcaattgcaaatttaccactattttgaatcgttattgcaaaactgtcattagaaaattacaaaaataccactagaactattattcgagtggcatccttacaatattgaaaaaaccagtagcaaatttgcaaatgcccccttagacaaaagatactcaacatattccagggaatatacgctgaagctcgaaatcccgttaaggttttgaaccaaacactccatcctacagaaacgaaatttgcatgctcatgcggagcaaacaaataatgcatgattttttgcgtaagcctccaaaactcgtactgcagttctccaaataaatgggcaactcactgatcactactgacgatataaaagagcccgaaaatctgcgaatcggagaagagatcccgcacggacacggtgggccggagcaaaacacagaccgttggatacgaaatggacggcccgaacgagacccaggatataatacgcagcgcagaagaaaatcaaacggaccaacacgaaaaccctcctcctccgcccaaccccattccttctcacccactctcttctcccgccgccgccgccggaggaggcggctcctcgtcgtcggcctcgacgaccatggcacggatcgtgtcgcgcgccctcccgttcgcctcgcgctcgccgcagctcggcgcggcgctgatacgctcggcgccgatgcgctgcccgcccctccccgccgcggcgcccaccgcctcgctgctctcctggcgcgggttcacgccctcctcagagccctcgcgctcggcgccgccgccaccgccgctgccgatgccgcccttcgcggggttcctcgccggcatccgaagcttccgcaggggtaggcgcggccagtcggcggcgaggcgtgcgcagccccaggaccccatcccttcaccccctcccgcgccgaaggagagcgagatcgagctctacgcgcgaatcggcatcgacgatgacacgcccgaagaccccgaagtgctggtacgtacgctactcgtggaacttctgtgccaataatatgtggctgttttagatgaagtcaccggaatcacagattgaaatgttcacaagctatagcgcggcattctctggtttactggatgatttatgctcaatcgttgttgtactatttctaatcaatgtagaaagtcctgacttttactcttgtgatttctgctccagtccttgtatgctaatttatggttagcatatcgtaactgttgtcccgaattggttgtgtttgccattcgctaaaacgaattgcacccttcaggcagctgagcatacactttctttgatctagaggtaaacaagtgggcaatgtagtcagaaatcttcgtttcaaaggaagaaaggtagtcagaacctaagttagcaggtattttattatgacgtgatgcagttttgaaattggtttaggcttaggcatttgggtatcggattatgtcgttttgttgtttgattttattcatcaagttatagtggaattccttggttgattttggtttagtagtttatatccctccgagcaatctgttgcatattttgccaataaaatggtgtgctagaaatgttgcattttcaatttgtgacgttttttgtttacttatgcttctggtaatgtgaatgcagaacattgtagaaattctaaaattaaatgttccgatggcgatgaaaattgcactagatgggcttctggattccaactacaaaacacgagacacttcaataagtgatgtcgggaggtatgataaggttgaagtttctgtgttgctatgcaatgacaacttcatccagaaccttaacaaagaatggagaggtgaagacagctgtattgaaatgctctcaatgtcacaatacattcctgatcttgatgttcctattgtaaggaaaaaaaatcctttatttgaatgctgttcttttagacatgccatcttgttgtattttctgaatttattttctcgcagctaatgttaggtgatattgtaatctcagttgagacagctgcaaggcaggctgaggagcgaggtcatacacttcttgatgaagtgcggatactagcggtatgctcacttgcttattgactgtcattagccccctaccgtttagaggtttgaatacacatgttatctttttcttggtgaatatccaacttccttttaccaaatcacttaatcctatgttattctacacatactaaaacacagataatatggtacaaaattgactgtttacttactctgtattaggttcgtggaattctacgtcttctgggttttgatcaccaaacaagtcatgagtctgcagttgaaatggagaaggaggagcagctcattttgaagagtctaaggtggaaagggaaaaatcttgctaagagtgttcttgattcgggcaagcgtcatacagaaacatcggatggtgtgcttttttgagatttctgtagttataatcctttccattattttgatcttgaaaaggtgctttcacacacatgatgataatgtagctattgctgcctaagaatgtttacagggcaagtgacaagtggtctaaaaagagctggaagcctaagattttatagaccaaaattcaaatatatcttctgtgatatggatggtatatcatttgctctttgcatatatcactactctagacatgtgtttatatttaccagtgatattttttaatttaaaaaggtacactgctcaacagtaaaagtcaagttacagcaaggaatgcagaagctctgagggaagcaaggtcaaggggagtaaacatagttattgccacagggaaggtactacaagttcttcatttctgtaataacttaactgtcccttgccagcccaggccagatcttctggatcaccctgtttccaccattgctgcatccttttccaagccaagccagattcaagtctcaattataaaacttgcattacgctaatcttggtagaatatgttaataaaaatcctctatgaggacacttgatgtttattgttttcattttatgagctgaaaggaaaaaattactacaagtagacaatcaagaataccctctgttctgccagcctatttacgtttggccctgtcatatttcagtaactcaaaatgctgataattgtttctcatacatgttcattttggaaataggcacggccggctgtcattgatgctctcaatatggttgacttgtctggaagaactggaattgtctcagaatcatctcctggcatatttcttcaggttggtggaaagtattcatggacaacacaatatttcaagaaataactttaggatacagtggtgaaaatgcggcatctttacacttcctggtagcatataatctaataggttgcaaatatgctaatggagatccttgtatcatatttttgactgaagagtgcatgccacttgcattgtgacctttatggcaccgtacttaaatctgtgtaaaatgaacaaaattattgaatgttttttcttttactcttaatttacgcccttttttcttgaattgagttaaagcgtgaaatttggttaagtgacagggcaatcattcttacccccctgcattttaatatctgttgaatgcatgttgcttgcaatacatccttttggtgccctaaataaacttttgatgaaatgaaatatagttgaaggtttatttccttttgcattttaattctttgcctttttcttgtatttgttgagtgaagtgcaaatgttagtcatgagataagtcaattattcttacctccctggtttcaaaagctggctatactgtgttcatagaacagaaaggccgctgctgatgttgcctgtgcagccttgctaattcgaagcttacattctacattttatggaaaagaacaaaaaaaagcatgacagcatcctttgatcaggccctagtggtctgtgcttctgctcagtcctataatgtgctaccctaagtcaatgttaccttgtattcagtatattaatatgcgctatgcctttattttccgagctcagtcaatattaccttgtaacatcctttgatcaggccctggtggtctgtgcttctgctcagtcctataatgtgctaccctaagtcaatgttaccttgtattctgtaatattaatatgtgctatgcctttattttccgagctcactgtttcaagactaccgcgttgttcctatccagtagataagtgaaacagtttattgttcatgtgtgcatgattcccattctcatcagattgatgctttcatctgtagggcctcttggtttatggtttgcaaggaagagaaatttataaaaggaatttagatcaagaagtatgcagagaggtaagctacatttttcttccttataggcattgagaccataaatgtgcatacaagaataatttagatccaaaaggctacactttcagggtttgcctacttaatgatatatcacctgggatgtatctctccagctaatggactaatttagatgccctcttatgtccatttaatatatagatgttagctggacaatgtagagtctatctttctactccatccgttccaacatataagaatttctgcgtgttttccaaaatgaatctggtgggagggatgcccggatacattttgaaaaactcgcagaaatgcttatattttggaatggaggtagtaatagataattttattatcttagtatccatcattaccaatttaagttagcgcttgcactgtgtagtgacactattggcttattgcaggcattgttatattctttggagcagaaggtaccattagtagcatttagccaggaccgatgcttctctatgtatgatgatcctttggttgattctctccattatgtgtatcatgaacctaaggtgtttgctggtccttggtcaagtaaattttagctgtcatattcctattaatttgactgtagttgtgactcttgttgcaggctgaaatagtctcgtctattgatcagcttttaggaacagctgagatacaggttctgtgctctcttaacaatttttagaacactttcatgattagttcagcatgaatcattttaatgttcctttgcttaaatactaagagcatccgtctagatgacattctggttggtgattcattttctcaaaatttgttccaagtggttggttcataaaataagaaactactggtttagttactataaaaatacgggctttcttttggacagggtgggggagggggtgtcctagtcctaccatgtattttacttaaccataaaataaattaggttaatatatcttatacaattggaaccctttaaatgcagttattactcttctcataaaaccacatcgtctcgattgtttctagcctttggatgattgatctaaggtgcagactacacagagcaataaagcgagtcttctagctacaaactataaatccaccttgcatctcatgtctatcgtttcgtcatgcacgtttctggcagcaatgttgtatattacaatctcaaccatttggataatcaaagattaatgttcattgaagcaacttgaaggcaaaaagatctgcttcgcttaattactcaatagatgtgcaaggcttatagaaatgcgcaaacagccactatatgaaccacttccaattgaataacaaattgtgatttgtgctgctgtcaacggcttccgtgatcgaatgccactagtcaatttctcaatatgaaattcgtaatagaaaccaatttatgcaacaaacaagttgctcattttgactgtggctgacattttcatatatggggattactctattagcaatttgacgatgctaagatgtgtagctgtctagctgactgcattataattttcatgttcagaaagtgctcttccttgaaactcctgagggaatttcttctgcattgaggccattctgggaaaaggcaatagaaggaagggcccgtgtggttcaagcacagcctgatatgcttgaacttgtacctcctgcaacttcaaaaggcaatggggtgaagattcttttggaccacctttgcattagtccggatgaggtattagtactttagttctctattacatcttattgcatgacggaatacaattgatgtcatcacctatctagttctttcaattatgaaaaaccgtcatttaaatcttggtcatacatatgccacaaaataaaatatttgaagtctgcactgagttttccaaaccaattgcccagtgatctagcggtataagtagatttaaaatggatattagacctctgatcttccatcaaaccattgaaagcccacctgcaatccttctaacttcaactttatttttttcttttgcaaggtaatggctatcggggatggagaaaatgacatagaaatgctacagctagcatcattgggtgttgcgcttgcaaatgggtctgagaaaaccaaagcagtggcaaatataattggtgccactaatgatgaagatggagtcgcacaggctatttacgactatgctttctaacagctgctaactctaaggcgtattgggataggattatctactctttggttctccccagtgccctggattcaccatataacaagacttgatcaccatctatccacaagataatactgggatgtgatctgaagccctgttggagtcaaaacattttgaactattaggcttcggttcattttttggtttggcaaacattcatgaccagccatgctacaatttgtgtgtctggaatatttatagaattgaattccttttgttttcatctttgatgaccaaaggactcccttaacgttaagctgttcttcttcttcttttaaccaaggcaattggatgtactgcagacatatgctttaaatttcgacagaaggctgttcatcatccccaggcagtccaatgaaaaatttcattgtagtatttacaaacagaatcgatgtctccttgaacaagacgactctctgtatatggcagagaacgaaatcctcttacatccgtgacaggctaatatgcttgtcaacaaaatcctcaacgaaaaaagaacagagatgaaaccctgaccccccaaaaaaaaaacatttcgatactgttcctactgatgatatccgcttttgtttacaggaattgggggaggcctatagagcatgcttttggtgttattcctggccatcagatttgcgcaagaacttccagacttcttggctattgatgtgctgtttgcgccaggtatatgacaagcttcctggttcccatccagtgctacatagctcttggatgatttgatcttcttgtatggattctccttcttgcgtagatcctctaggcatctcacctcagacatacatgcaaaagattgagactttccgtcgtagtatttggataatcctttcctgcaaagaacaacaaagcacttgccctgtgagaaaattttccttttgctagtacatctattgatactaatatgcaactcttcttccccaggaacttacttgacagggagttgtgccttcatagatgacagatcgtagaggctatctgaattcatccttctcgctggctgctgcgcaaactggtcttcttgagcttcagcttcctcgctgtctgaaaattgagcctcatcatcggagtcgcctgagatggacgatgatgtctcgaacaagtcttcatcttcttcttcacggtatactggaaggaccgcagctccaccgaatttgcccatgctcgcagtttttctggcttctggaacaaagacaccgaaagaacaggtacgctttgtgtatagaactatggatatattcttcttcctctcttgcttcctctctttcacaatctttacaacgtccggtggggagggtgggtgtatatatagctccagctgaaatgggataacgctaagctgccttctttcaaacactgcacagtgccctttgactaatataatcttacgcaatttgcatccatgacatcacctatttgttgtgtttacatggactagttaggtcttttccagaacactgacatggacccatgagcatggctgcttgtgtgcctttgtcccagtttttgccgaaataaaagaaagtaatgaaaaaagagcgtgaaagttggttggccacttccacatgctttcccggattctgctgctggtacccctgatctgatcttatcttcttagtttgttgaatgggacccagatttgttcttatatccctttggcaagttggttttctgagactgacttgtaggccatggcatgttatggtgaggatgatgcctcatcatgttaattcttttttgtggggagctgagcgaggacacgaggcgcgctactgttggcttatgattctcgttgcaggctgagtcggtggccgaggtagaacgcaactagatctttcaggataaaccttttcattacttaacccggagtattttggggaaatcacgctaatagtagaactttggtgccttcaattttttactataacaacctgttgtttttctactttctgaacagttcgaaatggtgagatttctaagtagtattaattccgttacgtcgacgagggaattacggctcttttagtccttgataactgccagaaaatactcttgtgcctcctaattcgggacaaatttcagcatacgaacagtgtgagtggagcactagctgcacaaggggtcctgtaagttaactgttaatttacgtaatctcgaacagtcttagctttcaaaacagagacctttttcctcatttccttcaggatcactgctcactggttccccacatactcatgtttctcgtttcagcaatgggtaaattgagattccatggacccccaatcagagttcggtgagtaacacgtgtatggttttccgcatgacaactgtgattgcacttcgctgtgttacttagcctccattacacgcaattttgcgagagaaaacgagaggcaactaacatacgtccagcgctcgaaataaagttgtattgcatcgcatcattggtaacagtgctaatgcctgtccattagaactcactagatgctgctcaacttgagctgtgtttagttcagtgtaaagtttagattttggttgaaattggagatgatgtgactgaaaaattatgtgtatataacaggttgatgtgatggaaaatgactgaaatttagatctaaactttggatccaaactttagatctaaacacagccttagagaagccgatacacgttcctgcggtaggatactgtcgatcttagccacattgtcatgtatctggggtttctttaagacttgagaacttaatcaagtattttgatgtagatagtataatctacaaacgcatatataattcgacacgactaggacctaacccaacgcgacgtggtgagctgttcaaaaccggacacctgtcgcgcgatccgtgtacgcgccaaggtgcatgttcggtgggcgaaaccaacaacagcacctcgcacgtctgccattaacacgaactcctgataataatctaaaaaatgcttttataaaccgacgagacagaatgccctgggtacacatggcacggacagcatttccggggacatggccacaggtttgattagtggaccaacaaaaccggcgacatgctaatctcttactcgtcatctcgtgtccgcgtgttgctctgcacgaaggctgtctgtccacgttctagagatgcaaattgtgttgcagatcaaagcccagaaatgcgctcctgctgtctttgcacttttgatcgcttttttcattttgttctcgagccaattgcatgtcctaatccgtgccattaacctcagatttgtagtcaagggatggctgcttagaatctgtactatggatattgatgcccccttatccttaatcctccttatccaggcgtggactgcttcaagcttcgcgtggtgggcaagatgaaaatatcatcccaagtagtgttccatgacgtctcactcccgtagcgaatttttgacttgtttacatagggtgagtttgaggaggaggagattgagaagattaggaagatatgcaaaatgagatgaaccattagcgcatgattaattgagtattaactattttaaattttaaaaaataaattaatatgattttttaaagtaactttcctatagaaaatttttataaaaaatataccgtttagtagtttgggaagcgtgcgcgtgaaaatcgaaacaaactcactcactttcttccgctgccgaacgcagccatattgtgctcgtggttggggaacggagcttctcttccggaaacattcaaacacgagcttgctacaagtattattgagctcgacgtacacgtacgagccttcctcccggctgcatctatctcctgtcaggtctgaatttttcctcatctagctaacctttttgttgcgacttaagactattcccaggtagaaataggatttttcctctagaaccttttcgtgcgttcaaaacgcgtcgaccctggatagagcgcaagccaaccaaccgcgctctgaccggcttggctcgcgcgcgcggaagattatcattggatttggaacaacacatgtttattccgctcactaaacatgaccggtggcctgggcgagagccatccatcatcgatcacccaaaagacgcgtttggctcgtagtcgtcttataatcccaagcgataagggttcgcggatcgtgccgggatccggcgaaagcgaccgagcgcagtagcatcgcgcggcgcgctgaaatcatgtggcacgaggccggagggagcctgcgatttttgcgtggaccacggctgtactacctgtccaggccgcgcgccagccgccgggaacgtggtctgcgcgcgctcggacgaaacgcgcgcatgtggatagctcgcggggatgggatcggctcggcgccgcgtcgctgttcgcccgatttttattttcgatctcttcggcggatctctcgcctgttccgtgcgaatccggacgggcgggctgaaccgcctgtgcacaagccaggcttgcaaattgcaaaccccgagacgcgtccgcgtctccgcctctcacgcgcgcacgtccggacgcgccgcgcggaacctgacgattttttttttgtttccttttccgtatccgaggggcgagggcggccaagccaagccggcggccgcgcgcgcgcgcaggcgacggcgtctccactcgtcgtgggcggtcgactcgcctactataatcggtgagcgatccatccagcacaggaaaagccggaaacccgggtcgtctctcctacagcgcgcgtggagagatgtaccgcggctcgtgtagggctcgtgcttggtcggagtctgcatgcgggatgttcctcttgggttgggtgccgtggccgtcatgggagcggactccggtgctccactgtagtggatgggcgaaccggaataaccaaaaagacgagaaggacgtgaaggctttgatgggcgcgagcccagtaagagcaacgtcaatagccaactattgactcaaaacatctaaagccaatctaataactcattcatacaataattaattataaaaatatgctacaccattaatatctggtctcacctctcatacacacgtaacatcttggagtccgtgttgcagctggctacaaatctgtagcccgctttcttctctcttctcttttcttctcgatatatggttatagccggcttatagcctgctattgtacatgctctaacagtggatgccttagggcacccacaatggttatctataagctctctacaacagatccatgtcagcatattttcctacttagaagagattaaatgaagagatagagcaaagctatctactaacatggaaatagtttatagagaaaaacaaggcaatggattagagagctatagatacccatgtagacataccattgaagtggtttattattaatttagtctattgctgagatgtacatattttatagatagcacattactttaccattgcgggtgctcttatgtattccgttgagacattgcaacggattcattcatgccgcgtgcgaatcctgcacactgtataactgcatgcgaatcatgtgtgctaggcatgtaacatactccgtatttctttgtttcagatagttgcgtacagggttcgctaaaccgttcaagatgagcttatcatatcacacggtttaacggatattacggtaaacacggttaccacaaaaccgtacggttattacgagatatacagtggtttaaaaaactttaaacgttattacacgtgataatcgcacaattttataaaccctaccatccctagggaaaaagtacatttgataaaacaacctagagtaagtgatataccagatgtggctatcaccttcaattttatccatatcattcaaacaaaaaataagaggcaacatatacaatatgtcacctctaatacacaaataccaatatctctaatactctcataatttttttaaatttgtgtggaggttgactcttgatttaggctcaaagtaggtttatagtagactataagtcaactgtaaacttacgtggaggagaaagaatttttaaaaaataaagaggattgtctccaatgcaatagctagttattcacatatttcaaatatattaaaggcatagggagagataaagagagagaagaaaaatagagataaaattatagctttttctactataatatgagctcatagttggctttagtattgaacttgctctcatcatctctctccccacttctctcctccaactcatcgctcaattatatgtgatatttttaggggcaatacatgaatcattataacacttgctcttagagcaggtacaatagcaggctataagccagctacaaacatattttaaggagataaatcagaagagagaagagcagcgggctacagatttataaccagcggtagcacgtactctaagatgcaatgtgtgtatgacaggtgggaccagatattaatagtgtagtatgtaactattgtatgaatgggctattagattgaccatatatgagttgaagctactatttggctatactattaaacttgctcatatgagattctatctttttaaggaaaaaagagctaaaggatgtgttcgttactccagttttttatcttttactttctcattttatttaaatgtgcttccgaacaaataaacaatgtgtttttcaaaaaaaaaagaaagttatagagttgcttaaaaaccatattaatctttttttctaagtttttatgaataatacttaattaatcgtgcagagcaatattattttccgtgtgaaaggaaagattcgatgctgtgtaatgccgaacgcacccaagcctctcgtcgaagcttatctaccgtagttaaattttaaaatttaaatgttaatctgagaatagaatttggtgttattttcaccgtggtccatttcttagcatttattttaagccgctaataatatactctctttgtttcacattgtaataagttaatctaggtttgtcatacgtcaaaaaaaaaattaaactcaaccaatttaacagaaaattacaaaaacatttctgacataaaataaatatactataaaatatattgattgatggattcaataaaaatactttagtgttatggatgctaatatattttttctataaacacccaaagtaacttataatatgaaacgaacagaacagagtagatgtgtgaaagtttttgctataaattattttggttatctttttgcatggcttatcagtcgtacctcaaaagatcaaactatatgcctttcaagatgaaccttaaggcactgttgcacacccgttaacgatggatttactgtaaaaaaaacagagaaaaaccacaacatataacccgcacaattaaaaaaaatcaagatccgttacaaatagatcgaataacatgtggatactttttttatatcatgacaaaatattggcaatgttgaagtctagatggaattggcatcaccaatattttagcaaactatttgtttgatggcatatttttttaagcaaaccaaacatttgcaaagtactactacgtccctcatataagttgttttagttttgttcttagttaaaattctctaactttgattggttttagattattttttaaaataatatttttaaaagaaaacttcaaatgttatagatattggtatattttatttttataaatttggtcaaagtccaacttataacataacttaagcaccttacatcggagataataggtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagggcagcaacttgcgaagtccatcctcgcgcgttttggctctcctcaagggcgtttcagtggggagtacggctgacccgattgttgagacgagtggcggtttcaactctcaactgacggaaggggagacgcacgcatcgtcatctgaccggccgctcacccgatgaggcgagcgattcgatcggatgggcggatcgattgggttgggttgcattggattggattaggcgcgggaatcaggtggcgacggacgggtggaagttaggacggcagcgcagctgcaagttggccggtttctttttgtatttctctggcgtggtcggctggttcagctagccggtcagatgcatggagcggatagagtcgatttctcttgtacgagtagatcacggaaggaatgatgatatttttcgtacataggcctagagaatttttagggcgtttcgtagtggatgggtcaatgtatggagcactgtgttttaataagacgggaaagctggaatccaagtagaaactcctggagacaccgccgcgccggggggacaagcatcgtgatcggtaggaaggcgatgagcgggagaacaacgatacttgcttaggtcgagtacgttagatcttccgcgttcttttcggcaattcggcccactgaacacggctggtcttgcggcccacagtagcggttggcaatgtcagtttattgacttcctgagctcaagctacgcctctctgaccatggaatcgtttttttttttctttctcgaaacaaaaatacaaacataaagctcgtgtacatacttcccattcgaaacttgagacaggtgaaaattaagcaagggcacgtaaaataaaaaaaatattaacgcatgattaattaagttttaattattataaatttaaaaatagatttatttgatattttagagcaactttttatataaggttttcacacaaaacatatcgtttttcagattaggaaaacatactaacgaaaataaagtacaatctgcatcttaaaaaaaagacctcacttttataagggcccctttgatttggaggaagatcatataaattttggataatttcaatcctatagtaaaatttcatatgaaaacctttgaaacaaaagattgaattatatgttatcttttgaaattcctatggaatgaacaatcctataaagattttggaggaaatttagtaagagctacaacctcttggaaatatccctttgagtctatcttgctcgtccgattcctatgtatttcctggagtccaatcaaatgatcatttttgtatttttcctatattttgcaattctctgttttgcacttatatttctattagaatcctatatttttcctattgctctatttttgtgtacctatgatataattataaaggggtcccgaaggaacacacgcacgctacctctacgtgcatttatgagatattgtactagcacatcttttgattaacaaaatcattataaacatctagctatcgaaggatacatcacctgtgatagaaataaatgaacgtatcgtgtaggatatgtttggttcgatacgatttaaaaaatgtagttttgaattttataaaattttgatagttaccaatccaaacatacgttaaggctcgattctgtttatctgattagatgatagacgatatatcattaggttttgtgatatttacaaacgaatgaactaattattataactattataaagttgaagtgtttttaaatactatcaaacttgtacataaaaaagttctgcaaaaatcgtacgttttactagtaattttgtagcttaacaagcttattcatcatgataatttatcctgtgaaaggaaaataccctacgttacctatcccaacttcccaagtcgtgtaattctgtaaattctctcacctaacaccacacaaaagtgacgaggctttaaacttaaaacactttcgcatgcttgaacgtgccagcttcaaagcaaacagaccctgtgttttgaagggagaaattgcaacatatggtgaaatgaacgacggacgacggactgtgcaatggcccattatctcactgggcccggtcgtgtgctgtttaaccgcagatagaggatgatgaatcttgttaggaagaagattattttacctccctcaagtaagagctgagatataatcgaaaccctcatccacaaaaccgggtcaacttatcgtctactgtaagacacggtttggacattggtttcgtcatacataacggaaaacacaagaataataaaaaataatggacctcgcgtgttagtgttagtaggttagaaaaattaaaacaagttatgtgacacccacatgtcaggagtactttctcctagcttgactcatccactcagtctctatgcatcctatcttggtggagaggagaagtgtaggaagagctcgccggtggtgcatgtagagaaggcggcgatactcaatggagaaagaggagatagagctcgtggccgaggtagtgcttggcattggaaataactagaggctcaacacctttccgaggacttcctcctgttgttccaagactgcctttatcttgggtatgctgtagcccctatgccatcatcgggcctagccgcgcacttgttagatcgatagtacggaagctactcacatcgtgcccgtcagttgccgctgctcgatggactagcacgattgggggcggcgaagggtggcaaggcctagatcgtgagaccatcgttgctgtgcttcccgatagctaccgcctgcgtctaccatcccaaaagatctcccgacgacgacgagtttattttccacctcttctttcctctatctccatctgccaccatggtcgatcttgtgcccgtggcccactcatcgagtactcgattttgccactgttagcgccttgctctttggcggcggcggcctgctcgctttcctccgtcgtagattgacgagtaactatgaactaggacaatgtgccatgtaggagtggataacgagccagctcgcctcggctcattaaccttaacaggctaaaagcctagctcagcttggctcgagagttggctcgttaaactcattaatatatatttaccaacttcacaatttcaattttacaagtttaccatgtataaatataataataaacactactatctccatcacagtattagtgcatccagaatataatgtgatatatcttagaactacgagtcttggatgcacttaagttaggacggagagactatctaataatgaattcactaaatacaaatagtctggatataattaaatgactaaacactacttaagaagcactaagtatacatgaagatatgacgatctcttatattaaaaatgcgtttgaacaaaacaagatagctataagcgcatgattaattaagttttaattattacaaacttgaaaaaaagatatatttgatattttcaaacaactttcatatagaaagttttcgcataaaacacgttgtttattagtttgaaaccaaggtaaaatcttcatttttttttgagaaaagaacatgacctaagtctctccataaaaaattcttaagcatatgttattttctagctttttaaaagagaatgatatatttgtagtcttcatatatccaagacttaaatgaagatgttgttttttggttttgtaattctaggttaaattgataatcagaaccgaaacaaccattttaatattcatttttttacatgtatacgtataattgccttttttacgtagtacttacatatatctacctataatagatcttgttatgactatacaatggattttggctatatatttatatatttagtataataaaattaaatagacttatattcagatttattgtattaagatatattatactctattcgtccaaaaaaattaacctaggactgggacgtgacataattttagtatagttttttatttttttaatggaaggagtagtgttcataagaccatcagtgacgagcacccaccaccagtccgatctgatcatttgtgaaccgtctgatatgtggagaaacagtacaacctgaggtgggctttaaataacgcctccgcttcccaaaacgccaaaaagcgcgccaaaccaagggacgctgcctttgccgctgcgggacgggcccacgccgtgtgtgtttttgcgggcggactgagcttaccgatgcgacctgtccctgtcactcccgcctcggtaaccggcgcgctaccctcgctttcgcttgctgcaagagcgcatggccgtggactccatggaccccctcctcctactactactgggagaatgggcccaagctcctgaaccagaaagggttttctcaagcatttaagcgactgttttctcaagcaaagcatctacccaaatgaaaaccaggagcccaggatagaatatgtcgctaatgagcctgtctaaacatggtaaagtacactccacacgagtgaagaagcatcaaaacgcgtaaacgacccggttctaaagtcattttttaccgcggctcctcagctcgaccgacatgtggtggtccatgtaaaagaatctccccagccgcaaacattctcgcattctccacgactccactaggcacacttttttttctctctctcttggtccgattaccactgatacggacgtgggccgcttttgtttgaacactctcaacccaattttataacgcccacctcgcgtccgcctcggcacggtcacgcacgcactccactgcactgcactgcccgctttgttgctctgtgcctgtgggctgtggcgtctgtgaccgtcaggcgtcagctcgtgtcctcgcctgctcgtcctccttcctctccgctggtgctctctctctcttccctccacgactccacggacggtcagggcaagggcacggtctcgcaccgagccacgggcgcacgcatcgcgaaagcgcggccaccggcttgtgttgggtaggaggactggcaggggcaccaggcggcggagcggagctcgggggctcggacgccaatggcgcatgtggcttttgttgcgctcctcttcttgctgctcgtcggtgagtcgttcaaccacaccgcgttccttcttccgttgctctcgctgtttgcgtagtagtgatacttttgtggggagagtgttcagtgagtgagtgctactgctagatgccttgcttgccggtgagtgtagcaacctgcagatgtgggacaagaatacgattcttcttgtttcatggtccagttgttacgatgcacattgaacttgttcgttcttttggggtgaaatcactcattttatcgatgtgtatttcaagattgtttctttttttttgggagatgaagaaatggaagagaaatgatcactaaaactatgaaaaatgcatgattgcaaatgtggcttttgcagggcattgcctcggaggcaaggttggcatctgctacggccgcaacgccgatgacctgccggcgccggacaaggtggtgcagctcatccagcagcagtcgctcaagtacgtgcgcatctacgacaccaacatcgacgtcatcaaggccttcgccaacaccggcgtcgagctcatggtcggcgtccccaactccgacctcctccccttcgcgcagtaccagtccaacgtcgatacctggctcaagaacagcatcctcccctactacccggccaccatgatcacctacatcaccgtcggcgccgaggtcaccgagagccccgtcaacgtgtccgccctcgtcgtgcctgccatgcgcaatgtgcatactgccctcaagaaggccggcctgcacaagaagatcaccatctcgagcacgcactcgctcgggatactgtcccggtcgtttccgccgtccgcgggggcgttcaacagcagctacgcctacttcctgaagccgatgctggagttcctcgtggagaaccaggcaccgttcatggtggatttgtacccctactatgcgtaccagaactcaccaagcaatgtctcgctgaactacgcgctgttctcgccgcagtctcaggatgtgattgaccccaacaccggactggtttacacaaacatgttcgatgcgcagatcgattccattttctttgcactgatggctctgaactttaagactctgaagatcatggtcaccgagacagggtggccaaacaaaggggcagctaaggagaccggagcaacacctgacaatgctcagacctacaacactaatctcattcgtcatgttgttaatgacagcggcacacctgcaaaacctggggaagaaattgatgtgtacattttttcattgttcaatgagaacaggaaaccaggaattgagtctgagaggaactgggggctgttcttccctgaccaaagctctatatacagtctagattggactggcagaggcaatgtggacatcatgactggaggaaacattacaaatgcaaatggtacttggtgtgttgcttctgctaatgcgtctgagacagatctacagaatggtttaaattgggcatgtggaccaggcaatgttgattgctctgctattcaaccgagtcagccctgctaccagcctgatacattggcatcacatgcttcatatgccttcaacagctattatcagcaaaatggagctaacgatgtagcttgtgactttggcggtactggagtgcggacaactaaagatccaagtaagttgccaccattcgtatgaaatctatatcggttatagtaccattttacaattcctatgtactacctactagtggatgttttggtgaggtctgcatcatagtgttgtagctcaatgaaagcatataactggaactagcatgtgctgattatgacctgtttatgatggtaagtggtaacataggtccttgaccgaaattgtagtgatagctgatagataagctggtaatagatgctgcaatactggctaaatttctgacttgaactaatattcaaatgtttatggtttttggtgacatggataatacatatgtaagtatgtaactgtaataacatgcttgttgtcaatttgagttgtccgttatatttttctggttcgctgttctcttgtgcattgctttgtcttgcattatctcttgggagtttgctaagtgttgataagtattgttgatttggcatgtatggtattcatgctctgctctatttcactagttaatagtattctcaatgttccaactctgttgatcttgtggtgagaacactaataatgttcgtaggaaattcctagcccttgtgcatggatcagcacatgcttttgtaaatcatggatatcaaaatttgatgatggatattgtgtattaatatgggttaccgatgggtaggttgctggtccttagaccttagtccttcaaaatgctatgtggaagtggaacaaccttcaagaccaaactaaaattataaagatattgatggttacatccatgccaattattgttacaatggagattttgcatacgctcgattgtttagtactactagaatataagatgaaggtatattgaaatgtgatgatgaattgttttgcttgcgtgcaggttatgacacttgtgtttatatggctgccgggtatggaaaagctttctcatatctttgttcaatttttttgaagcattttttcaccaactcctttgagaaatagttctgctgactattgttttttcctcccttgaaggagtaagatgagcacaacaaattcatccaaccttccagttcaaagtgggttcagcccatcgcgattcgacaaaaacttctacctgttgttctccatgctacccattatgattgctgcatgcattgtgtgatatgttcggagagagatcttgcagaagccttttgccatggaggatggaacggtaatcgcctgatactggaaaccagtactggtttgtttgtcatagttagcggagtgttgtagtatgactatgtagtaggaaactaggaattctcttgccttgcgcggacagcatatatgagttagcattatgaactaggaacattgcagatgatgtctcttggtagttataatcctattatgctcgctggatttttcagtgccactaattctttgctgctacctttttttggggacatgtttgctgctattcttcacatgatctgatcatcacatataataggggggctaatgggcgattgaccgatcggtttgccccccccccctccccctatactcctccctcttctcccccttcctcctccccttcttctctttctactacagtacaccacacaattttttttaaaaaacaaaagttagaaaaatttatgtatagaaatactatatataaaaaaattgaatttaaattcaaatttaaatcgggtatgtaaacttttgacttataaactttgggtctataaattttagttgtataaactttagatgtatagaaatgctatatatagaaaatatttgaattcaaattcaaatttgaatcagatataatttaaatttaaatttgaatcgggtatgtaaacttttgacttataaactttggatctaaactttagatgtatagaaatactatatatagaaaatatttgaattcaaatttgaattagatataatttaaattcaaatttgaagcgggtatataaacttttgacttataaactttaggtgtataaactttagatgtatagaaatactatatataaaaaaaaatatttgaattcaaattcaaatttgaatcggatatataaacctttgacttataaacttttggtctctaaactttaaatgtgtaaacttgaggtgtataaactttaggtgtataaatttactaaaatagaaaagtaatgcggtgacaaaaaaagaaaaccaggtggagggtggggggaggggatcgatcgctgtcctaacccgaacagcatttccgcatataatatcgtcttgcacctgtggctctgaactcaattgctcttgggctgcaccgaaaactattcagcccaagatttgttttcttctcattttgttatgtttagcccaggggaaaaggtacacccaaggtccctcaaccttgtcatcgagttacaaaatcgtcccctaaccacaaaaccagatatctagcgtcccttgactagttaaaaccggtcacaatagatccttcggtgattttgaccccggttttgtcctacgtggcaactgagacagcgtgggacccacatggtgcctaaatgtcaggctgagtcatttctctccccctcctctctagtctctagtctcttcctcggttcctcctctctctctctatgtgggtctgtaggccggtcggaggtgcgaggcgggagaggagggcggtgccgcgacggcggccggcggcggccgcggtggggaagcacggcggcagcccggtggagaggaggaggaggctggtctgccggcgccggagctgtgcggtttggtttggttggttggtgaggggattcagggattggtttggtgtttagtactgtacgtgcacgatggcgacgtggaggagcttgccgcggaggccgacggcgatggagatggcggccatgacggccgggccggtcaggaacctcaccgtcatggcgaacgtcgccaccttgttccggcacgcgatgatccgcggttgcagcgccatgaacagccctgagagtgaagaaacgtgtttgtgttggtaagttgcaagaactgtgttgtgaggtaaggtgaggaggagaatgaaccgaggctgaacatggccatgccatggccggcgtcggagaggatggagatggatttcaggagattgatttcccattgtgattatcgatggcctgcattgctccatcgattctacagtgaggacggagccgagcatcggggaggcggccgtggggagggtcgcgcaggggaccaaagtcctggccgagggcggtcacgatagaatattccggtatgtgttcagcgcgccgcccgacgagcagctccgcaggtcctacgcatgctacctctccacctccgctggcccacgactgttcctcatccgccgggctgccgccgtgcttccccactgcggcggccgcggccgccggccgccgtcgcggcgccgccatcctcctctcctgcctcgccccgtcgacgcccgcgccgtccgcgcacgtccgtgcctccccgtcgacgcccgcgccgttctcgcctcgctaccgcctgccacttccccgagcccatctttggccgtcgcggaactccgctgggctgccgccgccgccggccgccgtcgcggcgccgccctcctcctctcccgccttgcctcgccgagtcgccgactggcctagagagagagagagaggaggaaccgaggaagagaagagagggagagagatgattcagcctgacaatgtggggcctatatggtcccatgctgactcagccgccacgtaggacaaaaccagggtcaaaaccaccgaacgacatgttgtgaccggttttgactggttaagcgatgctatggttttgcggttagaggacgattttgtaactcgatgacaagttgagggacctttggtgtactttttcctagcccaggatgtgtgtcggacaggctacgtttaagcccacagtcctatatatggactggcccaagccttgaaatgttagacccacgtggtccctttttacagggccgagacatataaagcccaaaggagcttctagtcggacattggcccttcgagatagagttggagttaatgcacgtaatacgagagagacagtaacacataataataaattaagttttaattatgtacaaacttagaatataaattttatattttaaagaaattctcatatataattttttcgtacgatacacaatgtttagcagtttaaaaaagtgcgaacaaaaactatggcaaaatctacattttaatgaaaactaaggtactctctccatccacaaaagttacacatattacatattactttttgacataaagaccaagaaaaaattaaatcaccttggatgttacaaaatcaagaagtgaatataagcatgcaaccaataaacatttagatgactccttgggttctaataaaatatttaatttctctttttatttaagttttgaatgtataaagactacaaataggaacaacttatttggaaaaactcaaatgtgtaatatgtgtaatttttgtggatggaggaagtaaaatttactggttgcaagtttcaacatggtgtagtataatcaaggtaaccagtttaacatactggttgcaacttgaaagcccgaaacacaggagagtacttatctatttcactgttactgtttgccaagtgtatattattatgactttttttttactcaaagtgtgctgatcattttttggaggggaagggatgacactgcgttgaagacttctagtagtaccaagttgttccttgtttagtgccacaaaacgaaggttgttccttgtttaaactgtgccacggcgtgcaagtggcttggtgatactttttacagtgattttcggattgattagtacaaatggtagtcgagttgcagagctttgtgcacatgcatggtttgcagcagaagatcacaggaaggcaagtggcatccaagctttgatccgctgccggtggttgccgcaagactgcattgtacgccagcaacctcggcggatccggcgcgcatcctctgatgctctgatcaccagaacatgtatggcggttgcagtggcagttaaggaggcctcagctcagctgctccatcattcattagcaagttctcgaaccatcttctataaacaaatagtattgctaaatgaaatggtctggaagctttttgcttagtctggacaataggtactcgagcaagattgtttttttttttggaaaaaaaaacaatattcagaggaaaggatgtccttccgaatatttttgtaagaagaaaatgcaaatgtattgaggtttgaacactgaactttaaggttgaaattatatatcccttaatactgcactatcaagtgcatctcaagattgcaagtttgcaaccgttccagctaagggcacccgtaatggttatctatatgctctctacaagagatccatgtcagcatatttttctatttgaaagagattaaatggagagagagagagcaaagctatctactaacctggagatagtttatagagaaaaacgagacaatgtattagatagctatagatacccatgtaaacatactattgaggtggtttactattatctagtctattgctgagatgtacatgttttacagagaacaccttagagcacccacaatggtaaagtaaggtgctctctataaaacatgtacatctcaacaatagactagattaatagtaaaccacctcaatagtatgtctatatgggtatctatagctctctaatccattgcctcgtttttctctatagactatctctaggttagtagatagctttgctctctctctccatttaatctcttccatgtaagaaaacatgttgacatggatctcttgtagatagcctataaataaccattgcgggtgtccttactggtgctctaacaaagacacattatatgataacagcactaacaaatatgttcatgaatgcaacttagaactggctgattagatcggttccagaactacaaagcggcagccgcatccacagccaatctgcgaccggtcagccacgacaatcgccggatcgggctggagggttgcacgtacgcacgctctctcaagtctcacacaaccttccaccattgatcgagcgaagcatttgttgggaaacgcagccgtccaccgagcatcacgatccgaccggcccagaacgtttcggatcacgcaaatcgatcgtacatccggcgcccgatcgcgaacgaccaccacccatgcatgcatggccctccgcatgcacctcggtctcgaaccgatgtaaccaccaccacaggtccaagcgcgcggcggatggggcgccccaatccagtggcgctaccaacctcggtcaaaccggcggccaaccgaccggaggcgggccagccatcgccgggcacatgcgctgcgtgtaccgctgtgcgcgaggcgttgcacgcacctaacgcgcgcacccacatgcgccgatgcgccgttcgctcggtcgagaggcgagcgaacccggcctatctcgtccgagcgagcgatcgatctagcggaggggccccggacccggcggatcggagtagcagatcgacatgcgtatctcgctgcggattacggtgcctcggctgccgtcgcgcacgagctgcaagcacgccattggatgcttatataaaactttccgatcgaggcgcgcgcatcgtgatgccgcgcgccgctgcgtcggattggtagtgtcactcaccaccacgcaccggtggcgtgcgtgcggtgtgtcggccggcatgcagggccgttaaaaccgttgcaagttgcacgcagaatactgtgggatcagtgtttacccaggctctgattttgttttaggattccggagctccccgatcggtttcaccgtgttctaggattctgtccaagtcgctggcacgttggttggtttactgctggtgggttgacattgatctacaccgccaccccgctccaatatatacatggatgtggagtactagactggagtatttcagagactatttacctctattctctgccttagccaatcaaattactcctcttggcttgctcatgccttaacaaatgaatgaataagaagaattgggaatactcctactagtaggatgtgtttagttcacactaaaattaaaagtttggttaaaatttaaacgatgtgacggaaaaattgaaagtttatatgtgtagaaaagttttgatgtaatgaaaaagttagaagcttaaagaaaaattttagaactaaactcgaccgtagcatactgatctcttaacttacctactcctagaggggttttttttttaagaggtactcctagagtatatagagaggatttgattggtcagagcaattcatgcattttcatttagaggttcatgtcagtccaagggctgccagatagcacctgtccgcatccaaggaggactgttttatgtccagacaaaagacagagatcggattgggttccaatagcgatattcccatgtgccggccatctcgcactgtcacctcatcacattgctcatgactgtgcatgcggatatgttgctcgctagtacagagtagcacagtcaattactatccctccgtcttaacaaaactcacttttaagggcctgttttagtttaaaaattttttttcataaaaaacatcacatcgaatctttaacacatgtatgaagcattaaatataaataaaaatactaattacacagtttgcatgtaaatcgcgagacgaatctttagagcctaattagtctatgattagcaataagtgctacagtagcccacatgtgctaatgacggattaattaggctcaaaaaatcgtctcgtggtttccagacgaattataaaattagttttttcattcgtgtccaaaaaccccttccgacatccggtcaaacgttcgacgtgacactcaaaaattttcatttcaccaactaaacagaccctaaatttaaatcaaactcacttttaaatttaaatctagacataggctacgtacatgtctaaaaaaactcaacctagaaggaggtctgaaccatcccagtataacgaatctgaatagagagttattcagatttattgtattaagagagggtcacgttcttttctagatttttttttggacggaataagcatgagtgattttgttttggagggatggtatactagtatctcctagtgtggcgtatatgctaccgtatcaagggggcatacaattaatactaataagtaatctaaacgatatttctctatacatgccatgcatggatatattcccctagaaattgagcacatataatatatcgggatcgatttgagtgggtaaaataaacaatgtgttgtctccatttttcgtctcatactccattactacccccatgtttcgacatgaactaattgactcgtacgtactagtacaaaatgacgaagcttgggagactgtttaagcacgtacagtactacatgcacattatacggtgaggcccagttaagcataaattaacgccgaccggccaatataggtgaaacgttggcgtcatggcccgatcgatgcatgcatcttcgtacaacgtatggggggcagctgggacagcaaatggtgaaactatcggcgtactcgtcggtccgcgcgcccccttttgcccacacagccacacgccacgccacaccgatcggtagatcggcgggtccgcgcgcgcgaaaacacgaaatgcatgtggtgttcctatgcgtgccggataaagtccaagaatatattttagataatttctggtatcaatacaataataagagggaagaaaaaggctatatgctatcaatattaaacagtcttgctgaatatttccatctaatgaatgatataatgccaacatcagaaaataatgaagtaataccacaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatcccccaaattaaaaaagaattgaaagaagaaatacttaaagaattaaagaaagaaatgaatgacaaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgaatgaccaaagtatgaattgaatttgaatcaatccaaaatgcaaggacagtgaatgacatttgactgttaaaaatactgtggagaatattgctttcggcggaaaagaaaggcgcaggtacagaggtgtctccaccttggccaattcaaggacaaagtaaagccaaaaagaagataagcatctccatggtgcgagccagctcgtgaaaatacagtatctagaagataagcttgaagcatagtcgagcctcccgagctcctataaaaggaggggtttgctcagctgagaagaacaacgaagacaccattcagagcaaagctttcaagcgcgctctcaccctccattccaccattcttagtagtagtgactttagcctaccttgcatagtatattgaagcaaggagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttattctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagatagataggtgaggcatacggtgagtaccgagtaggactttacatcatctgaaacaagcttctgaggctgtctaaataggattcgccaccctgcaaagatcctaaagttaaaatatctctcgaagtgaacagtattgaacagtaatttaaacagtaaactaaatagtgtttttgaacagtgttttttgtccgaagcatatatatatatatatatatatatatatatatagagagagagagagagagagagagagagagacttacttttttttgttaattgaccatttagttgaccgtaaaaaatttagttttaccctcggatttcgatcgtccagcgcgcggtcgcggcggaggcatggagatcggagaggccacggcccagcgcaacacagcggcgaacgcgacgtggagcaacgcctcatgattattcgttatgtgcatacgcatgacactattctggtttctgtagcagccgtcgagcacgtaagcaaccaagctatcacacattcgtaccggtctactacaactctacaatagcgaaagcaattggtccaaaccttttttgtggttgacatgcatatgcatgattcaatatctatctattatattatcaacaccacgttcgctgtggcggctagaaattctcacattaatcggagaaaaagagaaaactttacaccattagatcttagttgtctaaattttaagggctgagatttaatagcatagaagttttaatatggtaatcagatacagatacgtgtattatagaaattggccagcagcagttagacttttcttaccaaactagcactaggaaacaaaaattgtaataggaatctagggaaaaaagctatgtccgtgtatgattttgtgtccgattgctatggtggctagctaccaaaaaaaaaaagatactacaaagcaatcacagcacgtacagtttcccatctgccgtctccaacaaaataacgaagaaataggagccagagaaagagaaggtacgaccagtacacgagagaaatagatgtatttgatggctggtccatttattcaattacctcggctaactctttgtactctactcctgttatgagggatagaaattcccacattaacccaaaaaataattttcaagtaaaaatacaatttaaaagtaactaaaattcggaattaaaaataaacaatattgaaaggagagtctatatatataagaatccaatatgagattaattaaaatttaaaatataaataaaataaaatccgaatttttttttaacaaaaagaagatttcaagtagtaaaataactaaaattcgaaattaaaaaaataagcaatgttgaaagaagagtccaaataaaaacccaacacaagagtaattgaaattcaaaataaaaaaatgagaatacaaaaataaaaatgagagtggaatacattatataaataactaaaatttgcaataaaaaagaactattgaaagaagagaccgtatatagagagattaattaaaattcggaataacaaataaaataaattctgaaaatagaaaaatatttataagagttcatataggaatataatttatctccaaataagaacccgacatgagagtaattgaaattcaaaataaaaaaacacaaaaatacaaaaataaaaatgagaatggaatacattatacaaataactaaaattcgtaataaaaaagaattattgaaagaagagaccatatagagagattaattaaaattcggtataacaaataaaataaattatgaaaatagaaaaataattataagagttgaattaggaatataatttataaataaaaaatatcggaatgaaaaatatggaattttcaaaacaaaaaggtccatttagaacactacgatgacaaatacaataaagaggggagaaacaatgagcccgtaaagaaatagagtggtggtggttgatgggacatctaaaaactataaacaaaacccgaaatagaatcaaatgacaattaagaggagggacgacaggcataccattaagcaacacggttatgacagttggcgagacttataaaaagtaaaaccccgatgataattatgttcgattttaaatatctctatgggcgggccatagaggagtacagtggcgaagccgttaatgttttggtgggacttctagaaagtaaaaaagaacacaaacaataattatgttcaattttttaaatcctaatgataaaaaagagaggatgcggtggatgggccgtagtggagtacattgacgacgtttgacgggacttctaaaaattataaaaacgaaacccaacgagacaatcaaatctgaaaactataagttctaatttttgaagttctaaagaggatgaatagaagtaatgatagatcaagcaatcaaataaaggtgtagcagaggagcaagggtagcgactaacgtgacttttaaaaactttaaattagaaacatgggaatgataaattttaaataaaatcatatgtaaaaacaataattttatacgggtactagccgcgcaattgcgcgggctacccaattataagagttaaagtaggaatatattttataaataaaaaaatatcggaatgaaaaatatacgggttctaaagaggatgaatagaaatagtgatagaatcgagcaatcaaataaaggggtgacagaggagtaagggtagctattgacgtgacttttaaaaactttaaaattagaaacgctagaatggtaaattttaaataaaatcatatgtaaaaggcaaataattttatacaggtgctagctgtgcaattgcgcgggccacccataagagttaaagtaggaatatattttctaaataaaaaaaatatcggaatgaaagttatggaattttcaaacaaaaaattcatctagaaaacagatgacaaatgataataaagatgggagaagcaacatgcctgtaaaggagtagagtggtaacggttgatgggacatctcaaaactattgataaagcctcaaatagaatcccattgatgattgaaagtaggaacaacggaaaggtcgttaagcaacacggtcacgacatttggcaggacatccaaaaaataaaaaataaagagggaaggcagcggcgagccgtagaggagcacagtggcaaagccaatgatgattggcgggacttctagaaagtaaaaaaaagaacacaaacgataattatgttcgatttaaatctcaatgacaataaagagatgagacagcggacgggtcgtaaaggagtatagtggcagtgtttgatgagacttccaaaaataatagaattgaaacccaatgaagataataaactctaaaaactataaggtccaatttttaaatgttccaaagagaatgaatagaagcagttgtaacgattgatgagacatctaaaaactattaacaaaaccccaaatataatccaatgacgattaaaagcaaggacgatggataggctattaagcaacacggtcatgaaaaaaaataaaaaataaaccccaatgataatcatgattgattttaaaatctcaaggacaataaagagggcaggtagcgggcgaaccgtagagaagtacagtggcaaagccagtgatggtttggtgggacttctagaaagtaaaaaatgaatctaaacgataatcatgtttgatttttaaaatcccaggcaacggatgggtcgtagaggagtacagtgacaacatttgatgggacttcaaaaaaaatataaaaatgaaactcaacgatgataataaactatatctaaataatgtctactacatccgtcctaaaatatagcaacttttagctatgaatctagacatatagttgtctagattcaaagctaaaaatgcttatattttgggacggagggagtaatttttaaagattcaaagagagagaatagaagtagtggttgatcgagcaagcaaataaggaaggaggtgacgaagaagtaaggagtaacaactggtatggctttaaactataaaattagaatcacggggataataaggtttggtcctttaaagttttaaaacaacgagatagctatttaataaattttaagtaaaatcattttagaaaatatataattttaaatgggtgctagccgcgcaatcgcgcgggccatccagctagttccttcgtatggtagcagtgctagtctgctagacaggctcttaattttgctcaggataagaaagtagaaacacgcctagatcattacgcgcccccacctcgcaggtgttatctcgatccagtactgccgcgattaatatggaaataaaagcgaaccgacgccagcccatgctcggtcgcaggccgcggtgtctttccaactcggtcgatcagcactccagtatctggtcggcacagcatttgcgtaggcaaccacatctccacacatacaagcagcacgtacagcggtacactatacgtagtcacgtagcaattttcgtaccgctagctgcagctagcgttgctcagtgctgttcccacgtatatctaatgacacccattctccgtttctcctgctgtcctgcatatacgagtccaagcttaataattctgccaccttcagaacaacattatgtggactcacaaaatctgcgaatcgatatattagcatgatttttttttacaactgtaacccgctgacacagatcatggagcattacaggggagaggaattgaagagcacaagagattaactagcaaagataaccagagtctaaaaaacaagaaggaaaaaaaggagagagtttgtgactaagcgccaagaaaaactcctaaggaactaggcaacaccgcaacccgaatcttctcttatgcggttaaccatcatctctaccgtgaaaagtgtcccctcaaagcacaagcatttctttccaaccataggtgtcatgtaataaggatgacgaggagagtcaaacctatttttgttgtgatcccacaaccactggcgagaagactcccactaaaccggaagcaaagattgttggcagggtgatagggaggccaatgtaacctaatcctggacaataacttgtgccaaacttgtcgcgtgaagacacactgcaccaagatatggtgatcattttcagctcttactcacacttgatcaacagctcaacaccacagtcgaagcgcaagccaaaggaaaagtttgcccttcacaggaccagtgttgcgtcaaagaaacacgacataggggaaggagattgatcccttatagaatgcgtttgttggtcgaggcggcgttatactcactgcccatccagtgctagatgaactcatcttggacgaagtcttgcagtgggcagttttgtattctatcccaaagcgcaaggaattgggagaggacgcgcatagtcagggcacccgtgatgttagagatccaagttttgccaaccaggccaggaaccatcgaagtggagttctggcgacgggtggggacgacaaggaacatatatggggcaatcaattgaactgattgcccgttgatccagctgtccaactagaatagcgagcatcatccgtctcctatgacgaccacgacagccgctcggaacatctctgacacacactgctcttgcggtagtttgaaaccaacccaatgctagagctagggtcaccacatctgcagggcctagcccatggtttggagggaagcggttcctctgacgtgaactgtcacatgacgtagtcactgacaggtgggcctgcgagcggtagggcccacatgttagccaccacgtctctctaacttcacgtcagatgatcccaatccggttcgaaggtccgtgatttctagaccctcacatttccttgggtcggtacaccttgggccaagcgacaaggcaattccggctgtagaccaagtttgaccacttccaaaggaaagctttcaaggtccaatccggcaagcccgatggcaagggagaggtgcaccgaggtggaggagaggacgagttgcaccaaggtcatcatgtccatcatagtcaagagcctctcctttcaagtagacatccagtcttggacaaaatccacaagcggttgtaggatgctcttcagaagattcgtgacggagaggggactacctaggtatttacatgggaactccacaatcgcgcaaggcaggatacgagagactactaccatatcatcttccgagcacctgattggagtggtggagcactcatcgaagttggtaataaacagcctcgaagctggagtggtggagtggtgaagcgtggcctaggtacgccattgaactggacacacgaggaagataatcgaaggataacattgtggagaggggctgggatcgccattgacgtacgccattcagggcagtcccaacccataacactaaacatggtttccataaactccacatcatcaagaaactagtactagacattactcttccaatgcaaacaccactattccatactttaatttaatgctacttatctcacatgatgtcttggatattgtgtagaaaccatgtctcatgcaagacatggttttcttctctttcctcatttattcacttgccacatcattttttgtcctacgtggcaacttatttaatgatatgaacaccatcctaatcattgggttgggaatgccctcagaacaactaatcttgcaagatttcaatatacgaatcagttaaattcccgtataaaacggcactaaacaaaaccaaagctggtaattggattgtctatttgtcttcgtcctggcggccggtcgatcgattgatcgtcgcctctcgtcgacggggactgcccatgcgtctgcgtgccacactacatttattcgagctgttaacatccagcatactcgcatgtgaggcacagctgggcaccagctgctacctgggccccgctgcgcgacaggccacgccggctgcatatatcatacaacgccccatcttatggatgcaacagcaacctagcttgatcgaattaattcgtagcgaatgccatgcatcatcatattaaaccgattgttgttagggctcataaagtcataatctcgtccacctgtcgtgtcgatccatgtcgttactggttactggttaccaacccgtgatcgatgattctgattcattctcctcgtcttttagtttctttaattttgggtgattagttgtatggcctacccatcataggccatttgtacatcttatatccacagacagtgtcagtgtaatgttggcaaacattggacaggggactcacacagcggtccttttctctgagagtctgaattagcatctggttgtttcaggctcaagtcaaaatacagtaacatggctatcttcgtgctagagatcaagactccattataaaaacttcctagggcaagtacacaagattaaggggttgtttggttgatgtctaagcttgtcataactaagcttaggcaagttgtggcatgtggcaaaagtatggctaagaaatagttagccacaagtgtggcaatattagctctaattatctgagtatgatatgtagtacctaagggtaggaaagtgtggcatgacataactgtggcattgaaacaaacacacgactaaaaactgtggcatgactgaagtgtgacgtggtaaagtgaagcaatcaaccaaacacctcctaatttcaaaaagaagaagaagaagaagatgaattcagcctacttactttgagtgggtgttgatatgaactgagcttattaaatgatgaaaatgaaacgagcagagagttgatcaatccgtgtcgagtcaatatcggccatgctgtgatacagtggtagcatctgcagccagctacgagatgattgcaccgattgtttcctctggcctcgagccaaggatgtaattacagtacgtaattggtgctattcaggccagtttttttaagcttagattaagttgcgcggcgggccagggagcggccgtagagtatttgttttagtaatttagggtttagctaggcatgcacgagccaacgtggagaagatatcgttcatgtgcaaaacggcaaatctcttcccttcctacgtactactactactagcgtcgtccaaaatttgccgaccgaatccaaactcccatctgcgcaggcgcagcgacccaaaccgggccgcacgcggctacaccaccactacatataacacgcgcgaggggagcagcagcagcaacggccgcgataacacctgcgacaaaccgggccggggtgatcgagcgcagctagcgcgcggcgccatggacccctgcgcgttcgtccgcctcaccgtggaccagctcctcctcaagctgccctccgtgccgcgcccgagctccggcgccgccggcgtccacccttccacctccccatgcttctgcacgctccacctccaggaccacccctccgccggctcccactcccgcaccgcgcagctgccgctcgcgtcatccgagtccccgggccccgtcgccgccggggagcccgtggtgataagcctcgacgccgccgcggtgcagaggctctcggcgcgccccgccgccgagctcgtcgtgtccgtgcacgccgggcagaaggggaacgccggctgcggcatgagcgccggccgcgcgctgggcagggtgcgggtgcccgtcgacgtggcgcgcgccgcggccggggagaccgtcgtcgcgcgcgacgggtgggtggacgtgggcaagccggccgcggcggcggcgtcccacggccacgcgcgcgcgcagatccacatggtcgtgcgggccgagcccgacccacggtacgtcttccagttcggcggcgagccggagtgcgggccggtcgtctaccaggtgcccgggggcgccgccggcggtggccagcggcagccggtgttcacctgccggttcagcgctgggcggagggcaaccaggaccaggttggtgacttggtgtgcggtacacgtattacaatgtgcatgcatcattccatcttcttcgtttgctcgctaagttaagcttgcggtgttaataatttgctttacagtgaccctgtgctgacaaacgtgtattttctcttcaactaagtgcttctcgtacgttgcttatatgctagttatatgtacgacggtaattgtgaagttcactgctagataagatagctagagctcatacttgggggcgaaaaaaaattcttacgttttatacagtatttagataatgaaacacagtcagtgttagttttcatggttgataaaagtgttgatgaattcattatacaagtagagttttgcttatttttcttgaaggtgcaaaaaagaaaaacaaaatcggtatgtaatcatgttaggatttaagttttcgaattatagtattcagcatgtacgtatagctagcagttggacagtatagtacgtgcccggccttggcctctgcggactgcggctctgcccatacacgcttatcaatgcaattatgcaaatgtccccatcagtccaggacatatatgatatatggacatatgaattaaaaacaaacaactcaatttatttatcttgtcatacggcaatcgatttgctaatcaataccgacttgtgattcggcaatgctcgattatttgagaaaaagaaagtagcacagctcaatgaagaatatgatgcgattctatttcatcccaactatcttcataaagaagttgaaaatcatttcgtctccttttcaatttcgcttttctttcatacggaattccttttcattattggatgccagctcttagataccttgtggtttatatcatgcaccggcactggcagtcatctgataaaatattccaactcccatacgtaacgacattttaaattaatttgccatggaagggaaactttttaaggttagaataaaatggttggaagacttgataattaaacaggcagtaccaatattccaagccacgtactactaaatacaaatcctattaagaaagttaagcacctccaatcctgcatgaatatatttgtgccattgctatttgaccagtcaggttgggttatgacatatgagaaccttcactgtcagtgcagctcagatctccatacatatacatgctttgtttatgctagctctacggaactttagtcactggactttgaaagtgaaacatacgccatggatggacagcatggtcagatatagacgacaccaaccgttcatgtgacggtcttagcattctgtctagttaccttactaatttgctctgcaaaatttaaatctttaacctcattagctgtcttcagaatcttccttgtatcatgtccaccattgccatcacctactggctactgatcttgtaccagtcacacttggcaccaacttgttatgcgctactcaaactaagcggttctttaattactagctcaaagatagtatgttgctatcttaaaccttttggtactagccatgcacgcatgcacttgcatgttactactacagagctagttaaactaatcctgcatgtgctgtttgttttgtccagatcgttgacgtcggagtcgtccatgactcggagcaccagcaggaagctgcggtcttggctgagcacgctgcacggcgaccgcgacgcgcaggcgcggcgcgagcagcgcaaggggtggacggtgacgatccacgacctgtcgggctccccggtggccatggcgtccatggtgaccccgttcgtgccgtcgccggcgggctcggggcgcgtctcgcgcgccaaccctggcgcctggctcatcctgcagcccaccggcgccgggccggcgagctggaagccgtgggcgcggctggaggcgtggcgggagcgcggccccgtcgacgcgctcggctaccggctcgagctggtgttcgactcgggccccaccgagtgcgccgtccccatcgccgagtcgtccatcagcaccaagcgcggcggccagttcgtcatcgacccggccacgttccccgtgggcgccgccggcgccgcgtggccgttcgccggcggcttcgtgatgggctccacggcggagggcgaggggagggccagccggcccaccgtgcaggtcggcgtgcagcacgccacgtgcatgggcgacgtggcgctgttcgtcgcgctcgccgccgccgtcgacctctgcatggacgcctgcaagctcttctcgcagaggctcaggaaggagctgtgccatgatcaagaggactagcagggagacgaaacggaatcaagtgcatgtacttgggggtttggcttgtgaagttgtgatgcatgcgatcactttcatgattgtgattaaattagttaactatagatattcaattgtttcttgtgaaagtgatggcctgtggctgtttttagtttaggctgggtcggatcacaagaagagaaacgtatgctctatattctttcctcgcgatattcttttgattctttttaatttatatacgtttctgttcctcttttttccttctgaaagtctggaaataaactcggctgcccgatgcaaatctgccctttggtgtctctgtagactgtagcctgtaggtgcctctgatgagttgatgtacactacacaaattgtcttttcagtcaacaggttaattatactatcttatttttcaccatcccgcacataccaatacccaaaaaaaaaagaataccctcgttttatcaaatcccaatacaattatttatcactttatcatctcccaatatattaattcttcactttcacatatttcgatgcaatgatttactcaaaaactaaacttatttgggataaatgggatgtcctaaaaataaacttatttccgaacggaggggtagctatttttggtgtggaaacgttcggccaggacagtgcccattggctgatgggcttaaacctgacgtgtagcccattttcggttggccacggggctgctactgacatgcgggcccatgtattacgacggaacggggctgtggcagacctacggcctgttaaggtacacatgggccgttttgggcaggttgaggtgtatttacgacccaactcgtacaactgccttccgattctggtgggcttgtgggacgtagggttgggtcagacgctttccattgtactccctccacatcaatggctagatttgtggtggcgcagcggcgccggagccatcagccatgggctcatcatcgtcgtgaagtatacgtttcagtaagtttcttcagtgcagcgtttggtgattatttaagtaggaatagccttgttgttcctttgtgaaaaaagagatagtctgttcctgtttctagagaaaaagtgtgttagttttgccgttgcgatattttcattaattctatctcttttcttgtttgctgttagcctattagtgttgtacctgatatggatgactataaacgatatggtattaaatttgcattgttcataacttcagtgtgttcaccaaaaaagtacatcctctttgttttccgatgcgagaatttagaggatttaccatcaaattcgcctgctttagggcctattaggattgttaccctaccaaaattttttgtagtgccaaaatagggcaagttttggcactaccaaatatttggtaagataagattatgtttgatcatatttggtttgctaccaacatatagtcaaaatgtgaaattgtagtaaagtatgttctagatgatgccaaatctagattaggtattaccaatgaatgggcttcaatccaaatcaaacacaactactattcaaattaccaaaatattggtagggcatgtttttggtaacaatccaaataggcccttaatttttttaccacctaatccgcaatgccctcaataatatattattagaactgttaattagtatatttgataccactttctatgtttttcatgtatttcttatttcttaattccattgacgttcaagcgttttctcagagaacgcaatacaaaatcaaagcagtattgtatatctataagctatacacataatagaactacaaaagtagtacacaagcatgtgtacaaaaaaatctacacaagcatctgtacaagtaacattccaacttcgtgcttgaatcgatcgccatgaattgtgtatatcttcattcttttccttgtacttaaggaatcaaattgtaaagaggatcaatagccagcataacatgactatccatgcaggtcaaacgttctttggcctgttggattgtttgattgctgaaacaatgtccagcctattgagttcaatgatgttatgtcaggctgccggcaagtacaacagaagcctgtgttattgccctcgcgactctgtgaatctcgtgctgtacaaacttccacgattctgtagtgttttccttccttgcactagctatagcattttctacaccaggataagatgcactttcccagtcattctgttctgatggtccatagacctgcgagaagcaacagctgccaattagcacaaaatacaaactgcaatctgaaaaccgtgatatcatggtgtaattcaaaacaagaaacaatgtaaactgaatccacacaccagatgtttgaaccattctcgcttgaacaggccttccctgttagtgaatgcccgttctgcctgcatgagccggtcattgagcgaccgtattttcattgaatcctttttcagctggttgctcgacagttgcctttgaagctcctaagaacagtcattcctcttagtcatgatgaaaacctgacctagaaggctgtctgaaatagtagaaattcttcatgtacatttacctttctctcgccatttactttggtagctgccgttttcagagctctaattgcattgtgcagtggagagcaactgatagccgttccccttacttcattctctactaccttcgtatatgcctgtgataaaaaaaacattaaaatcacgtaataattccagtcacagaaaagggaaatcaacagagttcctctctacaaaatactactggaagcatagtgatgatacctcaagttcaacagggtaggacatgtaattgaagggcaggatctcttcgtcagcaagcctcaaagccatcattccccagatgctagcagctgtaatacgaaaatgccgctcatcatgttgcagagaaagtactaacagccttcaaaaaatacagagcaatacctgcagcgtgcctactgaaccctggatctccgaatttctccatccacacgaagtcatcgtataacgaatgatatatgggatagcctggtcctgcaaaggacaaggcgaaacaagcaaaatccattaaaaagatagaagtgaaaaatccatttaaaagatggctcgatagattctggaacatgaaaacccttgccttctccaaaacccatgctggttgaaggaataccaacatgctggacgaaagctgaaaaatctgatccaccatggcctagccgtccaatcttttatgtgggggcaggtgatcagcaatgacgttaaaattattttttttcgaaatgaaaattttacagctaaatatatcaagtaacttggaaataggaattgctactataactattctgtttctaatataaaccatcttacaactcaccaagggggaaatgttggatttgacccatgaatcatacacggcttgagatgaattgtcaggatcttgaaccttcatgattggagaaagtgcatttatagttattagaaatcacaaccaaggatacgttataaacataaaatgtctcactagtgtttgaaaaaaaaagttgaaacacccattattgactatttctacagtaaaaccaaaagaaaaggcaataaagctctgccattttttttcgtcttttcccccaaaaaatgtcaacgtgactcgttttcaggaatgatgtgctcaccaatttcattgtttcctgaaatagttcgtcaagttgcggagttgcagagggatgaaataccgggccaactactgaaacgtcaacgttaagataagcaacagctcttgaggaaagcatctccctattttcttcaacccattcagttgatcctgtctgcataaatgtaagttgtgaatgatcaccattctagttgctcttactctgcataactctgtacatatatagtgcagagagagagagagagagagagagtcagagatatttaccagcccatactcttctgcatcccagctgcagaagattatagttcttctaggtctccatccttgcttttgcagcaccgaaagcctttgagctagctaaacgacaagtaaacaacacgccaagatgcagacatggccatgttctgagtgatcagtcgcagtattataaaacggtgttttggctcagcaaagttacgataaagtacagcctactgaacttcggagaaagaactttgtgccccaaaaattacctcaatcatagctgccgttccgctattgggatctgatgctccaaacgtccaggcatcacgatggttaccaaggataacatatctgcatcacaaaagggtcaaatttcagttaagtcacatcctaagttcatctctgatttcattttgtgtggttgtgcctagactttctgcagactgatacgtctctaatcagtcagctacatgatttttttaaaacgaaaaatgtgtagctgtattactttctgatctctatattctgcaggatatggatatgatagcaacaggagacggtggacatctacatccgaaatataaagtgagccatgtatagcttgccaagataatatttttgttatctacaaatctgttgaaatattgaaactacagagggagaaaaaaaatgtcaagggctcccactatccaaatgtcaagggatagaaattatacaataaatattggactagaaaatcatctgttgataatggtgggtgattgggtgaatatgtcaggcctagattgataatgtagaataaaattgttgtaattatacattcccggcaatgataagatgaaattttgtggcaaatataggcatgtaaaagtaccacggtagtgcagagtattaggtcaatggtagagcacatgaaatttttttatcggtagttatgaatcttcataattttagtgaggctagagatatattacagatctctatcaacatatggttagcaattccgaaaaaaatattgtcaacgaatggtccaaaagcagtgcatggcaatgcccaagtgggatgcatgtgttaacaaccagcacaggttgtgattgaaaatctgaagcagcagttagttagagaaataccccatgaagaagtgtatactggaggagtagagtaatttaatctgatgcaatgtcaaaaagagttacctgtccggctcctctgcaccttcgatcaccgcgaagacattctcgatggtggccatcgtatcattcccctgcaaactccacaagaaaccattggctcgttggttgcaagttgcgacccatgaggccatgactactaaaaaaacaacatgcggatttcagtgatcgagacagaaaggctcgtcgaatgttgcttacggtatacgtcaggttcaggatcgccgggccagggccgaggcggtacactgggctgccctcccggccctgccagtccgccggcgcagcgtcgccgcccagagcggcgtggatctccgccgcgtcacgcgcggacaccggcagcgcggggatccccggcatgtcgtcggtgtccatcgcctcctccacactcacgcgctcgcacccttcggacgacgcccacatcggcgtcgtcgggtcgcccacgccccggaacaggctgcccacctgcacgccggtcggcggcagccaccgggagtcggggaaccacgcctcccccggggcgccgccgtactgcagaggatcggtgtacaccaccgcggccgcggcacccgccacgcgcgcgttgtgcacgatgtcctcgcagtggatcctcccgtaccgcgcgaccgccaccttgcccgcgacgtcgacgccgcgggaggcgaggtaggcgaagtcctcctcgcggccgtagttggcgtacacggcctcggcggacaccgaaccggaggcggcgtaggcgtagaacgtcggcatgacctccgccgtggccgacgcgtaggggtcgttcgggtacgtctcctgcgacagggcgaagctcgtggtggtggcgcggccggggacggcgagggagagcgagcgctcgaccgggtaggagaggaggacggagtagggcgtgatgtgcgccgggatggagagggacgagaaggcgtcgcagacgtaggcggcggtgagcgagttggccctggtgcccgcgacgtgggggtgaagcgtgagcgcccggaggtggagcgccgcggtatcgttggaggcgagggagaggaacaggctgccatagttcggcgctggtgcggagtggacgacgaggaggagcagcgagagggaggctccgagggcggcgagggtggaggagacgacgcagatgagccggcgcggggtggtaggtttgtgcggcggcgtcagcgagggagagaggaggagggaggtggcgtcgaggcgcgacatggcgcgcggcgcggggtggtgcgcgcggggatcgcgcggcggaaggaagaggagcagagtgcggggtgctctgttctggctcgtttgcttccgtgccgcgggcgcgctgtatctggctcgcgcgctgtttaatccgcggagacaactgacaagcggaccagtggcaagctggatactgctgctgctactgccacaccggcagtttgatcgtgcggcggcgatgcgaccacagcgcacgccacaacaatggcagtgtttatagtttccgcctattcctaactttccatcacatcatattatatcaaaattgtcctacgcatataagctttcaactttgagtaaattacacccacggtacaacaatttagtaggtgggtgtaatttagtataataacttgaaaaataagcgttctagtacaacaacttagcaggaaagtacaatttagtataaggactttataagtggtcgtataaatgcaataacttttaaggtaggtaagattttaatacaagagtaaagtttatcaccggtccctaaacttgtcgctgtgtcattccggtccctaaactcgcaaatcgatcattcagatcctcaaacttgttcgactgtgtcatcccggtccctaaacttgcttatcactcgtttaggtcctccaacttgttcagttgtgtcaccccggtccctaaacttggatttgaatatcatctgggtcaaataggaccgtctaaagactttatatttaaaaataattcatagtttttccatgtgaactctaatgaaaacaaactttatatcaaacttgtagccctcgacgcgatctacaattttatagttgaatttttttattttaagtcattttttgtcccaaaatgtaattttaaaattaaaatttcaaaatctataaacatgcaacaacattttgggaccctaaatagttttaattcaaaaccttttcaactacaaagttgtaggtcgcgtcgagggctacaattttgatataaagtttgtcttcattagagttcacatgaaaaaatatgaattattttttgatataaagtttttagaccgtcctgtttagggaccggggtgacacaactgaacaagttggaggacctaaacgagtgatctgcaagtttagggaccgggatgacacagtcgaacaagtttgaggacctgaaaggtcgatttgcgagtttagggaccgggatgacacaacggtacaagtttagggaccggtgatggactttactcaaaagagtaaaataaattataattttgacaacttaatttcaagcattttttatataaattcaaatttttaagtacttattttgacaatatactagcgtggatttgtataaacatatttatattttttcctaataactaataactgaaagtcaattaaactgaatatagaaattattatatttcggttgatatttgagaaggtgaagaaaacaaaaaattcttaaaggtaattggatataaattgtatgtgcaatataattcttaaagattaaattcaatattataaggtaatatttgtatcaactaaaaaaaggtaatatttgtaggattattgtgttttggcatattgacatagtgaaaaaactcacctagcatatgcttatccaaattgatttaccaaaatactaaattattaagttcttgtactagaatgcacccacttgtcaaattgttacacttggacgttcaattctaaagttcttgcactatatcgcacccatctgccaagttgttataccgtgggcgcaatttactcttcaaccttttttttttcaaacttccaactttcttcaaacttcacttttttaggaactgaacacacccaggccgtatttagttccccaaattccaactttccatcgcatcaaatcacatcgaaaactttcctacacacataaactaccaactttttctttaacctaccaactttctctcaacttctcaacttttccaccatctaaacacagccccaatttctcggatgaaaatcgtgtgaggctggacgctggagaggatcttgccggcttgccgctttggggaaggagcgattattatagatcaggttctcgctgatggttcgctgtttcagccactccgtcacaacgtgcgctacagttgagtaccccaacttcgccgctcgtgtgacgtcgccggtggccatctccagctcagacatgtttgtttcctaataagataagctcccgtgtgtagtgcatggtctcccgcaaggcgctaggcgctaggagcctaggatgatggtgatgtagtacttactcctacaagggatcaactacatcaccatcaagtttaatagttattgattggcggcaggcaatgccaacagcgttaggatgttgatgagcgagtgattgggtggtgtcccaatgctacgctacaattagcggaccaatctgttaatgttccattagggacacgcaggggtactccaactagagtccctttcttcctgtcaattcatcctattacaaatccaaaagttgaacaaagtatggaggcttaattatcttgggcacgcactatttgtggatgcctcgaactatttggcttccaggtttaaaatttgccatctttttttttctatgtcgacactatgtcctcatcttttatttgagtgtcagattaaacttgctgcttactacccctccgtgttagaaaaagtgcagttttacacggttcatgttcaaccattgatcatctgttttatttttaaaaaatatgattggtattttaattgttattagatgataaaacataaatagtactttacgtgtgactatttttttttatgttttccataaatttttcaaacaaaacggacggtcaaacgttagacacgaaaactcgtatctacgcttaaattgggatgaaggtagtattacttgttggatgaacaactgaaactctcggatgtgacgtcaaaagaaaattgggggtgggggattggaataaaggccctggttagttccttttcatcctgtcacatagaatgtgtcggagaatgaactcctccaccagggaactgtgaggcccccctttgtgagttcggccgggggcagcgggtgagattcgaggatttggtgagcgaagctgtgtgatcttgagggggttagcccccccctcaagacgatgagacaaaagaggtttatacaggttcgggccactgagaagcgtaatactctactcctgtgcatggttgattgaatgtaaaacaagtgcttggggttgcgagacccaagccccagttcaccccgaagtccccctctccaccactaggcctggacctccttttatacctcaaggggttaccacatgggcccaacaacctaacctagctccggtggagaagtattataatctttgtattaaatgcatgtcttgtctcttgacttgggaagccaagcacacgtcatcttgatgatggggcctgtcaaatcttgccgcctgacacgggggtgcccctgtcaatcaccatttaatgggtgaagacttctgggctcctattacaccgagaaacgggagccttactttgaccagagcgggaggaccgactccggctgggataagacaatgagaaactctcaccatcattatttgatgggacatgttaggctgcacgccgcctgcagcgcacaggcgcactagccagtcccatcggtcattcgaccagtcacagaccggttgagtgcactgcacgctgcgcgaccgctcgggacgccataaatgtgggtaggtggacacctggaggcggacacctaacccaccgtacgtggtgacctagagagggggtcgggggagcccgacccctagtcacgggagggggcggccgccgcccgacctcggggggggggagccacgtggcgcctggggcagccttctctctctagtctcggccagggagtggccgccgccctacctcgggcccgacccccctcgggggagggccatgtggaatcgggaggtagcctcctccatccagtctctgggaaggagtggccgccgtcctacctcgggcctaactcccctcgggggagggccacgtggcatcggggggggggggggcagcctcctccgactattctttggggaaggagtggccgccaccccacctcgggcctgactcccctcgggggagggccacgtggcatcgggggcagcctcctccctctaaacccgatactcccgggcccatatcaccgacagaatgtttagacacatgcatggagtattaaatatagataaaaaaactaattacatagattgcgtgtaaattgcgagatgaatcttttaagtctaattgcaccataatttgacaatatggtgctacaataaacatttgctaatgatgaattaattaggcttagtaaattcgtctcgcagtgtacaggcggaatctataatttgttttgttattagactatgtttaatactttaattttgtgtccatatatctgacgtgacacgccaaaacttttcataaaacacaagttttcagcgtcataaaacacacactaaagttttcagtgcttgaatttactattccgacccagatcgataggtgtgaccaacgaaccaactgctgcgaccgacgctacctacagcagatctatcggccaagcagattcacgaggaatcaatcaataaaaactgcttgatccgtgtccttgtgtggccatggaggtgacgcaggatatactcgtctggcaccattccaataagctgcaagattccaagccttatcgagataattaaaaaaaagagatactatcgtactggtcaatttgttgtggtacactacgacagcgaaatggagacggtcactcaactcttaaacaattatgcttccggttttattcaacagaatttgggttaacccatctgaaaaaaaaactctcaaacaaattattcgtagtaccctagagaatcacgcagggtaatccacaagagagtttcttgtgtgcttggaattaattagaacccttgatcacctataatccaacgcactaagataaaaggtacaggagcaaagtagtaaaaggatgggccaggtatgagaggtggaaggttaaaatggtaattaacttctatagttgatttgtgtggttaaagataaatgcgttatcttttcaatattcatctctttacgatccgctcaaaactcccgatccgttccaaatgccgtgcacgtcctgatgccaccgctggctgctcctcccgccggttcctcgccgggacgccggctacataagttgatgttcggacttctcggataggttggccttcagagtgtgccgtccatgacctcgaggtaaaagcggctgccgctgatgtcgagtgaacctgccggctttgcataaacgtgcttgatctgcttaattaaatgatcagcgattaaccacagaatatcttgttcgatcaggatagcaattagatgcatcaatttcgcaagaaatcaatgaccaaacttttcaattccattcaacagctttcgagccaatcaatgcttaacaaaaatgaaataatgcttcagcatttaggaaccatcagcagcagccagcatccagccgtcggtcgcaaccatcgtacatgcccgccggtcgtcgctgccgaacgcaaccgtacgtgcctgccgatcgcagccaccttgcgtgctgcccctgctcctggtccgttctttcacttgggatttaaagttagggttagacatagagagattgaggtcacgctaatatcgtgaaaaaaaacaatctcattgaaacgacaacgtcagccagcggatggggattggacaattactaagctacccttgttaatattatttcataatcctaaattaccctttaggaatcaatggtggatattaattagtttaggaggtccctgggatacctctcaagcaccgtaaaagatctccacaattcattaacatcaataattatgatactaactgaggatagttcttcagtatcttcacaggtacttgtgtaactatatcatatcatcgtaactacgtgtagagctggtatctggtactttaaactgcacaaaactacgtgtagagctggtatctggtactttaaactgcacaaaatggaatcgtgtagtgatcttaatttatgtactctcatgttagtctaccatcaaggacagctgaagccttggacacagcccttgcagccctgtaaatttcatgctgcaggagctgccaagattcggttgtgttgagcttatttgccttgtcgatggccgacacgataccagggaatgccttggtgccccagtcgtcttggtcagacgatgcgtatatctgtcaaaagaaaaaaaatgattggacataggttatcactttgtcagcatcaaatttggatcagaacggcataccaaactgcagaactgatgatactcaccatatgtttgtaccacggcctaccgtcgagcccttcccggttgatgaagcctcgctccgccatcattaaccggtcgttgatatctctgacttttactgtgtacgctctcgtttttaggctccagttttctgcttgtagcatctgcaaggcagaaatgagatgttttcattggaatgttggagcaattttgcgcgccatacacttctgtttcactgaaaacggaaggcgttaccatcttttctttgtgaattttgttggctgcttttctaagctggtcaattgacttgtgtaaaggagcgaaactgacaggacatcctgtacacccaccttccacaagttttgtgcatttctgcgataaaaaatgtggcaggtaattcatatgttaagcatttgctgcagattgttccaccaactctggtaatttcataacctaacatttacccatcagcgaaaagtgtatcacaattatgttctgtttttatttataaaatgaatcgaggctttgtcttgtgtcctaaattggtcatctcaattgaagaaaagaaggaaagttacctccagttctgatgcgtaagagacataattgaggggtaagatctcatcatctgcaagcctcaaagcaatcagaccccatacacttgccactgcatgattatgcaagcaaaacaaatgaatctgtcagtgtttgcaatgagatgaaaaacctttgaacaacaactagttcagtacatgcaacatgtctgtgaaacaacggatctccgaatctctccatccaaacataatcatcgtacagtgagtggtaaacagggtaatcttccactgcaagagcaataatattagtagatgctaaaggagtgacagcagcagagactgcaaacaatggtgaagtaataaaaaaaattaggagttatcaagatcaacatctccaatatataatcattacttgttccgtaagacatgtcaagtgaaggtactccaatatattgtagaaaagctgcaaaatctgttcctgctccagccactctatcaatctgaaaagaaaactttatcactttcagcacaaagataattttattccagatctaagattgcacataacaggattataaagccatttcaccactgtacaatgtacgcaccggaggatggtggcgaatcatagtgtcatacaatgtctgcgatggatcatcaggatcttgcaccttcaaaagagagggtggaaaatgaaatgatttttgtgcctttgtaagactgctatatactttgatattggccctgttcaaagaaaatttccctccctccctctcttttcaaaatgacggtcttagttatacttcttaatcaaaaacaaaatctggctgtccaatttgtaaaaaaggaaagacggagtaaagcttaaataccattttacttgcttctttgatcaactgatcaagttgaggggttgcccggggcctaaaacctccagggccaaacactgttatatccacattcaaataagcaatagctcttgaagccagcatatccatgttgtcctcgacccattcagtagaccctatctgagacattgagtgtgccgcatcaatacacaaccttctgataaagaagcaattcagaacaagtgatcaaggacataccagagcaaactcttctgcatcccaactacacacaatgattgttcgtctaggcctccatcccttcttctcaagcttggacagcctttctgcgatctatatatatacgtgtgatgctaacattatatcatcaactcttggcattcagaaattatagatgccttttatcatcaacaaaaagaatatgcacttaaatttgttgtttggaaaatgagacaaaggctaactagaaagggaaaggatgaaatattcatgtctccaaatgtctgatgaaagatgacatatctgtataatttgctcctctaaactgaattgattacctcgagcatagctgctgttccactgttgggatcaactgctccgaatgtccaggcatcacgatggttccctatgatcacatatctgttcacaaacgggcaaatttatccttattagctttgccttggctttacaaaatttctagaaatctaatcatctcctgtgggatgaaaaatgaggactttgatctaaactcagaacaatatgcagggcagggcactaagtcaaagcctgataaacagtgataccacgtgtccacgtgcaactgaattctatacgtatgcagaaaaagacaatcaggaatgccattcacttgttcgagcgagagattacctatcaggctcttcttttccctcgatcacggcaaagacattttcgatggttgctaaggtgtcatttccctgcagttcaccacagaaacaacgatgagtcgatgagttttcttggataatgactcaactagaacactaagatccactcacaatgtacgtgagattcagcacagcaggaccgggtccgaggcggtacatgggcgcgccctcgccgccctgccactccgtcggcgccgcgtcgccgcccatcgccttgaggatcgtctccccgtccctcgccgacaccggcagcgctgggatgctgggcatcgcggcgctcccgtcgagctccccctggctcagccgctcgcagtcctccccggctgcgcaggacggccacagcggcgtggtcgggtcgccgttcccgtagtacagggtccccacctgcacgccggtcggcggcagccagcgcgcgtcggggaaccacttccgcttccccttcgctcctgcgccgccaaagtccttggcgtcggtgtagacgatcgcggcggcggcgcccgcggcacgggcgttccgcaccatgtcctcgcagtgcaggtttccgtagcgcacgagcgcgaccttcccggcgacgtccacgccgcgggaggcgaggtactcgtagtccttggtgttgccgtagttggcgtacacgacctcggcggcgacggagccggaggcggagtaggcgaagtacgtggggatgacctccgccgccgcctcggagtaggggtccccggggtaggtctcctggaccagagcgaaattgaaggcggccgcgcggccaggcacggagagggagagggagcggtggatggggtaggagagcagcacggagtagggcgtgacgcgggtggggaatgagaaggaggagagcgcggcgcggacgtactcggcggcgacggcgttggcctccgtcccggcgacgtggggccggagggtgagcgcgcggaggtgcgcggcggcggtgtcgttgttgccgagtgagaggaagagcgcgtggtagcgcgacgcgggggccggcgcgaggtggtggtaggaggcgaccagggccacggagatggccaggaaggcgacgaacctgcgcctcctcgtggccgcatcaccgcgcccgccgtcgccgcctcccatgggcgcagcatcggggaggatcagcggctgccgctgctgtggcttgccgtggcgagacatgggtgatgggcgcagtggcttgggtggagtttggagaggcgtcgtagtttgcggttgcaagcaacgtcactttgtcagcgccaagagcccaagaggttgtatcgtctcgatttaattgggtcgttcgcatcgcaccgcagcgcgcggtgctcgcacacgttgcaacttgcaagttgccgcgcaatgcttcgttcggcttcaataattaaacgcttataataagtgtggaaaaatatcaaggctgattatgagcgtcagccatcagctcacttttgttgatgcccacgagtttttcctctaaaaaatattagctcgtgagcaacgttccaactccgcgagcgaaaagtagtacttgtctctctaataaacgaagttacggattgtctctctaataaacgaagttacggattatgacacgttgaaatgcaaaccatgtttttaatatactccctctgttttttaatagatggcgccgttgacttttgaatatatgtttgaccatttgttttattaaaaaaatttatgtaaacgtatagatataaattatgcttaaagtactttgagtgataaaacaactcataataaaataaattataattaagtaaattttttgaataagacgaatggtcaaacgtgtgataaaaagtcaacggcgccatctataaaaaaaatagagaaaaatagaggtagtagtatcttaaagcataatctgtagtgctgtagtgcgggttagtttctagaacgtttggtggttggtcttgcgctcttgttaggaagaggcttctggacgtggcttctctgatatagagcactactcgtactttggataatacaaaattttgatacagtaattaaattgaaaatgtgtattttgttcagacttcagaggatttgaaattgtgtttggttcgtcgcatgaaccaaacataagatgcgctttgctgagttttttctgcacccaaaggcatcatggagcacatcgttgtcgaaagggtgaaccaattcggatactgggaatcgacaacaagattcattcaggtccttgtcaaagattggtcgtaggtggaaccggacaacggcacggaaccaccacgaattagcagatgccccacatcaataatgcgccacggcccagttcagagcgtagcaattcatgaggatttttttggcaggaaattcgtaccctttgcttttcggagttgaaacgagaaaacgcaacatcatcaccaattacaccgcatcacctgctcctttggaaaatactcaccggccggaatggcaccgcgacgacaacggcgtcgacttcaatcgacgtgatttgggcaatcagtgcacccagaaatcaacgagacagccaaagctttggactttcgggtccggttgatatcttccaacggtccaaggcctatccaaaattccaaatatcccaactcgaataaaacgaggagaacatgcatgcatcaaaatgttgctgggctcaaaggccttaaaatgttttcgttgcatggcctaccttgggctaaatcagatttacggcttgtttggtttctagcccaaatcaaaggaataagttcactttgggtccctctatttgtcgtccagtccgattttcgtcccttggttgcaaaaccgggtacgacaggtcccccaacttacaaaaccgtttagattaggtccctcggcagtattgtgtctgatttttgctgaggtggcgcctacgtggctccttttaattagtttttgtctaacgtgtcattgatgtggcgtttacgtggctactagattaagggtgtgtttggttcatagtaagactggataggatatggccatccatattttgagggatatggtggtccagttttttgtttggttgggtggatgagaatggattgaatgaaaacaacaacatattaattaataatgaaatatgttaattatcattaatatagccataatttatactaattaacaataaaatagagtaattatatctaattttgacaagctaattactgattaacaataatataatttaattattgctaatcaagaactaatgatcaaaattagcaaaggtgaatatcctcatccggccaatttggtcgcatacactcatccagcatcttcgtggaatattccctctccaggccgtcctatccaccttcgcccaccaatcaaacacactcaaaaactggatcgccatctcccatctagggatatccctccaaccaaacacaccctaaaaaaaacccgtgggacccacatgtcagtcacagacacaaataataaaaaatggtgggcccatgaagacccacacatcattctctcttttctctatccctctctatcctctccctccttcttatctcgctctccaagccggtggagcggcatgggcggcggccgaagcgggcgacggcgaggtggagcggcagccggagcgggcaacggcggggcggatccgaggggcgaagtgggtcgggcggcggctgatcctcgctgacacctcggtcagcatggcaggagagtggaggcggccgttccgcgatccgccggaaccagcctggcggcggtgacggcgccaccacgaagccgagagcggagggcgatgccaagggggaggacgatgccggagggaacgacgatgaggaggacatcgccggcgccgcgcggtccccctgacccgcgctggcccccgccgcacggaggatgggggcgtcggcggcggcggtgatggaggacggaggcaactggatcgagtgggcggaggaggacaaggagaaggtgtgggcgcgggagtcggcgcccgtcacagagatgcgccccaccggcgacgagcgaagccggcaggcgagaggagaaggaggtgggacggtgacggttgcaaggtcgacggtttggtcgccgttgacgaagacgacgggcagcatggccttgggccgcggtggcagtgggggggaggcacgtggacgcgcccgtgcaaaccttcgcctccgaggacgcaaggacgcaagcggccgtgactagcagcgccgacgcgggagcagggcggcggcggcgctcgggtctacacggcgctagctctagcggcggcggcatcgaggagggtgtcggcggcgcgcggggccccagggcgcaagcggaggatgccgtcgcccccgtctctgtcttctccgctggcacccccaactcgccaccggggcagcctcgccccctcgaactcgtcggcagtgtccgcatctgaccctaccccgtcctggtgggagacggcgaggtcccacatcctcgcgctctccaacatcctcccgccgccggccgattccgacgtcgcggcgctcgccgactccgactgcccggcgcacgcgcttcttcggtcacccgcgcgcctacgccgcgctgtccacggcgctccggtcggggggtagcaccgaccacgctcgccgcagccgccggagctcgcctgctccgccgcccacacacaccgtccgctgcccagaaggagagagagaggggaaagggaagagaagagagaatggagagggaaggaaagagaagtgaggctgacatgtggggcccacatgggccccaccattttaaaattattttttgtgtgcagctgacatgtggggccacgttttttattattttgctgggatataattgccacgtaagcgccacgtcaatgccacgtggggtgaagacctagtcaaaaaagccacataggcgccacatcagccaaaaccgccgaaggacctcgtttgcccggttttcgtaagttgagggatgtgtcgtacccggttttgcagtcaagggacgaaaatcggactggacgactgtggggacacccaatttaggcttgatgccccaaaaatccactcgtgatcgtccaggatttcaatcacgcacagattgatgtacagaacagctttcgattatttacacaggtttattcatacaagctaattatactactgttaaaaggtgaaaagatccaaactaaagaaaggatatttaaagatatttaaagaaaggatatttaaaggaaataaagaaaaggtaattaaataaagaaagaaaggatatataaagatatttaaagataatttaatttaaaaatggttttaaataaaataagaaattttaaaattaaagggatttaagataaatcaaataggtttaaattaaaagggtatttaaacaaaattttaaataggaaatttggtatcaaaagggagggtttgaaattagatgaacttagatcaaaggttcactggaattggatttgtggttggagagatatgggtgcctaaagtttggaatttgaaataactcaaataaaagaaaagggattactgtacagtggggcccgcttgtcatatgtctcttctacctcttcttcttctctgcttctttgatccgagaggagggagagaagagggcgagcggggcgccggctctccggtggccgggaggtgggaacgccggtaggagatggtgttcccgagcaacgcgcacccggagagggtggtggaaggcggaggaagagagagggatggccggaacggcggcaacaagagctcagttccggcgataagagaaggtggtggtggcggcttatcccaaggtggagggagaggggaaagggggaaaatggaatcatctgggcaaggcggagttggtggcgcaagggtttggcttgcgaagcttcggtgagggagatcggccgacggtagtgatggccggacatgggagtagagagagaaaaagggaaagctccgttgtggagagggagaggggcgacctcgttttctatttataggtcgcggaggtcggtttggagagaaggagagcgactaaggcatggcgacggcagcgaagagaagaggagcacggcgccgatttcttagcaactacggaaaagagtttgcggcggcgtgcgccgtgcgcaacacgtgcactgggaggaggagagaggcggctgggctgtgggccggctcggctgggcttcggctcagttgggtcggcagcccaagaaggagggaggaaaagaaaaggggaatgggccaaaagaaagggaaattggcccaaaataaataggaagttttgataattttgtatagaggattttgaatggaatttaaaggagatggaaactaaaggatagatggatgtggatttttttaatcttagtcaaagaattgaatctaaggaattttgaatggagggttaaataaattttaaaggagataaaatttaaaagagaaacgcttgagggtcttttgaactttataagaggaatataaagtttttttaaaagcaaaaatgagtttaaaatatttttaaaataaaatcaaatatatttattttgagatataaattttgaaaaggataaaaataaagatgctccaatttaaatagaattcaaataagaaccaaatgtaaaacttgtcacgaaagatttaaaaatcaaacggaaagaaaaggcaataatttaacttctaactttggataaatttgggatggtggcaaaaatagatggaggtaaaaactaagattttagcctccaaaatatgtggtatggattctcagtgaattatttgtggctaaaggaagttggactttgaatagaagggattgcaaataagtttcttagcacaagagcaatcattcaaatatttgtgataatattattcttgtgccaagaatgtgatcaagtcataggaatcaaattggtggatggatcaaaataggaacttgaccacagaatattttggatggattaaaaggagacaaaggttttcggagataggtttagataggggttgatccaaaataaattccaatggaaagggaattatactggtttaaccctaaagataaaaatggttaatggtatataatagagagttgggtcaatcggggaaatattggcccaagctaaatggtagactttgtaatcttgaatggataatttaaatgaacgagatttcaaagtggtaatatttgtgagagtatagaactggatttggaagtatatgtggatgggaatttttctaggaacggaattggtggtatattgataaactctaaatgatgggtatgttgactcaaaggggggattgaagaggatatttttagggactctaggaatatttaggtggagatccaaaggaaatgtatcaacatttcatgtattctggagatagttgagtggagatcaaaaagaaagtattgcttcaggggaaaataataattggtatttgtggatgttggagatgttcaggaatggaatcaaaggaactataatctagagccaaagttagagattaaagaaaataaatagagaggttttgtaaaatttaaaagagagcgattaactttgcaaataaagttttaaatccaagttaaaagaaattaacagaaggtaagatcacttcaatagaagaatcgagaagagtgcaactaaaatatttcgcaaaaaaaatttctctgaaaatttgagtccgttacaacgacaaatagagggacccatagtgaacttattcccaaatcaaacgcacctaccttgggctcaaaggccttaaaatgtgagacgatgattcatttggtttgttgccaaaagagttggtagcaaaacgtaacccaagtctatatgctcccaaaaatttggaaagaaagctaacaggcaaacgacgtcaaatagacaaagaaataagttcactttaggcccctctatttgtcgcccagtctaattttcgtccctgaaccacaaaactaggaacgacccatcccccaacttacgaaaactgggcaaacgaggtccctcggcggttttgataacgattttggctgacgtggcgcctacgtggctaatttggctcggtcttcatccgatgtggcactgatgtggcgcttacgtggcaattcgatccggaaaaataataaaacccgtgggacccacatgtcagtttcacacacaaaataataaaaaatggtgggccccacatgtcatcctcactcctccctcttctctctatcctctgctcgccgccgggggagcctacctcctcttcctgctcctcttcaagctcccctccatctccatctccgtctccactgcctcgccggcggtggccaccacgcaccgcccgcgccaccgcgagctcgaggccgcctcctccatgctcggctactactcctcctcctcgcctctccgcccgctcaagaccgccttcccttcctgccgtccccactcttcgtctcgtccatccgcttgcgccgctgcaactcgtcttccatcgatgcttccgccgcctccgccttcactgctgtgcacccgctcatgcaccacctcctctcctcctcctcctccccttccccgtcatcctcaccgtccccatctccatccacgtccgattcatgcccgtccacgatctcagtgcctacaccgcctacatgtactgccgatcctcgtgcgacttaatctccccgcgagcaagcgcggggtaggaggccccgacgaattgagctcgtgcaagaagatgacaaaaatcaagaacacgatgcaagtatacatgtttgggccacacgggtgcgtaaggccctacttctgtgttttgggagatgtgaaacgtattaagcgaccaactctagattagatgccctttttccctttctaatcttccaaccccttgctaagggggtgtttggatacattagtcctaggactaaagattagtctcaggactaaaacattagtcctttttagtcctagcctgtttggttgaagggactaaataggactaaaaccacattaattgagctgtctagtaggtattcataggtactttttaatgaacatgcattgcacaaaacatcccctcatgcagccacagatcaaccaagaccatcttgcggcatggcaaacagattcacagtagagattacaaagtacaagaagatttgttcacaatacagagttaaaattcaacacagttttaggccatcaagcacagtttgacagcaccaccatatgcagacatatagcatacacaatgaaaagtacagtacatgaaaatgcaaattcccgcatacatatcagttattacaagttatatgttccaaagtccataagatgaataaaacaggagactacatattttttaaactccacagtccattggcaaccgtgtcccgaaattgattcatcacttgactatccaaagagctggttggatcatttgattaaggactttgctcagacaatggaacatagctttcatcttggtcacacatgtcgaattcacagtcggctagtttactatctctaatgaaattatgcaatgctaggcaagcgcatattatcttactctgtttttgctgtggatagcttggtaagtggaacaaaatcctccatttatttttgggtgaatacccaacatgatccttgaactttcgcttaaggatcaatttagtccctgatatttcgtattgtccaaacaagtaccttaagttcattgtgtgattcaatatagtccttagaccctctaaacatgccatgtgtacatgccacatcatctctgcatgcaaatttaatatttaaatgtcctttacacccttatgttttcataggaaataaagaaaaactattgagaaaacacacaaaaaaaaagcttttgaccattggcaaaaatatgtagcattgatagataaaaaaattgacatttttctttgttttatgattgctttttcttgtttttcttttctttatttgatagaaaattgaaggttaaaatggacatttaaatgttatcttgcatgcacgaatgacgtggcatatccacgtggcgttttaagtgggtctaaggactatattaagccgtatgataatctttagggtcttgtttggacattataaaacatcaaggactaattcgagccctgagtaaaagttgaaggactaaactgcctattcaccctttatttttcaacactccaaaggacctctctatcacatttcgacacgaagaatggcagtagttaaagtattccttcctatgttggggcattatgccttcgttgtattcctgaaagtgataagttattcccttatatggtgcaagataacccggcctgtttgggtaccctgagtccacgagatagaacatttctaacaaagcctgtttggttgaatgcctcattttagctcttaggaagaatttttccttcaagttcttatatcccctagttgtccatcctccttggggacaatttccattccttatttcctcacaggctactacacacaacataaaagtattttcttctatccaacaagccttgtcataaggagttttatcctaaagaaaaatttattaatacatagattaccatattctgtcctaacaaagccagagaaaagtataatgcatctaaaatatacaagatcacagatccaagtctaaaatatacaaccattcatatagcatgtcaaacaggattgtatgtgtaacatttcaccagatcaatgcatgtaacaaaagctcatcaaagtaaatgaaaaaccaatgaatactctggtttggatgattaccgtgcgttgaccatcgttgtcgtcttcgtcatcgtcctcaacgtcgttgtcctcctcttcggcagctgcggttggggcagaggacgtcccagcatcccatcctcctccaccgaagcccccataccccgtagcaccgtgggacatagagctcccacggccgctgacacccgcactgtgggacatggagctcccatggcccacgacacccgcaccattggacatggagcccccacggccagggggaacgaatcccctcatccgattgccggcggcggcaccaatggtgccatcccttccgcggcctcgacctcggcttcttccacctcttctgccgcccctggaaccaggtactggacggcgcgacggggcgatgtcggatctggtggcttggaagagtggaggtattcctccaccatcttcttgcaagatctgctggtaggagccgaaatcggggaagtcttctgcttgggagtttagatccaggcccgccgatctcctccctagaaaatggtagcccgcaccagatccgccatagcctaaggaagcttggctgaatctgtactcggtggcgtcaacggaggcggcttcgtgatgtgcttgtgattgggagaaaaaaatcaaacatgtcgtcgtcatggccggccatggctgaagggctacgagcggcggcggcagagacggcagccgcgctcacggcggaggtggcggccgcgtgaggtcgcgcgcggcggcggcctcgggagctcgcggaggcggtggccgcgggagcttgcgcgtggcggaggtggcggccgcgctcacggcagaggcggcggccgcgtgagctcgcgcgcggcggccgtgggagctcgctcggcggcggccgagggagccttcgctcggcggcgtcggtggcggcacttgcgccggatggggggagtgagtagtacaggagagagatagcgaagtgtgtgagagagagaccgagtgaagtgggagtgacatgatagggttaatgcgctctgttataggtttttagaccgtataagctcctcccccagcgacttattggcctatgctgttttagtctcttttaagtccctcccgtttggtagtttagagactaaaaaatgacttatttgaagggacctatggattagtccctcaaaccaaacaccacctaagttgcataactcctcttatacttcgaaggggagcctgcgccattacattttgcatagggttatgtctatgtctagtcttgtcattgtccctcctgtcacattagtctgaatgtactcattgctactgaccgagcctacgcttgtgccccaggaagctgagcatggggcccaggacagctggaacgagcttctagcgtcacttatcgtgaagtcgggcctagtggacctagatgagggcgtaggggattgtccgcccttcataacaccatgcagccataccaagtgttgctcgctggtgcatggcgcgttgttctagccctattccttcgggtgacacaactagcttgatcacttcataccttgccacctccttcttgcatgtatctgagttgtaatctcgaattgtaattatttgggtaccgctttgctgtggtttaatgtcattgctcgctgggcccgctaccctgcatagccggctgggagatctccaccaagctcagggcagcgagcaccaccgatgtggtctccaagtcaaacccaagtgacatgtgcaattaggctcgccttttgacatggtaatattatcatggccggactcatgccctgagaatgcaagcagtctgcaatctcaaggcgcggttcgtgcttggcgttggatccgtgttcgggccctgcaggtaccctcgggtctgcacatgctcccatgctgcttgacgagatgtcgtgttatttctgataagcttctcgaaaacgtcgttgatgaaggatttcatgatagacatggcctcagagggagtgtcgatgttaagatgtggatcttgtaggtttccgcactcttcttgatatcttgaagatataaaccttgtgtggcgttaggcgccgggatcccagggcccaggatgaaccaagccttgggttcccaccttacgccacacatcacctaccaccttagtggttttctgataggtaatgaattatgtttgtgtgaagacgatcctgcaagcccaaggtgcaacaggcccttggaggaacaagaccctggttcccatttctctagctaccaacatttggtaattataaaaatttctactcgcagaactaccaatttaaggtgtcaaaattttggcattagcaacaaatgtgttttttttttcagtgaactcaacaagcctttcgatctaagcttcaaacttcaaagagaactacactgatgcatcacaggagatcgaagcaaagagacgatgaaatggtgcaagatcattgcattagaacttgcaaggcacatttggtatacatacatggttacatatcacccaccaagaaatatattgcactgtggtagatactttgaaaagaagatgcagaaaactgctcaactgggcaagaaaccagcaaaatgcaggagaaggttacaggggaaaacgcctctagtggagcagggaaggagatcaccgaagagcgcatgggatagcaccgtagcaaccaggccaatcttacaggatcacctcccagccacaagaccactgaacacttggctgttcccagctagcgtcgcttcccactcgatcgacgacagcagtatttgcgatagcgtgattactgcctgcttcatgtctggccgaagaacaggatcttcctccacgcactgtttcgctagcatggccatctttataagaagaatttagagtgagatttagctttgaagcaaaggtatgtgaaatgtgcaggagatgttgatcatcaagcaccaacagattttattgtgcataccttgtatacacagtcatgtggatacaggtccattagattagggtcaatgcagtctttcaggctccccatatacattgagttacgacaattctttagtgcactcaacatctgcattgttaaaactaaattagttcaaaacttttggagtcaaaatagcaagtaaaatatactaaaacttcaataaagccagtgaaaaacactgcaacttgggatggcaaaataattctaagcccgtaagttataatgggcatatatgttcaattgcttatgctgaacctagaaaacttacaactgatgccaaggaacgcctttctgagtttgatccttcgttcaatccatcagtccttgtaattgcctcctttccagatattaactcaaaaagtactactccaaaagcataaacatcatttttcgtagttgccaggccatcgcgcaagtatctacaggaataaatgaaatgtcaggattgagctagatatttttcttttccaaatccatactgagctaccagaaaatgtactcactcaggggccaagtaaccaaatgtacccacaacttttgtgacagaagcctctgcatcagttgacttcactaccagttttgcaagaccaaaatctgaaatctacggagacagaaaatgcaggtaaacaagctgttctaaatggtgccaggagaaaacaaatcagtaaacaaatttcaaatcaattaacctttgctctgaaggattcatcgagcaagatgttactcgatttgatgtccctgtgaacataatgatcctttgtatgctcatgaatgtattcaagtcctctagccgcatcaagagcaatttggaccctgtagatccaagacaatgatgtgtaacctgaaaaagaaacaacacaaaatcaatcaataacgatagaaaatgtatgtgtgttcagaaaagaaaagttaacaaaacttgagttagcagcaatcaagaaatgttctcaagcagcaatattttagaacttgtacataagggttgcttttgattggtacctactcaacaaatacaatatcaaaactgctggaagtggaaacattacatggcgagattacccaagttaaacagaaagcaattagtaaatcactcgtacaagtcctaaatgatggtatacctttgctttgaggatcatgaaggtgattcttgagtgaacctttttgagagtactcgtaaataaggtatagttcatccttgcttgctgcatagccaatcaactctacctttgacaaatcatgggtaacacaaatgaaattcaataaacaggatataagacataatctattagaaggatttacacaactgtaaaatggcataccagactggcatgatggaccttacaaagaactttcatctccactataaactctttagttttagttgctgtcattctctttatagcgacctcctatgaaaaaacatatttgttattggcaagggaaaatcacaacagttttgcatggatatggtcagctcagatcacatacctggtctcgaagaacaccataataaacagagccatatgtaccatgacccagaagatttgcatcagaaaatgaatcggttgatgcaagtatttcttgataggtaaacacaatgggcttctccctatcaaacacgtccactacaacacctgcatgagaggaaaattgagaacagcttgtatgtgagaggaacgaaagaaaattagaacaaatcaaagcagagcgttctaggctgctagaaatggcttgtcacactaagaaatcatgaagttgtttagttgtgaatttgtatcttgacgttttgttttctttgatattatttggacaatgtacttcagtatagaagttcagatcatcagatgtgtttggtgctacttgaactcatacaaaaatttgaacagatcgtattcctgcttaaatcattgcaggaaaagcaactaagcgatgctgacatgagtgtcatatgcaatgacaatataacattttgaaaaaacaaaacccctaagggatatgcatatgacaacatttcgatctttaatatgcctatataaggcactagattcatcaggccactcctatattaatatccacgcaaaatgaactcagcaaaacccattcaccactgcattgccgtgctgtgcagatgcagtggccaggaattattcccatcatatatatacaaaaaaaacatgttatgcagcacaatgatggttaaaaggagatgaactaaccttttggggtattcatatgatgatcactgccatccgttcttgattgtttcacatttccaaattggcaacataagtatcttccagaaccataacaaaaactaccactcttaagaagttgaaacttgtgtgatatagactggtctgggctctttccctggttatttggagcttggggattgtattgggagagcttgcacagaacaagtgcaaggagagcaatagcaatcaaagcaagtgcaactcccatgctgccaataacccatccataagggaattttgtggaatgatgttctgatacatctgccgatgtaattcagaaaaatacactgttagtttatcataaaaaggaacatctcaattgtaggctacccaacctaacaaaaccaaaatatttcaacattaatacttgaagaaaacaataggacaggatcctcagaatgaagtgccaacaatgtggtagcatgttatacaactattagcattaagtgttctcagaatatcatatagctgccaaaaaaaaaacctagaaaacaaagtgcatcaactctaacaggtacctccatacctgagaatgtattttgtgcgggtgctggcgcaggagtaggagaggaaggagatatcacgggatatggttgtccaggaactgcacatgacatagttttacaggaatgaagccaaaaaaaaaaaaaaaggtaaaagcaagaactatgcccaaaagaaaccttacaagctagaagagaggtatccaaaataacaaaataaaacatcataaaagaacaaagtggaataatatcattgtatttgtaccaaaaagggagtgctatacagatatgaatgataacattgaacaaggttaacccgcaaaaatgcaaaataagaaaataagatgaagcacctagctaaccaaaaaggccaatattgccaaatattaaacgtattgtggtccttgcctgtaacttagggtctcattctattaaatacatcaaacagatagtaccttatgtttggtgacaacacaatttggttaaattcttagtaaaacttagaagcatggcatgtgtttcgagtacaatcattcgatatcacaatgtgcctccttgtttgtgccaaatttgtctgtagcagcacatcatcagatgccaccaaccagtctaggaatgaagggattattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgtgttcatgctattaagttgcatgcaccagccagttgcacctaaaagcctaagctgatagggaaaggcgggcaattcactttatacactccaacacatgctccttcctatctgaggtgatctcaagcaagaaatgaactgttaaatccagttcaatatagctgattactatgtaatgggcaagcatctctgttcctccctcattaaataacgctgcatctataaattattagaccaattaatttcaccatgttcatgaaataaatggtaaattctcggttcagccaaaaagaaaaatgcagtataccgtgtgtaaatagggaagtttgattgatcaaattgccggagtgaatgatcgctaaacatttgttcacctgagttgagtgggatgtagtacacctttcccgtggttataggatcagggccggccatgccattggcggcctcgatggcgtccatgctggccccgaaccgacttgatagcgattgcaccgtgtctccgtcgacgccgacgtagctgaggagatagttccaggggccggatgagcagccacagagcaggtggagagccaccacggcgccggggcgcggcggccgcagagccggtccgcccggcggcggcacggctagccccgcgtacgccgcggcagccacgtcggccgccgtggcgttcgccgtcgccccggcggcggcggaggggacagtgtaggtcgtattggcgaggtatgtgcgggaggcgaggcaggagcagttcttgcggacgaacgcgtacccggggctggcggccgcgtcggccgtgatgtcccccggcgcggcgtcgaacatggactccagcacggaggcgttcgcggcctcgccggccgccgggaacgcgacgaacgccgtgcagacgcgcgagagctcggagcaggggagcggcgccgaggcggtgacattgccgggggcggcgtcatcaccggcgacttcgccgggggaggcgagcgccaggaagatgaggaggatgagaagcccgggcgcgggcgggcggcggcggggaggcggcattgaggggggctagggttctgggctcgaggtggcgaggtggtggtggtggggcatggaggtggcagtggcgagcagcgagctggatgcttcgcgtggtcgggtcactggagcacactctgggggacggcgcttttagtaagacgacggggttaattagcaagcaaagcccgcaccgcacgcacggccatgggtactggactactagtagatcactgtctccttcattccttgtgtgttatgcccatattgcccttgcacgcatcaataatccgcccgtttttgcttccgtcggtctgggaggtggtaacggataatggtttacgacgcctcaacttgttgagtgctatctctgtttcaaaataaatttactttcaagtaaaatacatcagcggtccttaaaattatcgtgaggtttcacttaggtccacaaacttgtaaaacgcacattgagatctctaaacttggtttattgtatcatttcggtccaaagtctcgtttgaccgtagtcttgcctacgtgacacgccacgtggacgatgacgttgaattttttattttttttctcccttcttttcttttttttctcccttcttcattttttttctccggcggccgctgcaccgcgagctccacagcagcgcctccatctccttctccatcagcctccgctccgctcgccgcagctttgccacccgcttcctgtgacctcgtgtggcctcctctctagctccatgccagacaccccgctgtcgtcttcctcgtcacggcgacgatgcctaaccctccttccagctcgatgaactcaccgtcgtccgaccactcctcttcctgcagcggcttctcgacctcgatgatgacaacgacaacgacgacgtggtgcgaagctcgcgacgttcattgtgccggcggagatctacccagcgaggctgcgtgcgacgagccacgggatatcggcggcgtcggggaaggtgggcgcgatcatcgggtcgttcgggttcctgtacctggcgcagagccctgacccggccaaggcggcggcgcacggctacctgccaggcatcggcgtccgcaactcgctgttcacgctcgccggctgcagcttgctcggcttcctcctcaccttcctggtgcccgagcccaagggcaagtcgctcgaggagatgtcacgcgagaacgaggtcggccagccatgatccacccgttaattccaccagcatctgtatgcaagatccatgcatatgcacggttagtccactatgagatttttgttctcttttttctagaatccattggaagcatatgttttcttctctttttttttctttttggggtttagagcggtgacaattagaggcagtatgatgaaataatggccgccaattaattgttgacgacaatgtagtttagcatcaggtgggtcatataatggacgatcattagggttcatgctgattctgtttcggcacgagggatcctcgggttcgctccttttttctgttgatgatctcctccaaaaaaacaaaacagaacgcatctctctctataatcaaaaggattccagctcgatgaactcaccgtcatctgatcactcgtcttcctgcagcggcttctcgacatcgcctttgtctggcgaggaagccgcacggccgacgccatcggtgtccgcgaaataacccgaagcaagacgagtcgagatcgacaatgacaacgatgacgacgacctggcagccacctccatcatcgccgtcgccgccgctgcaatggtcggcgtcgcgtcaatagatggcaaaactccgagaacacaaccacgagacgacgtcgacgttattgcgtgcacaccacttgcgagacagagagcgcgcacgtgcggtggagaggtggaagaaggccctgacaggtgggcgccggccctcagcggcagatgggagaggagggaggcaaagtggaaaaaaatagagaagggagaaaaataaataaaaattacatgtcatcgttcacagggcgtgccacgtaggcaacatcacggtcaaacgaggctttggaccgggatgatacaataaaccaagtttagagatctcgatgtgtgttttacaagttcgtggacctaagtgaaacctcatgacaagtttaaagaccgctggtgtattttactctttactttttatattttacacgtatgaatacaaaactaaaagtactttatcaaatctcaatagaactatttctcatcttatcttcttctaatacaactgtttcctattttcacaaagcatgatacaatgattactttaaaaatttattttttaaaaaatggaagtaactataaataaatttaatatcagaccgaagaagtaaaaagcttaacataatgatgatcattgatcagggggagcgaaatgaatgagcttccaatgtaaattttctttccgcaaaattttattttgtaatggttcgttgtcgtcttattaaccttacgatatgcaccacaatgtgtttttaacagtgaaaagaaatatgtattcccttcgtttcaggttaattataagatattttaagtttggtcaaagtcaaactgctttaagtttgaccaaatttatagaaaaaagtaatattttcgacccatgataaatttttattataaaaatatatttaattattaatttaataaaactaatttaataatataaatattattatatttgtatataaatttagacaaacttaaagcagccttataatctaaaacggagggagtagttgtgatacagcaacattggcgtgtgttggtgttcaaaatcaaaaactaaggcttagggtagcatctctggataaattactactggaagtgtggttatattacaaaaactggatcattggatgatggatccaactatcacaacatcgaaaatccccccggttacatctatcaacaaatgttggtttctgacagttcccttcatatcgatcaatcgtccgattgcaccaaattaacaacagtgataaaatttggtaagaactaaagataggctagtaagctacgataatataataaacttaaaacttactaacaaattatggcatgtataatatcgtctttcatgataatcttctaatgcgaattaaacaggtatttgattaattagttaatcaatatatatcataacaaatataaaaaagtaaactcgggcactgtaaatatatccattcctaagatcaaagaaacttcggggagcgacgtgggaattgtaaatctaccctgcgcgtggatcaatccacgtacaaaacaatgggagcagggccaaacccaggaccgcacaattaacgagcctccgtttgtctttgatacactattttcactctttgaaaaaggttagcaatccaaaagctcccgatgatcaaagattccattagccggctagttagtgttccaaattaaagaagagggggtaacagggtagcaactgtaatgctgcctcctcctcattcggacacttttgacggtgagttatctatcccccacggcccacgtattatatgctgcatactgttcagtgatgttcaccgagagagagagagagagagagctactgctccatccactgtttggtttctcttgccatctctctgcgtactgctacgattacaggaggatgtactgcaacttatggtaccctgagcaatgaatccaccatgtacagaatgaaatcgtttcgcagttacaccggcactattgcactaaccattaattagcagcatagacgggctgagtaaagcagggtagtagtactactgcccgcaataaggcctggtttagttttcaaaaaaaaaaatttcaaaaagatcacatcgaatttttaacacatatatgaagcattaaatatagataaaaacaaaaactaattacacagtttatatggaaatcacgaaacgaatcttttgagtttaattagttcataattagtcataagtgttacagtaacctacgtgtgctaataacggtttacttatgcttaaaagattcgtctcgcggtttgtaagcaagttataaaattagttttttcgttcgtgttaaaaactctttctaacattatcaaacatcccatgtaataccaaaaattttcttttcaaataagacctcggtggtagctgggcgtcgttatggcctgggccgagcggcaacgaaggccgatgtagccaaaaggccccgcacgtgggggtggccgacagctggttgcccggtactactaccatggaactatggcagctaacgccacgcgaggagggagccccgagtgggcgaggaggtgggtgccgtggtggcgcaccgccacgccacgcgacgccactgccagcgtcggtacagacaggcgagaaaagaacgatttcctcgctgagttgtctgagcgttttcgtacgagcacatccactcagatctcccgggggtttattttaagcgcctcgcccgcagctcacaaagcctgccgccgtgcgtgcatgcgggctgcgcaccagcaccagctttgcgagaaatataagatggttttcttgattatacggcggggtttgcgtgtgctacgtgctgtccgaatatttccgtggatacggtggatgtatagtggttacagtattatcccgtactactactactgtgtcctactgtccttgtttagtactccgtaggaatttagggcaaagctcaacacagaaacagaaaagtaggtgaccgaattgacgcacgcggtgctgttgctgttgctgaacgttagtaaggccgagtttagttcaaaactttttttaaaaaacttttaacttttttatcacatcaaaacttttctacataaacttttaattttttcttcacatcgtttcaatttaaaccaaacttttaattttgacgtgaactaaacacaccctaataagcagtcccggattgaagtggaactaaattggcagtgacacctaggggggacaagaaaaatctcgcctcccatgtcgtgacagctgtgccaatgcttaattcatgcgtcggtaatgcaaaacagaagtactacatgaaattcaggggaaactatgataatactcgtaagcacctgctgttgtgatcgatcaaatcatcaactgatgattaggccgcttccacgcggacgggcacctcacgggtgatgtgcgattagtgcgaacgtccggtgccccgcgtatgccgcgcgcgctatccgtcgtacaggacgcgagagtagctgttacgtctcccggccggactgttccagtgtcctgtgtccacgcgcacggtaccgggcggggcggccggtataaacgccgaaaatacacgacagattccataaaacaaccccgcacatgagctctatttagaagagaacatggcctgcttcgatggacgcaataatggagatggcccagacgccagtgggtgagccccatcaccgtggagttcgagtgaaacactgaaacgtaaccaagccgatcgataagacgaggccatcgatcacagcttcacgtacacctttcacggccacgatctgcacgaaaagggaggagtccaaaacatccgaggtgggggctactgattgacgtggtggaccattttaagactttgcagaccgcaccacgtatatggcgtatatcctcaatattggaccttggtccaccactccagcctggggacaggcccgaaatctttttatcagctacagtaggtagctttcatacacaaaaagatgatactgtagatgatctcccgtttgcaattcagagtacagaccgaacctcggtttgcgatgataagtagcagtctagcagaaacagtgatccactgcttagctttacctggcctatgttagaccgtgatatcgtttggaatacattcttgcttgctgctagaagaaaggctacctacacaaggtcacacctaatggcaactggagggtgggagacacagaactacaaaagcaggggcattcatgagtggtgggggtacagccaggtagtgctgcactgcccgcgtaccactgtccagctcgctaagcgactcatgtcatgtgttaggtcaccaacacgaagcgctttctcctctccttgtctcctctcctgtgttgctaccagccctatgccaatatcggaacaccaacgaatgcgtgcttgaaaattgctaatggaaattgccaaatttcatgtgctctcagtcgcctttaacctctagaatggggtagacaagaagataggagagccaggggtggtggcagccagggcttgtcggcgacgaccgacgaccgcgagctccttgacaaccccttccatcttccgcaccgtgaaggacacccgaattccagcaacggatgtacggattatggggtttttagggtgggggttagaggaaggggaagatgatgttttttccgagcttgaaaggatggctagggagatctgcaggggaaaaggatgggcgacaggatggtggtggccgtggcatcgctatagctgaggctcgaggacacgggcatgcattagatcaggagtggttagaggacggagtttaaatagtttaccttctatacctccttaattgatgagatggaagaaaaactttctcgccacactgcgtactataattcttctcttgtgtgatgtatactccctccggactgataacacttatcattttagacaagggtgaggtcaaactttagaatctttaattatgaatcatttttaaaatatttgtctttcaaatatggtgactacatgtatagcttagtcaaagtactttaataaaatcatatatttgttagagaatttttatagtccagtaataggtaccgcccagtactgatatctgtaggtacctaaaaagatcggaccgttcaattcggaagcgtacgatcgggagaaaatgtaggtgcgctcgcttgccatctagtcgcagcccacacgcgtgtgtgccgtaatcctttccccttccatgccctccagcggcaactcctcagccgccacgtcctcctccttcactgccaccgccgcgtccccttcctcctccgccggcgcctactcccccgttgttgcctcctcctcctctggcactgccgccggcggcttgaaaaggatgagagaaaaatagggaaaaaaaatcaaggccacgagtctccgtcgccatggaggaggagagcacaagctccctgtctactcgcaacggtgaggaaaaaaaggagcaaaaacgaggagtcgaacaaatcactctcatgaatgaatcaatagtttactcttttaccagtttatcagtgagtgaccttggtccttaccagaagcatattagtcggagtcacccaccggaccggcaacacaaccactccggccttggtaccaccactgtgtgttgccgtcgagggtttcctccagccactgaacagctcgcttggtagctagcttcctcgttcagctccacgcccttccatgtgtgctctacttcacgctagttgccgcatctagggatccacacgcactgccgctggccgtctcacatgccgccgccgtcaccggccgcctaatccgaacaaagaggttcaccggctccgatcgtttcaacctcatatccaacgcaaaaatacagttttacccttccacctctatctcctttggccggtaccacctacaaactgaatggtacctggaggtactgattgctgttagccgttcgatccatgcccctcaatggttcagatttggtaccgacccaggctgaagaactgtaaaaataatctagttgttaacatttttatacatattataataaaaaataatggtcaaagttattttttagaaaccgtacccttgtccaaaacgataagtattatcaatccgggggagtaccatatataccactaatgagtaaatatttttttctttgattccaagatttacatgtagatctcataatatataactagtgggcttgcattttttttaagtaatgaatgggaatacaatggacatgcgttgaacttggtcttctaaaaaggacagatatatggaacttggtgatataaggtatatttgacaaggctgtaactttagcttcattcctcttgaagctagagcccaaccaaaaagttttaattccatctaaagaaatagtagagaaggttacagtgatctgaaaaaataaactagagaggtgcatcgggattcaaactccattcttgaaattattgtttggaaattggagccatgtcaaacatggccagactagtttgtagatattagtggatacttagagcctcttttggggagcttctaacatatgcagcttctcctagaatctctaattgccagaacctcctttaaacagtctagattttcagatagattataagaatgtgtagttgtagaatctaaaaaataaacaagaaaatacaagttgggaaacccaacttttccaaattctcactagctagcttctcaccaaccgcttctcagaatcttggagcaccttcaaacaaggccttaggctagcggctaggcgttggctgctctatggggcctagagcctaggttagtcgcccactggccaaacagatgaagtagagttatctcccatggtccagattggcacggacatcccaagagcaacaaatgttactcgcttgccaagttatcggacagaaaatgaataagtccactttgactccctcatatatagctccaatctaatttacgtccctgaaccacaatatcggatattttgactccccaactattaaaccagtgtaatttgatttcctcagcggttttggagggcggtttcgctgatgtggcgctttgatctgatctatcccgctgagtcaccaagtggagccacatgtcattctctcactcctttccttcttcatcccgtagacactttggtctatggagaagccgaatagggaagaggaagaggaagaaggtaaggaatgagataatgacatgtgggccccatatgatgactcagtgttatagacctagtcaaaagcgcaatgtcagcgaaacaaccctccaaaaccgctgagagagaatcagattacattgattttaatagttgggggttaatatatccggtattgcggtttaggagtaatatgaattaaattggaactatattgagggagtctaagtgcacttattccgacagaaagacataacactggaaatggcccaagcttcggcttgacaccattttgggcctaaactacttactgcttatcaggccttacgccagcagagagctcggcccattttatgccctagtgaagtctacgcgtgcctaccgactaccgagtaccactgacttgtccggttgtcccgtaatgcaggagcggcggcggcgtgccagcgccatcgtatcaagaaacaaagaagggagttactccctccgaatttgaattttaatgtataacgttgttaacttttcgaccaacgtttgaccattcgttttatttaaaatttttgtgcaaatataaagatatttatgtcatgcttaagaaaatttgatgacgaaccaagtcataataaaaaataatatttacatatttttttaataagacgaatggtcaaatattagataaaaagttaacggcgtcatatattaaaatatggaggtagtacaagacaaaatgagataaaatatggtttcagcggttacatgcactaagaagttgataaaggatatctatcgcgcgcctagcggtttcatccggctgataatgtcgcttatgcctgatcagctctaagttcgtcacttcgtgggctcgtggcgctcctgcctaccgcgagaccacgccgagcagcaagggcaatgacccagcaacggcgcaccgcgtatgactatcaacgcgcggggagaaattaagcagcagcaccctgaaacacggagtgttcggctcgtcgcgtcggcgtcgaaagaggcaagtgatgcacgcatggtgcagatcgatcacggcggaaggggctggcgacaacggctcgcgtcccgtccaaggtgaggaggacagtattcacggaggcgagctctaaccgcacgaacggagccccgatcgaccaggcgcaggcgcggccggaggataaacccgtgctcgacgtcgccgaagcccgaagttacaagcgacacccccggctagccatgctcggcgccacggcgccgtggttcatcgcccgcaaggtcctctcacgatcaaccagaggccagagccggctgcagctctccatcgtcgtcaagggcaaggacatggccccgcgcctgctcatcaccaagaccggccttgacggaagccgagaaggccctcgtcaacgtacaagcgcggccgggagcccgggagtactcgctgaggttcaggtactcagcggcaacgccaccagctaccagctcatccgaagctgggtgaagttcctgagagagaatgaattactcatcggcgccacgcggctataagtttgaagcgccgtgtgtggaccgtggggatgacctggagcagtgggcattacgctcgcgcgaactgccagcctgccacatgccacgggccccgaggatgccggccacccggatggcgcgctagggtttctcgtgttgcacggcgacgacgacatggaggagacggctgccgtgatcaaagaaagaagaggtgcctgcggctgaccatacgtccatacacgtgcagagaagggtgaggagaagtcgagtttgatcgcaaaacttgctgcatttgtgatggtgtacgtactcttgaggacaagcactcgatcaagggaaacgaaacacaaaactgatgacgatagacgaaggccatagaatcttgcatgtatgcagcagatgcacgaggaaattaattgttgtcagtgctcttaagagtagtatgttacctccgtgtcccgtttcttatacacgcaagtttaatatatagattattgtgtaatctatcactttaattattaacacataccccctccgtgtcttaatatgagggattttgacatgttacttgcactggttgaccatttatcttattaaaaaataaaattattatttattttatttgtgatttactttattatccaaagtactttaagcataactgttcgttttttatatttgtataaattttttgaataagacaagtggtcaaacagtgcaagcaaaatgtcaaaacggaggaagtacaaggtgaaaacctacccatgaaaaaaaaatcattatggtgcggtgttgttgttagtcggatattctttttagttgctccatgttagagctcgtgaatgatagtggcactacaattcatctagttaaatatttttagtgttttttttatagatatatatgcaagaaaaaaaaggtgtgcccttaaatggcttaaaatatagtcccacgctatatgttacaggcattccccctgtgtaaagggtgtgttctttacaacatcttcctaacttttactttctcttctttcgtgcgcacgttctctgaactaattaaatggagacgttttttttagcaaaagtttgctatgagaattactttataatccatttctccgctttacgtgcccaggagaaaacgtttctataccctcccctaaagaatacacccatccgagctgggaaaataccttgactttggaagggtgccaatacattctcttcaaaccttgcttttgagaaagcaaattggatgtttttgtagctatatcttttactacatactcctaccccagtctacaaatatgattttttttaaatttttaatgttaaaaataaacctttctgaaacttatttcaagatctgaaccttttgaccacgggctgacatggtaggataaaactgtcacgtacgcccgtagcgggtggcgtgacagtgttattttgccacaccaaaatatttagattttgagaataagttttagaaggttttatatttaaataaaaattacaaaataataaaaattccacaaatataaggcgtgtaggtgcatatcttcgagttcgatagactgaggtagtatgcgctagttatagatggccatatggcctgtggcccgcggctcggcccaaagaacgcgtgtttggcccggcccaagcacggcgcggcccgactggagtcgtgctcgtgccggcccggcccgacagcgggcctctgtcgggccgtgcttgggccgcgccatcggcacgctgggccaacacggcacggtggaccggcatggcctggcacgctataacggcaggcacggcccgaccgaggcacgcacaccgcagcccagcccgctggcccatcgcctccctcgcatatataagccgcccccgccgctccgctcctccgcctcctccgctcctcaaaccctaaccctagccgcctctctctcgaccgctcgtctctctcgactgcttcgtcgctccaccgcctccacgcctccactccacggctccacttcctccacgcggaccagcggaccacgcctccatcgcttcgctcttcgccggatctagcaccgacggtcgccggcctaccgctggggacatgaggggctgagggccgttcttctctctctttttctttcatctccacctctccgatggccacgctatcgatttcctctttttttttgccaccctcgtcgttgctccgtgagcacttcgtcagatccacccccatttccagtctctgttctcgtcttcttgtagatctgtcgatctctgtcatcaacggcaactccggtgcttcggatgcgtaggtaggtagagtaaaaaaagtccatgtttttctttagttttttttccatgcgacccctaaaccctaattattctctgtgtattgtaggtcgctgagcggtgagcgccagtggtagccaccgttgaggaacagtagtgtcgtcgatggatgatccatccttctgcaacttcgagttgaggctattgggaatgcggggtgatgacgaagatgacttggaggaggaacgcgtggaggtgttcggcaacactgcctcgcctcggatcgatgggtcgcagccggagacgaagacggagccggacgatgacggtaccggtgctggtggcaacggcgcgccgtccggctcaagtgctagcaacaaacggtccagatctcaggtatggaacgactttgaagagctctatgaatcctgaaatggcagtcaggtttgtgtccatgctaaatgcaattactgccataaaatcttgtctgctttttcatctggtggtactggacatttgattaggcatattaagtcatgcaaacctataaatgctggtgctctgtctcagtctatgctccggtttaatgctgatggttctgttagtcaatgggaatataagacagatgttgctagaactgagttggttaagttgattgctagagaggatcttccactttgttttggtgaatctgctgcttttgaggagtatattcaaaaagctcataaccctagattttgttctgtctctagacaaactactagtagggatgtctttaaggtttttgacagtcagcgtgctatgcttattgagactttaaaatctattagctctgttgctttgacttctaatatttggtctggtaatgctaaggaggattatttaagtgttgttgctcactttgttaattctaattggcaattagggaagaggattttgggtcttgtgctgattgatgtgtcacacactgctgaaaatatttcggaacatattctttctgttgttcaagagtatggtttgactgataagattttctctgttactctggacaatgccgctgctaatactaaagcaatggatcatctaaaacatgctatctctggttatgttggtgatttatatttgcatcagcgttgtgcatgtcatatcatcaatttaattgttaaggctggtcttgagatcttcaaaaacatgctggctgattttagatctgctatttcttttgtgaatgcatctaatcagcgcattgctttatacaaaagcttctgcattgctaagggtgttcgccctcgtaaatttggtttggacatggatgttagatggaatgcaacttatttgatgcttaaaaatctcttgccacataagggtatcttttcagtgtttattgcaactaaccatccacctgttaatggtcatgcattgttgactgatttacactggacaattgctgagactgttctgttattccttgaacaattttatgattcaactattattatgtctggtgtttattatccaacatctccattaattatgcatcacattcttgagattgctggacatctaaatacatatgagaatgataggaaccttagaaatgttgttattcctatgaaatcaaagttcttattatactggtctgagattccatttctgtattcatttgcttttatcttggatcctagggctaagatcaggggttttagcaatgttctccaaattatgactggtaattattctgagtatttaactgaggttagggctgcattgtctgatatttataagaagtatgaagctaagtttggtgatgtaagattgcaaagggcaaccccaagcagttcttgtggtaagaaaaagacagcttgggggaaaatttttggatcatccgctagtggttccagtgttggtgctggacctggtgtaggtgatggatttgctagtgccagtccaggtgctggacttagtgctagtgctagtccaattcctggatttggtgctagtgccagtccaggtgctgggcttggtgctggtctatttagcaggagaacttctgctactgctttgattcaagctgtttattctactgctaacatgaatgcatctgagttgtttgcctattttgacagtgacacagtcaaccaattcgatgacgacttcaatatccttaactggtggcatgagcacaaacacacctatcctattctttccctcttagatagagatgttttgaatgttcctgtttctactatatcgttggaatatgcttttagcttaactggcaggatcatcgaggatcgacggcggtgtctaggtcctgccatggtgcaagctctggcattgatcaaagattgggagcaagcagaatcaaagaagcagcattcagcggagaataaagagcttattaagtcttttgaatacttgtatcttgatgatgaaaccactggggatggggatgggactgggactggagatggggctagggctgggactgggacttgatgctatttgtattggacttggactttattatgaacatttgatgaaagatgtggattgcactcttttttcctttctagggttttctcacgaggtgtgagtttttacctagaaaggattttaatgaggcaaccattgcactacacagctactttatatttgcaaataattgccttgtgtctgtgatttgtctgaatcagtgaatgaatgagtgactgtatgactaaatgctttcaaatattgtgaatagtgcatctgtgatatgtgcatgtaattttttggacatgtgacttgtaattttttgaaacttggtgaatgaattgttgttaaagtttgttgattcaatctgtgaaatgagtacttctgagttctgattcaaaatgttggtgcaaagatctgctgaatgagatgtcacaggcttatcgtgcctgggctggcacgagcccaatgggctggtcgtgcctttgggccaacatggcacgacccgagtgtttgtgggccgtacctgggcctgaggtgcagcccgtgggagggcacagcacggcacgaagtgccagtcttgccgtgccggcccgattgacctcggcctaggcacggccgtgcttgggccgggccgggccgggcggtccatttggccatctatagcgctagtggtatggaattttgttatatgatcatgtcagccaaacttgtacagtccacaacctagatgtgtcctatagaacaaaatttgcagttggacataattagagctagtgtgtctttgtgcttctctagattataacttttgactttatatcagtaagactaaccaaacaaagaaaaataatcgtgggagatgttgaatattggtataagaaattgcctaacacgtacgtaagacaaaatcaatcacttgatggatgatggataaatgccaaatggttgtttaattatgagtatattagttggtgctcctattgttacacacatttgatcctgaatcgcccaccgtttgaaaggtggagttaaaaaataagtgtatctgagattggcaggttgcccaaattaaaatcgcagaggaccacatttggaccagcagtagttacaacacatgaggtgatgagtcgcaatcaggtaagctctcaatcaagtttttgctgagtttctgaccaactcgctgcatcaggatttgttcagcgacgtcaatcttccgctcccttcactgtccacagttccacatatgcccactgcagggatcttaagtgcactactcttgtagatctacagcgttcgtgtcgcgttgtttccagctaggagacgagccatccgatcggaatggccgtgcttaattcgggcgttcaatcatcaggaagcctgtcggagacgcagctaactttcccacagctagctcggtagctctgcttcctgcacgaacgcagcggtcgcaggcaaagcaccggaagacacagagagagacagggacgactccctccacaaaaccaaccgcgagtgcgtccaaaacacgcacgacgacgacgacgacggcgaacagtgtggagagaggcaatcaaacgtgcgcgcgccgtcccagtaaaggctgtgcctgcccgcgccccctggaccctgcgccgcgcgcggcagctgaggcgaccagggcgtcaccggcggcatcagggcgcgtgcatgcatggcgcggcatggcatgcatgctgcgttcgcgcgtgagacggcgtgcgcgatcagatcagggggagcgccagagcccgcgcacagtgcaggcgggtcgtcgcagccgcgcagcgcgaggaggccgatgcgcgcgggggccggatcgagggcgacgggggccggcgtacgtcgtcggcacccgcggctcacgagcccccgtttttctttctttctttttttgtttttttttgtcccgtgcccatcaatcaggcccctggccggctagctactagcctgtgcccctgtgcacacggccgcgccagccacaaccctgcctctgacgcgctatagctccatcgtctcatcacccgcgcgcagctgcgtacggtgtatgtaggagtacgtgcaaccgctggcccgtcatgcgcgtacgtacgtggaccatgcatgcaacgcagtcacgcagcgcgctcgcgtttggtgcgcatgattgaatgcgggaaaatgtttgcttcctctactgatgtttcaccactctgccgcgcgcgatccgatccgatgcgatcgcgcgtacctatacacgggtagctggagtagcatgcatgcacgggccggtgatgagtgatgatgcaaacgacaacggccgccctgtgacgtgccatggcgcatgccgggatacgtgccagttgtgtccgtgcgtggtcaccgatcgccgcgctgcaatgataaaccaggccatgaatccctacgacatgccaggacggcaggtccattttgaggaagcagcgaagcacagtgtatatggcactactgggcactgtgtgcgtatactgactgctactgttagatgctttttacacagatataaatcagatttctctcggcattcgggtagagcagctagctgtgtccatggagggcactaccgtttcagttcacatgattgaaactctcagttcctagctaggacagtccgaataaatttcactaaactttacaatacatattcatatagtgtagtgcccctgttttctttgagctttgctcctctacatgcaccgcgccggccatacctctttctctagtgaatggcaatacatatatattcatatggtgaaggcaagggtgatatggtgatctcgtcgagaagctcttacaataggtcgccggccatacctctttctctagcgattggcggagccgcggaggtaggaagctagtatgactagagtcataaggggtcaatataacaagagcgaatagagagaacaaacctccgtcaaatgcatgcttcatgtcaaagataaaagatagtgacagcggtgtgtaaggccgtaaggaataaaaacggtgcttaatggcatacaaagtatcgagcatttcgatcttcggggcatgaaaggaagtactacctccatttttagatggggcaattacaaatttaccactgctttgaatagttattgcaaaattgccactagaaaattacaaaaataccactataactatcattcgagtggcatccttgtaaaattgaaaaaccggtggcaaatttgcaaatgcccctttttaatatacaactccattgatcttttttatacattacgtttgataattcaacttatagaaaaaataagtatcatctattccctccatcctaaaatgtaacaacctaattaatacacacatcataatactagaaaatgtgtctaactagtactagggacttgtttagattcaaacttttttcttcaaacttccaacttttccgtcacatcaaatgtttggacacatgcatggagcattaaatgtggacgaaaaaaaccaattgcacagtttgcatgtaaatcgcgagatgaatcttttgagcctaattacaccatgatttgacaatatggtgatacagtaaatatttgctaataacggattaattaggcttaataaattcgtctcgcaatttacagacggaatatgtaatttgttttattattagtctacgtttaatacttcaaatgtgtgttcgtatacttcaaaaaacttttgccacacgaactaaacacagcctaggttactatattttggggcagatagagtattttgttgtgacttattttatcactaaaagaaagcatgacttgaattttttttacatctgcactaatttttttaataaacgccatgtccaaaagcctacatcgtcatataatttaaagcgagtagtagtaccgattagtgaatgtttagtggacatgtaagaaaattacccttttatccttttacatttttaacaatacatactataccaaataagaaatgtggctacaactctattgttacaataaaaaaaccagctaacacaagataaagaggtatttcccttttcttttggtttcggtcaatttggtgctagagttttctgttagtacattgttatgatttctaaagacgcagaatgcagaaacttgttgaggagaggcagctggagtatatagatcaagtactaagatttgagtaattggaggaggtatatcccggggttggtagccgctcttgtcgtaatgatccggacgcgtgtggctgatttcgacaaaatgggctttaaaaacttaggagacggaaagtgactaggctgtaatgattagagcacaagcagcacctattatactaatgatggatgagaggtagtagcactgattgagttttagatatcaattagaggaagctaatcatctgtggtaaaattggccagctttgagaaaaggatgtgctatttactctttatagttccaatctgaaaggagggaggggtacgcttttgtccatactgtttagattatgggcaataaaagtacatgctgcagcagcactgcacgcatgcagaccctaccagccgcatgacatgcaacggacggcagagggcgcccaggaacagcgaaagctaacaaatttgggatttttcagagggaagagccatactaaaagccactactactcatccttattagtcagaatccgtgctgtttgttcagtcatgttattttagaagttcagtaacatgttggatgcattattggtgcatcagtgagggactttatgcaattatttcaaaactcggcccggtcatatatacacacagacaatgtttggctaatgggaaatggcaatgattttccacccaccaaaatgcatctttaaatactaaccattcattctccctctttcatttaatcctaaccctttattcatttcccaattccaatctcaccctctatttcccattatccaaacacactcataagagtttgactgatctcaatatatagctgtatatccacgagtccaagaaaaaaaacaagtattctttttttcttttaacagatcgagtcagctagcccaaagttcttgaaaagtcagatgccggggtcaaaatgcctggagcagcatgcgcgcatccttactcaacttgcacgactgatgggccctcaactgtttaaagattcgatatgtcaacgagttgaaacagtaaatgttatcgccttcctttctttaagcctctctttctgcacttagctaaggggggccaatgtaccggccgaaagccagcacaatccggatatcaaacaagcacgagttttgtcaacaaagatgatctaatggtccaagcccaatcaattgtctctgacaagcatgaatagtaagcaggtggagctccactccaatccaatccaagggttcagcgaagatcaggagttcagacggggtaatgtcctcatcaacagtggtcccctgtggtcggggcgtggaaggaggtggaaccattccttacgccacaaccaacagcagcgccaatggccacacggatggagtatgtgcgtaagccagccaggaagacaacccatcaaatcactcatcgcgcccccacttgcccggataagcgtgccgctgttcctgtcctgggcgcacgccttgctcgcgcggcgcggccacaccctctcccatatcatatcgcccccaccccaatccgccaaacggcacacgcacacacgcgcaagaggacacacgggcgaaaaaacgcgcacgctttcgtgatcgagccgccctctcttctataaatggattctctactgtaattcacatgctaatcttccagccacacacctagtcagtcatcaaagtgtgcgtgcttctccagaacagtgagagagagaggggcaaagggaggcaggataaaaagccgagctgtaggggactaaagaagaaagaaaagcatagaaaagaacggcaagcaagcagctcgaggcacccgcgctagtacataaagccaccgaggtgcgatttcgcgagctctagccgcttccacttggccatttcccatctgcctcctggagctttagctctaactctagttctagctctagctccggctacgtttgcaactgttgtttatctcctggtgagtcctcctgtcatgttagccgtagattttggccggagcacaaggtgtttttgttgcttgctgattttacaggttgcaggttgttcttctctttcctgaaatggttttgacaaaagagctgttttgatctggggctgcctcaatcatttgcttctatggcaggctatacaccacacttttaagatgttttagcctcattggtattgtttatgtttcattatgagttattacgaaagactttaattaaaacaaacgtctagggtgctgcttgttgcacaaatgagttattcgttccgctttcaatttttcattgccagaacctgatcttaactccgtgtttttccgcgttctctttcgttctcgcttagacctcagcttacgcttcgggctggtttggtgcttttctccagcctaagttgagtgtagaactaaactttttaaggagttggttgaactcctctcattgccttcaaactcttcctactattctaggtggatagcatttagactcttgaagactttgagctagttaaccttatggaagaagggtccaacaaaagagaaggacttcctcctcaactcctagatctcatcccagatgagaaggaatggaagctgagagaagcattaggtctagggagatcaagaaacgcaggcttcgacggtgaagaagacaagaagctagacctaaagcttggtcttcctggttttatagaagatgatgaggcagaaaccttaagagattacaggctacagcaagagagcccatctctctcccttagtttctttccaaagcactccaagaccaccagcagcactactacgacaactggagcaaagaggggattcatagacacagttgaggacaaaacagaaggtaacaaacagcttttcagttctctcgtgagcttgttcttgaaacatgtttatacttgggattagaaacatggaaacaaactgatggaagcactgaactgaaaattactcttttgttgctttataaggttataacgaccagaagcagcaggcaagggcaggatgtgggaaggaacttgcagtggaggaaatgatagcagccgtgagtgagaggaagaaaggatgctgccccccaccaccaccaccacatggtgctcctgctacacctgcgcgcaacagaccacagacccagggaaggtactgatagcctatatggtgctttttccatcttttctgctctcagccaaggaacacatgctcgtttattcctgtcactcatttatagttcattcgaaggattgcatatagtccctccatgctcttttccaggttcccagaaatcgcaggtgtcctatgtccatttcaatcttttgattttaacgtgacgtgcaatggctaatttacttagctgttcttggtcgatatgaacctcaaagaatatactacttcttttatccctcaaaaagcacccctttttttatagaaagagagttgtcctttttctaaacactaaacttaattcctacgctcatagtcttgtctatttatcacttattcaactaagggcattcccgacccaatgactaggatggtgtccatagcattaaataagctgccacctaggataaaaaatgatgtggcaaatgaattaatgaggaaagagaaggaaaccatgtcttgcatgagacatgatttctacataacatccaagatattatgtgagataagtagcattaaatttaagtatggaatagtagtgtttgcattggaagagtagtgtctagtactagtttcttgatgatgtagagtttatggaaactatatctagtgtcttgggttgagaatgccctaagtctccttgggcacatatattcttggattataatcactctaacagtttaattggttggaacaatagcagtacaaatagaaaaatatatatactagtacaaccaattaaattattttaactattttattttattaatattatgcaatcatttatctcgatggcctttcagagacgaactcaccagttttctaacctgtttgtagaggagctgcagcaccagtggttggttggcctccaattcgatccttcaggagaaaccttgctagtagtagttcatccaaacattcccctgaaccacaaaatgataatgccaatgcaaaggtgacgctcacctgcaagaaaaaccctcttgtaaaaatcaacatggatgggatccctattggaaggaaaatagaccttgcagcctataacagctatgatgggctatcgtcagctgtcaaacaactcttccatgggtttcttcaaggtagaaattaacaatctatccaaataaaataagtacttcattttttataaaattcttagcttttatctgatcatattgcagctcaaaaggaccaaactaatgcgcaaattgcacagcaaggtgcagatgacaaaatattttatcaattgttggatgggtctggtgaatatactctagtttatgaagacagtgaaggagacaggatgctggttggggacgtgccatggaagtaagtttgctggtcccccttgtcatttacagtttttactggcatttacaaaataatcaaatcttaaaaacaacaaaaggacactgccaccataatttatattaggcaccaccaaaccatctaaattatttttcctgttctccaattcctgcagagtatttgtctcaactgctaaaaggctgagggttctaaggagttcagagctttcccataccctggtaagacaagctagaccacttaaagtcgtgtccaaatctttggtgtagccataaaaaaattagctttcgctaaatttgaatgaagatagctacacttttatgttagtctcatattctttactatttttttcctattctccagattggagctactgctagggtctagccgtctaggagagtcaccaattgctgaaatgctgggatcttattaaccattcggaatgaatgtgtgcactcaagccagtccattctccattttaggactacccctattttgcctatatagatgatctactgagatgagttggcatacagcaaatgcaaggaaatggcaatctgttttgtaaattaggttaccttgctatgacatgttgcttaattcaattcgaagcgattttggttttatcggggagagccgcatatgtagacttgcaggtcacccatgtaaagtgccttgttctgcgtgataaatttgtattaatcgctgctgcaacccgacatgcagatctaatgtcaccagcgtgtctcagaggacagcaactaggctaacctgatagcatcaagtcatcactccacgtggaatatgctactagtaggaatttttttttttgaaaaaaaaacagaattatccactgggtgagttgttatccttctaatcccatcactttccaaaatttgtcacaagcacagcgagaaaggtttgacccgactatgaaactgccgaaagcaaatatgtgctaatgccttcgcgcttattgggtgtcaaatagctatcatgtgatacaacagtggcatgattgtgaccacacacaagaggggtagatgttcatacttcgttttgctgtgaaagctaagaaataaactggttgtactatttttagtttttaacatgaatgcattatgtaggtccattaatgattaaaaccatctgatagcactagctgccaaacctggatgttatctccaagctgccctggtgaccatattcacattggcttttttgaataagccaatatcaacagctggtggcactgtttttattttctccccaagataaatacagtgcattagtttcaacttgacggttaacactgcaagcatgcctaatgcgtataactcttgcaaatatgtaacacaataggaatattagatgtataactcttgcaaatatgtaacccaataggaatataagatgttagaatagacactggtaatatttttggagggtaattgttatgaggcgtacctgaaataggactgcagaagaatcttataagttacatataatcttgtagcgccttcagtgcccaaagttttgacaggaaaatcaccacacagccatttccagcagttcatgccatctgtacagataaaaaccttatgtatttcaagatcaatgaagcaaacgggcacgaataaaaccagagagagagagacagagagagagagagagagagagagagagcttttctggtaaaggagaatattcaccttgatgcttccgagccttgaaactggggacaaaggaaaggtctttgtcattggaccatccctaaattccggacagcaggaaaagtagaagagacggggtggattacgaaagaatcttaggctcttttgtaatgtccttaccaaacatctttatccccacagtattgtgtgctcatgtgctggcacttgcagtgtgcgactgtataatttacctgtgtggcctaaaaactatactccttttgcaagaacagttctttggtgacagtgaaagccaaaaagaaatgcagacaatccaatgacagaactaaccttatttccagcacccaatcatgtggatttgctggcacaacaagttgaatactagatagattaagacgctaacaccattcaaagatgttctatggaaatacaatagagaaatgtaaaggagtgcatttatttgacacaaagcaatttggcatgatgtgatcaaaatctaatgaacaatgccatgtatctcgtacagtgtgctctaattcatgatgctacagttacactggaaaatgttaacctgacatcgacagtcgccttcagatttcagccccaaaagggagtatgcataaaaaaggataatatttttgctcacctatgaggctatagctagatgacctactatggataaaagtggtactcatcccatgttccacttcttagatgtttggttattaacctcgtaaacatagaccttgcattagtttttagagaacacccaggagagtggcacatgtttgttattaagcagatagctctgcaagacttttaggcttattaactcatgttatcatgtaggatgtgtaagtgcgttcatgggttggtccaacccaacccatttgctgatttgcatccctatgcccaaacataccaacacatctcttatgtccacatgaacagaatcaaatatcaataagagattagcagaagatcacacaagaattatgtacaatattatgatatcaagaggaagaaaataaccgcaccagcaaaacgcatacgtgtaggcttgatggataaaataaattcaccttagggttttatttctggaactgcatataccaactaataaaaaacaaataaatcactatatgccacatttaggaagagacgtgagccaattgcttacgttgcattagagaacaggcacaaagaatacctttacagcacaatcagcaatataatttcacaaagcaatgtaattaaatataaaatgttagctaaaatggcaaattggaaattgtgtaattcagaactccatgtggggcaccatcctgcatatgtgcaaccttataatcaaccatcacctagcctacaaaataagatcgggacgcagcaatagtgcttatatagtttttaaacattatttttctttcagcaaagatattgcatcttacctgtgttcaccgaacataaggcagaaatttgttcccactttatccaggtatgccaactataatttggggtattccccaaaactatttgtaatggattgttccatttcaggtaataagttgggtttctgtgtcttgtattggcatcatgttcctatttccaactctctagccaagtacttgttgaaaaacagtataaggatggtgtacttatgatctatcaggtcaaaccagtgttttacagttgacagctcagcaatgctctttgttttgagaagaaaagtagaaaacatgatggctactgtgcatcagtaaaccttcccgtgtcataagaatatacaaggccagtttccttcattttcaaaatacctgtcagcaactcagccttgactagtatcattattcaaattttaaccaccaagaacttctaaattgttaggtcatattcaacaaaagatatgtgattacatttgccatgcaacatacttcaataatacaataatatgatagctttgaagtattttcaagttcgataaaaaagtggtcaaagtttgaataagaatagtgtttagtgacaagtattgtgagtttgtgacatgggagtagtaatattattacaagagaacatcttgggctacaatagcaagagcaataatatgactatattttgcgacaaaacatgtctaggtatgaatgcatttgaaagagatgtgaaactatagtcttgtagcttgcttactgtgaggctggtactgttgaactattatgttgttctgctttcacttcctaacttttactaagatgatgctgaaagttcaaacatcacaaggggacaatcataaaaatcagatttccagaagatggaaaagaacgccagccaggagacggtaaatagcaggaccagattctgtccagatggttctatttgacttccaattcacatattttttcctctaaatcctaattttcagcaacttgtaaatcaccaacgtcctccatccttccaccaaaaaaaaaaagaacacaatattaatactactgtgaaacagtaactcgtggccctgcatgctgagcaaggatcagttaactctggtttttttaatctccaagcaccaccagttaaaatagactggcattatatttccagaaaataatcacaaaatggatggcaatccccccccccacccccgcgcctttgtcaaacacgcacgcacaccaaacacaaaaaaaaagggaaagaaaatgcccatgatatacagattaaaatacagtaatatactcgtattggtgatgttattgttgctgtaataaaagatgcagtgtccaagatgcctctagaaagatcaaaagtaatacgatctgtaattgtgcatacatgtatggatttcaaatgcaaaaacggtataataatactctataacaacaatgcagtcgttatcattgatcaaaaaggaaatccaaagagaatagttagttagttattaagatcattagttatatatatgtgagcaaagatgtactaaacacaagcagagaaggcagaacatcaataaattcctatgcatgctttatatgttgaagaactttgagaaaactatctgtctgtgttatattatgagggaataattagcaagcaaggataactttgtggatttttcatgaatgccactcagaccctcagaatagttcgaacttcgaacgcgcctcaccttacagccttcaatcatcagttccacacttgaccctcctaactatcagttgctttaaattctctaggtctacactagctgtgttacttttctcagtttattgctttgcgttggattacaacagcaatatatgacatctattgtaactgactggctgcattattttcactaataaattaacacaacatgcagtatttgagtttgtaaacaatgccatccatatacttcagtcggtccatgacaaacagaaaacaaaattattataggccatcttaatcttaaattatttaagtcatcaaaacaaatgtgtgctgaatgaagctgaggtgaaaacggaagcttaagcacaaattatatagtatgtgtaccaagaaccaagcaaatagaaggacatatttttttaatgagaacaactccatcttaaatattttaatgtgtaccaaggaaagccatgcatatggaagctaagttcgagaatatatgaatgaaacgccatacattgaaacgtattacaagactagtgatatcattcttcatatgaccaatgaatctagtttttttcgatgttagtagtcaaagtaaaagaactttgacagtacagcttctaaaaaatcataaattagtaggtacacccatgcttgcaaaattgccttagcaaaccaagagatgtattagctgttagtgcgatttatctagatataatgcagtaatttggtgactaaactaataagaatatatggaatatagactgtaaaaagaagggaacagagcgatatttataggaatgaatttgaggatgacaacttgtcaggaacagagcgatgttattttccaagttgggtcatctttctagtgttacggtattacagagatatttataactgaaaaaacgacactaaacatgcaatattgcaaggtagatgcaggtaatgctcaatttccttggcatgctcacaagagtcgtccaggtaaggaatagatttcctctgccttaatcttttttgaccttttggacttctgaaaaatatttctaactagcaattctttatgtgcttattccagaacataattatggcactatgacaaagaatcatttatgtagaagcatgcgactgaaactgaactcagtacatagagggagtaagtgttaaaagagaactaatataaataattatgatatggatggatgaattatgtgacatccttacataagagggatgctaggcttatcacttacaggggatgcatttgttccagccagatgataaagcaaaacccctgctgcgacacttacattcaagctctccactgcaaggaatgatttcatatcttggttacctgaataattatcaccttcttcccctccatctgtgtctgtatctgctcctacaaaagatccatcaacattacccggaattctgaccaaatgtgtgcaggatcgctcaaccaggggcctcaaaccagtgccttcactacccaacacaaggattgttggttctcctggcacaacttcagatagaggtatagctttaggagcaacagtaccaccaagaactcgccacccattttcagccgatgaagataaaaactgcatcatgttcctacaggagagcagttcgatcaactcaagtgagcctgcactagctttgctcactacaccacttaatggagcagagttcttagcacataacacaacaccttccgcgccaaagaagtaggcagatctaattatggctcctaggttctgaggatccatgacctcatccaaagctatccagacaggtgcctttccatcgtccaccctgactggctccaactctttagtattcaccatttccaagggtgatgcatcgagtacaaggccctggtgtggacggttatccacaaccatgttaaggtcatgctttgatgcttcgatgactttcagcccaatcctctctgccagttgcaacactttctcaatccctttcttgtccttcttcttcttgttgctcacactaaaatccatcccttcctgaatatacagcgcatagaagtccctcctctcagccatgagagctgcaagcacagggccaaccccataaaccccctgtccaaccatttttggcactgtcgattcccctgcctccttccatgtcttcctcccccagttctcctgcctgctccactgcctaacctccggcttgtcaaatctctcccctctaaatctctcaccacgggaccctctatccctcggcaccatccgccgatacttgtccttgatcctgccccacttcggattgtcaatcgagccattatcctcttcctctctaattatctccctgcccgaaccacgatccgtcaatacctcacctcgcgggctttggtcgcctctggagaaaaacttctccgcggaggtctcccacgaggaggagcggccggcgctagccctcgccgcgggggcggcgccgccatcgcggctcgcggcggcgagccaagggagcgcgctcccgccgtcgggcgatgcggtaccatcaggtgcggtggagaacgaaaccctacctcccagccccagctgcgaggggccgcccgggctaaccgcggctctggcgctcgcacggttggtgacggtggttaccggatgaagcgcgggcgaggaggccgtgggcctggagaagcacgctgcgcggagaaggccggcgaggaggatgcgtcgcggcgaggacgccgccgcgaggagcgggaggggctgggatttggtgaggccggagtggagcatagcgcggggcggggggagtagggttttggatgaggctggagccgagggggttttgggcggcgcgcgccacccgttcgacaaaatgccgcaacgagccgacgacgacgatgcgtggaaagtcacggttttgcagttcgcttcatctctggcgaccaattcatccaacggcacacgtgcatctttcttcctttactcgcacaccgtgcggcccagttcacctacagcaggccatcggctagcccatcagaattcagaaagaggagagaagggacttctgtattttgtggacccctttaaaactacagtactgtaagggcaattactataatgcttcatatgctacctctagaaataacacatagaattaggtgatgaggtggaggagagaagtgaggtgagagatgataaaaccacccctaaatgaagaggtggcttccacacaaactccaagaaggatgtgagagtactaaagacattgatatttgtctattagggacagtggcggacccagaaaaatcatattgggtgtgcccacgctaggatgtataataccattctttaactaaaacatgtcaggttataggtagcaaaagttttatgaaatttgatcaaaatttagttcaattaattcatgaaaagttggtaaaatgtacacaatttatgaaagaacccatttcacccatgcttggtccgttgtcgcaacccatgcttgattttgcattttagttttgatgaatttgaatcaagtaacactggtccaagaatcagatattcagagaaagtaaattatagaagggtaaaagactactagttcggtgatggctttagggcctcaaggctccaggccattggcgtcggcgtaacatggactgcgttgtgcgatggtctcagcctcaccgtggccgaccaccacaacatactgtatggccattgcttccgctacttttcttgcaccaccaactgaccaacagaaatgcccacaacaactagagaacgagatcaggtaagccttttggtcttccgtttgtttaggaacaagggcatctaccaaatatttaggccacgaatgaatactacatcctatattttctctgaaatatttgggtatgtccgtgcatacccggcaccatacctaggtccgcccctgattagggatgacctattgtatatcttgcatcttaatttataggtaaatgatataaataaatttgaaggtagcaatcacatctactataacacttgctttaaagcactgtaaaacttgtgtctagtgctggtcagctggcatgtgaggctcggtattatagtgagacgtactgtaaatatccttatggctttgctgttgctccccgctgtcgtctgctactccatacaggaatgcaaaggacaaggctgcaacagaacaataaaaactgaaccgctgaaatataaaattgatttaacattgtgaaggcgaaggatgaaataggccgagtttagttttaaacttttttttcaaacttccaatttttccatcacatcaaaactttcctacacacacaaacttctaacttttccgtcacatcgttccaattataactaaacttccaattttgatgtgaactaaacacatagtagagaaggaagcggaggaggttctggtcccaaagagtgggggcggtggtggcgatgagatagtggtagtgttgtcatcggcaacaatagtggctgcagcggtggtggcacgtgagtcatcataatacgagaggagtttattggcatccctgtcgctgggcaccattatctcttgtttgtctggcaccttgttttcaaggtttagatctagttccaccatcgaaacaggtgtgcactatatagatattttctagcatcggctgataacgcatcatatcaatgatctggtacagatgggtatcagtcgatactagtgagatatctgatactgtctttaggtattactccgtacctgatatcgcgtagggtaccagatggtgtgatacctatctgctatcaaagcatagcaacccctaacaaatgggcctgttcggcaggccgactgtgagggatgcggctgcacacagtgagtacggtgctgttcgtgcgcagctgcagcctggcaaccgaacagatccaataataactcattatgcataatttattatactattttcatcttaaaatatagaatagtttgttaatgtaacctatataatttttaggagtattctgtaaggaaaaaggtgtgtggtaaacttgtgctggaaagagccgtaaagattccgcaacgtagcaccggcatgattcatgagtgccaggtgccaggtgtcaaataagccatgaacccaaagccagtcaaaagtgacgaaaacggtgagggtggttcttggccgctggctgcctgcctccctgcaaaagccggctcgcgaacttcgcctggcccaacaagcgctcctgcatgccgcttttcgttgcgcgcctcctctactcccgtagtcccgttgcccagcaagcgaagacagtttttccgcggtgtctctcccttcccgacctccgtttcttggagatctcaggtgactttccggttcaaaagctttcaaggtgttcattcttcctcgcgcgaggggcgcacgactgcacgaggcatgacgcagctacgatgcttctgccgcacagctcatacggcgcgctacttgtgtttccaccgtgtgtgcaggcgatcgctcacggttgttcgatggccggggtttgggtttggtttggtttggtggtgcttctcgttgttgcgtatacttgcatgaaaagttgaaactgcagcgcgtcgtgtatgcatagcgattgatcgatcaggccatcatatggtcctcactcctcacacgtactagctaggagttgaacacaacaatatgcaacgacgatggttaattatacacggatttactctagatgtacgtgcgtaggtgtgcatactcgagatgcgccgaactgattctattgatcgcttacgcgttagcttaggaggtaataaaggaaaaaaaaaagagagaaagaggttaaggaccgagatgaattgatctgcatgagtcccattttttttcggcacatataatgtccaaataactcttcaggactgtttggataataggttaagaggaatcgaattaagataggaatataagtggacgattgagatgaaacgagggatataaagaatcgatggttaggattaagagtttaaggtggtgtttgaatctcttgaagatgaaaatgaagattaagtgttttatgcaaaacaatgtgataataacgtgtgattagttgagttttattttttacaaacttgaaaaatggattaatctgatattttagaacaacttttatatagaaagttttcgcacgaaacacaccgtttagcagtttgaaaagcgtgccacgaaaattcaaaagtttatccactctttgtcgtggattcgaacaggatggtgggaaaatattttcccatcccaggctcaataataaccattcttaaatagggaaaattggaaccatgccattataattttgcaaaaattgagatatgccatccaaacccacatgtcattgacacatgtgggtcctatattcattgagataccgatggcatatctcaaactttgcaaaattataatggcatggttccaatttacccttgtaaataagttactccaattatctaaatctattctaatactttctccgtcctaaaataaatttatttttcacctatctcacacataccaatagaaaacctgaaagactagaatacccttactttatcaaatctcaatgcattcctctactttattgctcctgtcggagtgtgaaattcctctgacagataaacaacgcgacgctcgcacgataaaaatgagggaggcaagttttttagactgtgttacagccctgcctagcgacgcgtggtgcaggactcaccacgctcccccccattctcaacaagacgggatggtatgcatgcgccacatcactattaattagggggggggggtgttgagcaaccccctcgcctatcaaaacatcatcgatgcgactgcgcttttcatggggtgcctaaggcaggtggcgcgctcgggccactgcttgggcatgaagagtgttcttacgtggtttgtgtaatctttgattctatcttagctgtatatgagcttgcaagagctacaacggatgtgccccaagcataacccaggaggggggcacgctatgggcggatgtgccccaagcacaatccgcggggtgccgcgcccgaggaaaggagtgccccgagcacagcccacggggggttcgtatccggaggtaagatgcgcccgagtagttggtgatggtaactctagttttcatttctctaacaacccccaatacaattattccctacttatgcaacaattactctaaaaataaacttattttggaacaaatgtaatgagctaaaaataaacttattatgagacgaaggaagtaagcaatattgaaattttgtttcaactggttggactcccatttgtttagtgtcgccagtttacgtgtgtcagggttatggataccacatacctaatagtagttgacttaatctcagcaggacccaccatataccatgtcttatacgagaactaactttagatatggagggagttccggataaggaaagacaatcagagttctacatggaaacgacaaggactactcggattgtatccatattggtttccctagttctaccttgacaaagggacacctatgggtataaatacaaggccctctaagaggagagtagacacgagataatcgacacccaccacaatctacagaataatatatcaagacagaagatcaacatacaagccaacatacgccaagacaagacgccagatatcgacttcagagataggcacggctagtcccctacggtgtctccggatactgtcaggagagacgaaagcgctatctttgatctcgccggacacgaactcgaggaggaagactaccctgttgtcgactacgagtcagaccttcagaccaccatgtcgacaacagttatatatgctaccctaaatattgtactggtgtgattatggtgaataagagcaataccggcttcggccaacaggatgtagggttattacctgacaactcaggggcccgaacctgtataaaaatccctgtctccatctcttttacctcagtctcacatatatcctagtaccaacgatccccatactatgcaaataccggaatcgcgacatcaaacgtcgacaacgtgttttagagattttctcatgtgttatgcgaattctcttttagactactatgaaacacaatattttaaaaatacagggataaggaaaatatagaaatatgtcatcacgacttattgaatcccagagaaaacaaaaccacatgaatcgctcaaaatagatatttggatgattcacaggaacaatatactccatccgtcccaaaatataagtatttttagactttgatacggtcttcgagatgctattttgaccaacgatattgtgatagtttgtttaatgataaatctagtaatattaattttacatgattgatcttatttttttgctattaatagttaaaattacaaatatttgatttggcagtatgctaaaaatgcttatattttatgatagagtagaaaacttaagattatattgcgatttgttagagagaggtgagagagaaagatataagttgtattgaaattcttaaaggaatttgaaaacataaggttagatctcacgctaaaaatactttaaaatatggaggaatcttttcctatcctatgaaaatcttttgaatcaatcctaataaccaaataataacctccataggaattgttaatgtgagattgggggtcaagacagcctttcacacgttcattgcattgggcatcgattggttcgtcgcccagccggaaactctgatgaagtctgaactctaggttagaattcccggtcacgggagaactgaaaagtctgaaaagcgatcccgcgccgaggtgctgatcccacggccacgggccgttgcgccgttgagcaccgacggctgccgtcctggtttcccatggcagagcagccgcctctgtcggtcagttgttcagtaggcgacgatggccagcctcttctgtcggtcagttgtccaggaggcgacggatggcgtccgtgcgtggccggccagccccaagcgagcgagattcaggctggcacccggtctacaatctacatccatgcctcccgaggccgcgggaggtatacaccatccgttacctccaatggatcccccgccttcccctgtatgctctcgtattgcgtattcccgtggccgtgcgcccgtgcctcactgcctctgctgtatgcccgtacttattccgtttgtatgatggttgaacgggtcggtactcggtagtaatgcttgctaggtgttcgttgttttgcctgacaagaagagtcgtggccttggcccgagaagcattagttacatttcgttttacagttctcagttactgaatttgttttgctgccgtacctctctgaattcccaagtacaactagtgagaaattgaccatggtttgcttggtggtaggtgccatgtctactattgtattcatattagtctttttttttctattcttaattgatgtgtagttccttataggtgccacaccaaatatgtgtagcgttgatcaaacattttagtctgacacatgacagatcagtgctttatctaattatctgttgtcttaatgatatcgaaaattccaaattgttgctctgattactattctgtgtagtacttctactcctgtcagttttccacaaacagatagttcattaggttggataagtggttaaatttagttgcaaactctgggagagatgcaactgttatcttaacaaacattggatcaggggaagcacatggagtgtagaagataagtcaaacttatgtcagattcccaaggaacatgatatcatgatacacatgcttccagtatagttatacattagcacctggctgcttcgccatttgttgtggtgatgctcatttattatagttttttgagcaagatgcacagttctattaagtcatgtaatgcattttttcattatgcacttgacagctgctgaattttaaattgactttcagtagaagtactattgatcttagactcaatatttttcttaacgcgtgcttgccattctgaaacacaatttctagtttacctgcggctgttattaactcactgcaagttattttctgaacacgaacttgtaagcaattgttctagtacaaattcatatggccatgcattatgtcagcattaatattagtgaaagtgggcaaatggatgtcgaaagaattaaaattaacactttataccatgaatgaacttccttctccatagctttattattctgattttacattaactgtgaagtttcacctgtgccaaatgtaaaagcaagataggttacttttcaaatgtttataaatgctcttccaaatttatttagcatgctgctttatctttcattttcactgtgaggtttgctaatcgaattctttttactgggatattcctggattctgactagattgatcatttcaaaacaggaaataagtttggtgtaaattgaaaatcactcacaatggttaagtttacggttgaagagatgcgcaggattatggacaagaagcataacatccgtaacatgtctgttgtcgctcatgtggaccatggtatgtttgagtagagtgctctaagactgttatacaactattatctttttcctgatatgccacctgttatgttgtcattattatttatactcatgcaaaaaaaaaaaaactactattcctttttgtagtagtgactgtcagtgctcctgccttttttttttcagaaaaagggcccatgctaagaacttttgctctttatcatctgtagttaatgtgttattgtcatatttatttttgcttgatatgaaatgtctgtaagcaaattaactgtatctgccttttcatttgcatgatctcaaaattaaaagctagcattttatagtatcaccttcatgtgtgcatccttcatcctgctcactgtttgtgctttttcgttaattaataaagtaacttacttgtttggtctgttatcacttctttgtttaacagagggttcctgatttcctgaatatattatgctcttgttttcctatttgtttgctgattcaacatcttgagttatatttgatgcaacaatgatgtttgatctgttatgatttctttgcaggaaaatctacccttactgattcccttgtggcagctgctggaattatagcccaggatgttgctggtgatgttcgaatgactgatagtcgttcagatgaagcagaacgtggtattacaataaaatctactggtatctctctttactatgagatgagtgatgagtcactcaaaagttacaagggtgacagagatggaaatgaatacctaatcaacctcattgactcacctggacatgtcgatttttcttcggaagtcacagccgcacttcgtataactgatggcgctttggttgtggttgactgtattgagggtgtctgcgttcaaactgaaactgtgcttcgccaagcccttggtgagaggattaggcctgtcctcactgtgaacaagatggatagatgttttcttgaacttcaagttggtggtgaggaagcttatcaaactttctcccgtgtcatagagaatgcaaatgttattatggcaacatacgaagatgcactccttggtgatgttcaagtctatccagaaaaagggactgttgctttctctgctggcttgcatggatgggctttcaccttgtctaactttgcaaagatgtatgcatccaagtttggagttgatgaatctaaaatgatggagaggctttggggtgagaactactttgaccctaccacaaagaagtggaccatcaaacacaccggttctgatacttgcaagagaggttttattcagttctgctatgagcccatcaggcaaattatcaacacctgcatgaatgatcagaaagataagttgttgcctatgctgcaaaagcttggtgttaccatgaaggacctaactggcaaggctctcatgaagcgtgttatgcaaacttggcttcctgcaagtaatgcacttcttgagatgatgatctatcaccttccctctccagcaaaggctcagaggtaccgtgtggaaaacttgtatgagggcccccttgatgatatatatgcatctgccattagaaactgtgatccagaaggtcctcttatgctgtatgtttcaaagatgattccagcatctgacaaggggaggttctacgcttttggtcgtgttttctcagggagagttgcaactggcatgaaggtccgtatcatgggccccaattatgcccctggccagaagaaagatctgtacgtaaagaatgtccagcgaactgtcatctggatgggcaagaagcaggagtcagtggaaggtgttccttgtggcaacactgttgctatggtgggtttggaccagttcatcacaaagaatgctaccctgacaaacgagaaagaagttgatgcctgtccaatcaaagccatgaaattttcagtgtcccctgttgtgcgtgttgctgttcagtgcaaggttgcctctgaccttcccaagcttgttgaaggtttgaagcgtctggccaagtcagatcctatggttctctgtactgttgaggaatctggcgagcatattattgctggagctggcgagcttcaccttgaaatttgtttgaaggatctgcaggaagacttcatgggtggtgctgaaattactgtctcccctcctgttgtctcattccgtgagactgttcttgagaaatcttgccggactgtcatgagcaaatccccgaacaagcacaaccgtctgtacatggaagcccgcccaatggaagagggtctgcctgaagccattgacgagggtcgtattggcccgcgtgacgatcctaaagtacgctccaaaattctatccgaggagtttggttgggacaaggacctcgcaaagaagatatggtgttttgggccagagaccacaggccctaacattgttgtggatatgtgcaagggagtgcagtatcttaacgaaataaaggattccgttgtggctggctttcagtgggcatcaaaagaaggtgcactggctgaagagaacatgcgtggccgtggcatttgctttgaggtttgtgatgttatcctccattctgatgctattcatagaggtggtggccagatcattccaacagccaggagggtcatttatgctgctcagctcactgccaagccaagactgcttgagcctgtttacttggtggagattcaggcccctgagaatgctcttggtggaatttacagtgttctgaaccagaagagaggacatgtgttcgaggagatgcagaggcctggtaccccactctacaacatcaaagcttacctccctgttatcgagtcatttgggttcacaagcacccttagggcagcaacctctggtcaggccttccccctctttgtatttgatcactgggaaatgctgtcagttgatcctttggagcctggcaccagacagctaaccttgtcctggatatccgcaagaggaagggtctgaaggagcaaatcacccctctgtctgaatacgaggacaaactctagatatttaatcatgttattatgcttatagtgttatatcgctttataattggtagtggccatctatgtgagcagtgagctgctatttcatgtataatattatgtcgaacggttgtacggtagcatgggatgatgatcaggcgatattgttataatttgttatggtatttaccatcatatcataatctgttctctctcgtatgactggtgcttttcatgccattagctctttgacccattttaatgctttgtactgtaacttaatccgatcattgattctgggagagtaatgtatttgattttatgctgagagtattataaatttataatgatgtattgctggccggaggggtagaaatcgcaagtcttttgtgtttcacttgtgcagtggagtaaggtaagaaagcaggtcaccgcaaacttttctcagactaatcacagttccatcaacattttttaagcttgctgaaatatgctccaccgtcagtgtgtggaccgatcattccaacaagccgactgagagcaaagataataatatagcaagctgcagagcatagatctttataatctatctctcagattactcatatagtggttaactcttcactataaatatatggtttatctatctgtctcatagatctttttggttcctgtgactaagccggctgtaaacttacaacccgcttctcatctatcccctctactatcttatccatttacagcccgcttctcatctatctcctctactatcttattcacctcagtattcagtcttcttataaccctctattgtacttgctctgacaagaacaaactataggagtatgcactagtaagggtgtgtttaatttaggtcaaaattaaaagtttggttgaaattggaacgatgtgacagaaaagttggaagtttgtgtgtgtaggaaagttttgatgtgataaaaaagttggaagtttgaagaaaaattttggaactaaactcggcctaatcccaaacggtgaaacaccacgtatgcttcttttattgatctgaatcttttaaccactgtactgtaaacagacagagcgaagcaatcatccaaccattccattacacgatcgaacacatctaaccgagctgagcctgagcagagctcactccggtttcttgtcaaggcaggtgttgttgagccgctcgatggcgaggatgagcgcctgcgtgccgaggccgccctcgccgtgcgcgagcagcgacacgtagagctggtgcgcgagcgcgagccccggcagcgccagccccatggcctggcactccgacaggcagatcccgaggtccttgacgaagtggcgcacgtagaacccggccgccatgtcccgctccagcatccgcttcccgtacaggtccagcgacttggaccccgccgcgcccgtggagatggcctccagccacttcgccacgtccagcccggccttgtgcgcgtacaccatgccctccaccagcccgaccatggtggacgcgatcgcgatctggttgcccagcttcgcgcgctgcccggcgcccggcccgcccatgtacagcgcgttccccatcagcttgaacaggggcgccaggcgggcgaccacggccgcgtcgccgccggcgaagatggagagcgtcgcgctgcgggccccgcggtcgccgccggagaccggggcgtcgacggcggcgcagcttttggcggccgcggcctcggcgatctccgcggcgagggtggggtcggaagtggtcatgtcgacgagcaatccgcctggggcgaggccggcgagggcacccgtggaggggtcgagggaggtggagcggacgtcggaggggaagccgaccatgaggaagatgacatcggctgcggcggcggccgcgcgcgggctttccgcgagggtggctccccgggagacgagcccctcggccttggaggccgtgcggttgtagacagtgagcgcgtagccggcggcgaggaggtggccggccatggattggcccatgacgcccgtcccgacccaggcgacgcgggtggtgtccggggaaatcggacggtcggagacgttcacgccggtggcggacgacgacatggctgctgctgcggcggcggcggcggcggaaagcggaaggggtgggcgacggcgagtgaaggatcgggagatgcttgcgagcatttgggggcgaagtgtgagccgaataatttgtctctgtgtgcagatgaattgtcccaaatgccctctggtgtcgccggagttgataaggtgagcctcgtttgcggtgctcctgaatgcatctcgttcgtcggaaaatttctttcccaaagatccatttgtcaaatttttcgtttaaggctgtgtttggttcctttcaaagttagaagtttagattgaaattagtatgatgtgactgaaaagttgtgtatgacaggttgatgtgatggaaaaagttacaaatttggatctaaacacagcctaaaatctactactctagtatggtctatagtttcatttgtgtactggcactctatatcgaattgagtagagcatcaaaaataaaagccagaatctcctaagagcgattctagcggttctatctaggccacccctcaatttcggcctaggagaatcccatgccacaccgaatccacaacacctgcatgaccattatcacataacatagattagaagcggtcaaacgaaggccgaaggtatagaacgtcatcgctccccgatactcgttcagtcgtcctatcaatgtctcacgtgtcggcaggggctgcgaggcatcttagcttgctcagaacagctcggaaacatagaaaaaacacgtagaaagtacacaggtttgggcctcctaccagataatagcactactcctttgcttttactatttcgatggagagttaagctcttgaacaatataaatattcgagggaatctaagtctctctctatagcaacttaccgctaggcttttatacccacgggtcacgtcctcatccttaggccggtgaaaacgccacgatatcccttctcgagaagtcaaggagttaccatggcaagccaggtggttgtgggtttgttttctttctcggagagagacacacatccaaccctgaggaggggtgactcacttgatccagccaggtacgttcttaacgaagaacaagtggagtttctgggcggctcgccaatgagtttcacacacctatggacatgccacgtttccgtgcccgagcaaccctaggctcccgtctaggtttcgattgttttaatcttaccatgcttatgtgatttgaatggcaaagaggcacatggaccttcttgaaaggacctttatgtcgcctagaggggggtgggtgaataggcgattttgaaatttacttcaaattgcagtggttaaaattagggcccagaacttcctggcaaaaggcccggaacttcctggtagctttttatgccgagcaaagaaagctgcctggaacttccggagttcttcctaggaacttccggggagttgtgagttgctctttcgagcacctcacaacaagtaaattgattcacaaggaagcctaaaccatagaaaggtgcaacatgtatcaaacaagagtaatacacatgaaactacgcaagatagcacaatgatcatacaaggggagacatgatagcacaactagacaaataaggggataagcatcacaatcacatagataaagagagtgggaggagacaaacgatttgttttcccaaattcggattctccaccgagaatcctacgtctccgttgaggagctccaaagagacgggtcttgattaaccccttgcctcaccaagcaaaggcctaggaagaggtctttggtcttcaagccaacacccctaggtacttctctttggtttcaaatgaccactaagattcctaacttgaacaccaagagaacaccacaagtgaggcttgctctaccaagacgacctcctaaaccttagctcggaatccactcaccgggtattctgtttcctttcggaggtggaataacgccctcacaaacttcctgcgattcaccacaagcttgggagctcaccgggcaactcctagccgtctaggaggcttaacctccaagagtaataaacacaaacgatgatttgcttgctatgaactcatgtgctcaaatgatggagtggatctctcaagctctcaaccttgccacctctcaatctctcaaatatcttcccaaatctcactcacaaagatctaccactaaggtgggaggtttgggaggggctatttggtttttgataggtctattcttacccaaagtcagcagcaaacaaaggagagagtggaggggcttaaaaaacacaagcccccaaaaaacttgccattactcacataatagggcccggaacttcctgccccgagacccggaactttttgtcaccctcctcgcccaaacagagagattgggtcagaacttcctggctcagggccctgaactttcgagctaccatgacatcacttcacaaaaacagtcataactccttgctctggagtctgttttcggtaaaattgggctctatggaaagcttattaagagggccacccaacccaaccagaaaaaagctctaaaaccactcatagattaagttaaggctttggtttctctcaaggtagcacttgcataggtcactttgagcaccgagacataaacaaacatatcaatgttgcatccctcttaatagtacggcattcctatactcaaatgcaaatagaaaagctataccactaggaatgccttcttgccatcttcttgcttcaccttgaggggtgccaacgtcaacgccatttcaccatagggactattcttatctacaactagttaagcacactagtcccaaatcaattatacctttgtcttgatcaatgcccactttggcttttgacttgatgttcatcggagaaccgcatcctcttgatcttcggcattccatcttgcggtcttcttataattgatacggattactcatagcttcaaatggcctcgtacggtccatcatgacaaagccttcgctcgcccttcaccaccggattcggtccgtcggcgccaagcctcttgcttgcccttcgctcccgcatgatccattgtagctgagccttacttgcccttcaccattttgccatagatagccacttcatacccgcatcatcaatgtcttcacttgctcttcatcaaggtataatgtccatcttctagccgagccttacttgctcttcaccgttttgccatagatcgtcatttcataccccgcatcatcaacgtcttcacttgctcctcatcaaagtaaaatgtccatcttctagcttcaatcttttaactcgatgccggaacttaacctaatctcactaactcatcgaaatagttagttccaacaacgggttgtcattaatcaccaaaacaatcaccgcactcttagagtcatagatattccaatctccccttacaaggcaactctagggcataaatctttcaaaaccatatcattttttaagtaaaattggcaaacacatgatgcactggtaatgcctagagaattctgacaacaacaactattaacttattaaagtaataggaaaaaggagccaccattttcgttctcacggcctaaaaattttcacattgataggagaaaaagaaaaaatagagtccatataaaaatgtaatttaagaatagctaaaatttggaattaaagataaataattttggaagatgagttttgagtatatatagagatacaattaaaaataacggaacttcggaactaaagaaataggaaattggaaaaacagtctagatgcgtccatatatgaacttagatctaactggaagctggacttaaataataataaatttaaaagtagagtttagaattcgtatagaaatacaatttagaaataactaaaattcaaaattttaaaataagcaagattaggagaagagttcaatatagaaatacaatttataaataagtaaaatacggaattcaaaaaaataagaaatatttagaaaaaaaagactagagtctatatagaaatacaatttataaataactaaaattcggaattaaaaaaataaattttgaaagatgagtttagagtccatatataaatacaattagaaataacgaaaatttgaagttaaaaatatgaatcttagaagaataatctagagtctatataggaattcagacataattaaaaaataagaaaaaaagttaaagtagagtttagagtccatagagaaatataattttaaataaataaatttaaaaaattaataataaacaagattgagagaagagtctgtagtccatataggaatataatttacagataacttaaatttggaataaaaaaaggtatactggaaaaaaagtttatagtccatataggaatacaaagtacaaataacgaaaattcaaaattaaaaaaaactaggaatattggaataagagtttagagtccatataaagatacaatctacaataactaaaattcaaaaatatgaaaaacgaatattagaaaaggagtatagaatccatatatgaataaaatttataaataatggagaaattaaaaaagtaaggaaaattgaaatatgagtctagagtccatatagaaataattaaaattaaaaaaataatcataactatcacgtatatacaataccatataaatatcacatattggttagttttgtcaagttattacataatttaaaattatgtattttaataaataaaatgtggaaatatttaagatattatatgagaaaaataaaacgatgctagccgcgcaatatgcgcgggccaccatgctagtttagtttgtcttacctgccttttattatactatcatttttttaattttaatattgctaaatttcgaaaaggtactaatcgtcctaaatttggaaggatgcgtcacggtggtgagcggtgacgtagctagtctttctatataactcaggccgtgtttagatgctttggaaaaaaaataatgtatacgtacacacgtttgaagtactaaacatagactaataacaaaataaattacagattccgtctgtaagctgcgagatgaatctattaagtctaattaatccatcattagcaaatatttactatagcaccacattattaaatcatgatgtaattaggcttaaaagattcgtctcgcaatttatatacaaactgtataattggttttttttcatatttaatactatatgcatgtgttcaaatatttaataaaagttggaagtttgaagggataaaaacagcctcaggctgatgagaggacgcataaaggcaaaccggctagtgaggagcggacctctcggtctctcggaccgatcctgtgggcgcgaggccgcgagctatagttaacggtgtggattggagtctacgcgagtaacgcaactcgtcgagtcatcggtccgcggtggcgacccggctgaccagtcaacggtccactggtctccgggtggagctttcccgcttggtttccttcctgcagttgccccactagtgaatctttttctttcggttttctttacggaccagtctcgactctcgagatcgatcacacgcgcggtgcgcacgatcagctcatatggacgtccttttcgagcttaccaggccgcgcggaacgccgaaaccgttagtgctaatcaccgatgtggacactcccagtcgcttccgttcaactctctcaggaaggtggagtggatggccggacgttgtatgcacaaaatactctcaccccgtcccaaataaaagaacttttatacatgaacttgatatcttaggacatacagattagtgagtactcccttcgttctaaaaaaacttaatttttaggtttccgtgtctgatgtttgaccgtccgtcttatataaaatttttgcatgattagaattttcattattgttaaatgataaaacatgaataaaactttatacatggcttattttttaattttttttataattttttaaaataagacgaacgatcaaacgttagacacggaaattcaggaattaagttttttttttttggacgaatggagtagagaatagtgagtgccatttttattggtagagcagtattcgatcaccagtattgtttgcatgataaaatctgtatactctactataagctcctgtgtcggggcaaagctcggttacatatggcatctgtagtttataaacggatttgtggaacggtaaattaacgttctggatcttgactcttgaccagttcatccacacgtgtgtagtccgtttgttggttggttgctttcctgttccagctggaagtttttgacctacagtaacatcatttttcgctttctattttgattccccgttgccaagtcgacagccgacttgaacctgagcctttcggcgaaacttgaaacctccaatccccaatagcccacgtacggttgcagacagccttgtagagtcgccgtgtttcaccggagcgaactgtatactcctacagtttaagatagttcggtggaaaaacgagtcgttagttaacgacctgagtaagctccgacttaaaaaatggtgaaaaaatgctgttaatcatgcgtcgggaagacctaactcacatacccatatttacaaacgaaaaataatttatgaataaaacttttatatatatgttcttaacgatctaaaagtaaaggttgaaaaataaatatggataaaaaacaccaaaattaacttcaaatttaagaccgaaaatttaaattttgactgataagtataagtataagcgaaaagattaggctgccagttgggcctttcctgaattctggactctcgatgtcttctcgaataaccatgccgtctgaatcactcttaagtcttactaatccacagaaaacaatcatgtgctccggtaagcaacatgaagcttcgaagcaagcacgcaggagcttataacggtctcgttcccgccgcatttgcttaacattctcaaaccgaactccccccacttcttcccgcgtccacagcggcttgcggcgggggcagaacacaccatggaaaccatggcaaaagcaccgggccctgtgtacctcctcttcctgctgctcgcgctgccttgctgcctcatcccgcaccgcggcgcggcccagcccgcggcgaacgaggcgcggctgctcctccagatcaagcgcgcgtggggcgacccggccgtgctcgcgggatggaacgacacggccgcgcccgcggctcactgctcctggccctacgtcacatgcgacaccgccgggcgcgtcacgaacctctccctcgccaacaccaacgtgtccggccccgtgtcggacgccgtcggcggcctctccagcctcgtgcacctcgacctctacaacaacaacatcaacggtacgttcccgacgagcgtgtaccgctgcgtttctctccggtacctcaacctgtctcagaactacctcggcggggagctccccgccgacatcggcgtcggcctcggggagaacctgacaactctagtcctcagcggcaactacttcactggcaccatccccaagtcgttgtcccgattgcagaagctggagtggctgatgctggacaacaacaacctcaccggcacaatcccgggagagctcggcgacctgacgagccttacgacgctgacgatctcgacgaacaagctcggaccgggtcagctgccggagtcgttcaagaacctgactaagctgacaaccctctgggcgagaaagtgtcagctcgtcggcgacatgccagcctatgtggccgacatgccggacttggtgacgctcgacctggcggtcaacaacttgacaggaagcattcctccggggatctggagcctgaagaagctgcagtgcctgtttctatttgcgaacaagctcaccggcgacatcgtcgtcgccgatggtgctttcgccgcagtgaatttggttttcatcgacctgtccgcgaatcccaagctgggtggaccgattcctcaagactttggtctcttgcagaagcttgaagtcatccacctgtactttaacaacttctccggtgagataccggcgagcatcggtcggttgccggcattgaaggaaatacacctattcaataatagtctcaccggcgttctaccaccggagcttgggcagaagtcaccggatttgtgggatcttgaggttgatttcaacaagttcaccggcccgattcctgaggggctgtgtgacggcggcaagctcaacatattcaccgcagcgaacaacctcttgaacggctccatcccggagaggctcgccggctgcaccacgctccagaccctgtttctccccaacaacaagctgtccggcgatgtgccagaggcgctatggacggcgacaaagctccaattcgtgcagctgcagaataatggcctcaccgggactctgccttccaccatgtacagcaacctttcgagcttaaccgtggagaacaaccaatttcgtggtagcatccccgcggcggcggctgctcttcagaagttcatcgccgggaacaacaatttttccggggagatcccggagagtctcggcaacggcatgccggtgctgcagacactaaacctgtctggtaaccagctctccggcgggatcccgaagagcgtttccaagcttaaagtcttgactcagcttgatttgagcaagaaccagctctccggcgagataccggccgagctgggcgccatgccggtgctcaacgcacttgacctgtcgtcgaacaggctctccggcggcataccgtcgtctcttgccagtctgaatctcaactcgctcaacctctcgtccaaccagctcagcggccaggtgccggccaagttcgccataggtgcctacgcccgcagcttccttgacaaccccaccctctgtacctcaggcctgggctccagctacctcgccggcgtgcggtcctgcaacgccggatcgccaggcagcgcttcctccggtggcgtctcgccagggctccgcgccggtctcctcgtagccggggccgcgctcctcctcgtcatcgtggcgttggccttcttcgccgtccgcgacatcaggagaagaaggaagcgcgtggcgcagcgcgaggactggaagatcacgcctttccagaccgatctgggcttcagcgaggcggccatactccggggtctaacggaggagaacctcgtcggccgcggcggctcggggagcgtgtaccgcgtcgcctacaccaaccggtacaccggcggcgacggcgccgtggccgtgaagaagatacggacgggcgccgcgaaggtggaggagaagctggagcgcgagttcgagtcggaggcgcgcatcctcggcaacgtccggcacaacaacatcgtcaggctgctctgctgcgtctccggcgacgaggccaagctcctggtgtacgactacatggacaacggcagcctggacgggtggctccacgggcgccgcgccatcaacgacgggcgccccgtggtggccgctgtggcgagggcgcggtccgcgcggggcggcgcgcccgctttggactggccgacgaggctcagggtggccgtcggcgccgcgcaggggctgtactacatgcaccacgagtgcaccccgcccatcgtccaccgcgacgtcaagacgagcaacatcctgctcgactccgagttccgggctaaggtcgccgactttgggctggccaggatgctggcgcaggccggcacgcccgacaccgtgtccgccgttgcaggctcgttcggctacatggctcccggtaacgatctctctctgcttgacactgttaattttgtactctccttttgtgccgtattctatacagaacatgtctagttaattaattcgagtattattatcactgagacttactctctctctcttttcagagtgtggttacacgagaaaggttgatgagaaggtggacgtgtacagctttggggtggtgctcctggagcttaccacgggcaaggcggccaacgacggcggcgagcacggttccctggcggactgggcgcggcaccactatcaatcgggagagagcatccccgacgctacggatcagtgcatcaggtacgcgggttactccgacgagatcgaggtggtgttcaggctaggcgtgatgtgcacgggggccacgcccgcgtcacggccaaccatgaaggacgtgctgcagatcctggtcaaatgctccgagcagacgcaccagaaatgcaaggcggagagcgggcaggaggagtacgaagtggcgccgctgttgctgccgcaacgaggcagccgccggaaacagcccgcgaaggccaaaggagcagacgacgacgctgacgagaggagcgatttcgattccattgtctgaagaaaggagcagagcactgccgcacctttacctactaggaaacactgatgtgagcagggaatggttagtctatgagccagcactgcactgcatgaatataaacgccatattagacagtactagaaaagatgatcatactctattaccttaccttgatggtacacttcttagtactattttgttagctgctcgcggctgatcagatcatttgagctttgataccagtgtgtaagagtacatacatagttcaaactgacatacgaaaagtgaaattatgtccccctctttattctgaaatctgaatgacaaaaggctacacgcgaaaccgctgtgattggtttgcgacatcgcatcacaatacaaacttacagggaaagggggaaaataatttgcaggaaaagaacggcatcattcaagcccccgttttcacttccctgcagttgcaaatgcttgttcatgtgataactgcaaactctttggcgccatactagctacatcccgctgcacaggcactcgtttatgtgactgcagaatagcaaaaggagatgcgaatcgcaggagggaaacgaactcccattggaaagaaacggggaaaatgggaggaaaacaagctacactgggagctcagtcccatgagctcctgttactactcgacgctagcatactgggagtgagatgctgcaagaagtgcagctccgatgccagagccatcgtttgccaacttgacaacaactgatgaggcagcctcctctccaagcaggtctgcaagcgttgcttctaggcaggttctgaacttcttgtaatgctcatagagaccaccatccagagcaatgacagtcctctgcttttgactaccgtcacttggcactctgtccctgcccagcttctttagaatgccatatataccagcagcagctaagcgtgcacctctctctgcaacgaggtcgcagacatgaagggtgatgtatcgtgcttccagggaagtatcagcgacctaaacataagttcaggcatatcgtaagtaatcaatggttcttgaaaattagatttgatagtatcctattttcaagatatgtattatcatacccccaggatatccttcagcttagctcccaggtgtttcagatcatgtgaggtatcatgatgcatcgctgacatgtccggcgtcctgcaataccacaattggagttccgttaagaaattttctacatagttacatgaatttatcttattttgatagttctgtgctaccatgatcaaggaacgcataatgcacaccatacagtctatgttgaaattttatcttattttgatagttctgtgctgcatatatgaaaagctagatacttagatgatcaacataggggacatagaagtgcacctcagtataaagcgctgctccagctttgttggaacaacatctccaaacaaggaagcatcatgagcaagcttaagcaagattctgcgcacaatctctccaagatacatgccggaaatcatcttttcatatatctgaggaaaagaagaccgaaattctttcatgcccacatatagttggaaaataaaaagataaaataaacaatacctgctcgcctgggtttaaactttcaaagtccaaggcattatcgtaatctgaacgaggaagcctttctgacttgaagtttccccattccatgttaatcaccttcatcataccaaagatccaaatgttataatattaattgatgtgacaatcatccagtgcagaagttgaagtggatacatacatttatacaaggttcaaagacatttaatgctacaagtataacgaaatcagtcactaaccatatttcctgatctaggtagtaatccagtccattttggaattgcatttgcatgctccacgtaggctgcgtttgtgccagtgcctaatattacagcagcagcaacgtcattatcaacatatcttccgccagccaatgtgcctacagtgtcattaacctgggcaaaatattagttgtcaatttacatgacacagtctggtgatatactagtaaacatccaaactcatagaacattgaaaaactccaaagtcagcattttcataggaatgccaatgtatttacccatcagcatatagcagtagcaggcatgggaaagtttcagatgataaataattttaacagagtcatgaaccaagaatttacttacaagagctgtaactttcatatcaagcccttgcctttccatagccctgctcaattcagccacaacatcttcccccacctgagttcacagaaatcattagtctatacatcaaaattatgggcataacattataaaattaaaaaagatattgcagtgttgatgccacatttgtcttgagaggctagaaattgccacattaaaagtaggaaacagaaatatgactagagtgcttcattcttggaggttcaaatttaagaagtgcaggataagcaaatacatttttttatggttacaagtgttgtatagcaaacacagctctaattgtaacatctgcattcacaatcgccgcaggatttagaagcaattataagatacttgtgaattggataaatggggacatatgccaccatgtcccgtttatatcacatctaagaataactttaccaaacatgttaatttatggataaccaaacatcagtccaaatattctgaaaggaaaatgaagggcaacggctggtcacttggtcaatgcagggaacccaaaagtcaaaagtgacacagctagtgagaattcgtttgctgacacaacgtggtttctaatcaagactgatcgtcaaggtaataaataattcctagatcatttagccatgaaatttatactaaggccattcgaattttaccgtgccattgatggaaaatccctttgtccacttaataagagtgcctgatgatattgatgtttggtgcactgggaaagaaaaggtgaagcctaactctctctgcctgccctctggcaagtggaaatcctctccctcggtcttgacaaaactttccaactcagccgcaatgaagtcaaacagttcctgtactcatatttctgaaatttgagtaaccatgaaagaaattgtgcaaacacaggagaattgaaacataacagttgaaaggaataagccactgaccatagaagtcccaaccatcaggtgaggtggaatggcaacctcttcgtactgttgactaacaacacgcttttcccttcctccaagctgaacacgtataacacggaaattggtgcccccaagatcgagagcatagaacagtccgtgctcatccctgcacaagtggcatgcaaatcagaggaagcataaaagaagatttcatgaagtgataggctcaacatttttcattttccatacgcctatggatacatataataaactgtcaaactcactgaaacttttaagcctcgagtccttgaccatttctttctctaaacttattcataaacctttcatgacatttcctacaaaattcacatggtacaaaaaaaagaacgattgttctgtgatcgactgatcgtaagcccagcatgaaggcacaaattacaaaatggacacacagatatatatagttgtcaaaagtgaccggaacctaattgttcattttataattctgtctggagtcttcactgcgaaaaaaaaattatgtcaagtctatcctggtggccactttctgctaccaccgtgagaaacctccactcagtagatcaaaattccataggaaacgaataggtctcatcattcttccgtgatcaataagaaaagagctaaaaggccgtgtcaaggcacagtgctcttgatatcaatatgtcgcacctccatctcaacaaccgaagatcaatgccacatttatgccaaatccgaacctaagcaagcgctaagccgctagggatttccaaccgattcgcccccgaagagaaacacccctcgcgaacacagtaacaactattcccaagctttctcgtgtcacgtacaccccagaaatcataaaaatcgcacaagcggagcggagggaggcctacccggtggggaggttgtcgacgtagctgatgagcatcttgagcggggcgtgagggtcggcgcggaggccgcgctccatctcctccaccatggcgtccgcgatgccgcgcagcagcgccgtgggcgtcgagaacctctgctccacctcctcgatcacagcggcggccctcctccgccgctcctcctccgcctcccgcttgctcctcctcctccgcgacaccaccaccgccaccccaaccgccgcggccgctgcagcgcacaccaccaccgccgtccccactaccgtccccttccccatagccgcgcgcgcgcttcttcacgctccccccaacccaaccctggcctccctctcgatcgagcgcgcgccaggagcaaatcccccagaccgggtcggcttcccggatcgggagctacgccacccaccactgcagcgtcctcctcctcctccttcctcctgcctccctccctcagtctctctcctctactcttttcttccgcttgcgcaagcgtgggaatgggacgagagccacgagttgggcgtttttgctcgcgaataaatcgccctcgagtttgacgttatttacggatatgcccttacgtatgaacggccctgatttgtcctttctgtaaccgtagggctcagattgcagatgccccaacgcgggctttgtctggattcgtttcgtggctctgcgtgctgctgcctgtaatatggagatttcgtgaggggtttatgtatcaaaagcttcacaagattaacgaacgaacgagcatgacagccagggaccagcagatggcacctgccggccgtgcatttaggagagccaagaagggtgttcccgtcaaattccctaattttcactagagtagtaggagtaatcagttccaaatgtccaactgattactttgtcagaactcgggcaactaggcccaccgatcagcaaaaggctgggagtgattagttaaaagggtggcaggacgtgattatgatacgggggtcacgtgcacgttggggcccacctgcagtaccgatgacgtgaccatgagctcagaagtatacgtgtcgatgaagcaacggccggctgcctggagatgcgtgctcagcgactctgagcacatatcttccctcgcgcttgggcgtgggcgtcgataattcacgactgtagcgagcgagcgatccatccatccggcccactacgtatcgtcgtggccgacgctcggatgggtcgccgcacacccaaaactcacgatcgttttagctactgctaataaaacatctatccccatcctataatataacaacttttaattacgaatctaaacaaatatatatctaaatttatagttaaaaattattatatttaacaacaaaggcaacaaaaagcagtgaacaaagcaacgaaaaacagttttagataaattacaggtaaaacactatatctatgttcttagtggtttaaaagttaatacttaaaaatatcgaaatgtgttacgattaaataactctaaaattaagtgtgaagattaaaattttggttactgtcgataagctaacaaggacgaagagttgaaaggcgcatatctatgggtaccttccacgatttgattagtcaatgtcagaaacagctttcgcacaatcactctcacgcaaaacgtgatataggccctaaagccattagtcataggctcaactggtttgctgatcatatcttttaatcagat

SEQ ID NO: 74718 - DNA, 12337 bp, Oryza sativa
atttagcataatagtaagtgctagtgaaatttggaaatctcttcgcatttatatttgttcatacgacatattgttaatacacggtttatttttgtactaattagtttgcactaatttgagtaatttaaaatgtgacgatacactttttttttatattagaggtttgaaacgatggccgatagtactaaagggacttaagagaagggtttaggggagcaggagcagtcccttgctgttatggttgctccggaaccaacggtcccaccggatggtagttccgacagcgacgtaggtgacgaagacgaggagtactcgttgccaagcgatccttgtcaaagcccaagcccgaaaaaaaggaaaaagggcgacggtgaagaaggcgacaaggactacattccccctaaagaaggggtaagtaaacttaatatgtaaaatgttcacagtgatagctattagcccgagctaattcgaaactttcatgcataccttctagtaggaaacggcgccacgacgatcaaaacggcagccgaagaaaaaagttccttcgaaagacaaggacgtaccggcaaacacaaccggcacacagaaaagcgaacggtcagcaaaggcgaagagaaggaagggcgagagaagcgtaaatagaaaggatgaagggttccatgttgttacccatgtttcgcctaaaggagagccgctcgcccctaagacggcacgtgcgaaattcagttcacagtgtggcataatagtaagggagaagatctccatcacggtcaaggactgggatcatgtaacggatggggataaggaagtcctatggaaagagttgaagaaaatcttccagttcccggaaggatcagaggcagcggtgagaaattgtgcactgcaaacaatggccaagtcttggcatggttggaaaaccaccttgaacaagaaatttgtgaagacgggacgcacaccgttttcgacgtatgccaacataacccccaatcagtgggacgactttctgaccttgaagaactccccggaagaaattaaaaggagccaaaagtactcagagttggccaagaagaacaaatttcctcatcgcttaggctccgcgggctacgcaccaaaggtggaacagtggacaaaagaggaggaggaaatgaggaagaaggggcaaccggtaccaatggaggagtggacacagagatcaaggaactgggtaagaggtagaactccgaagatcacggatgagggaaaagtatcgtttgaaaatccggagctgcagagcgtttccgataaaatagaaaatttatccagttcacaaaagaaaggatattttaagcctaaaagggagaaagatgtgctaagtacggcgctgggtactcctgagcatgggggaagggttcgaggtgtgtcgagcaagataagttggaaggaagggttcaaaaatgacccccacaagaaacgtgaagcgtacaaggataaacttagagacgaaggggctgcggagtttgaaaggaaaatgatggatttctgcatcaagcacatgattttgcctcgccccgaaaccaaagaaactgagccagattaccccttcgataacctcaaggagaatacaccctgcagattgcacgttcccattggacgctccggtaaaactcttgaggccgctacagccattgctatccctggtagaacatacaatgaacagttcatacccgatgcgtatgccaaggtgtagccacaagtggtccacgaagggtttgagtcctacgacattgactacccgactgcagatggtatatctgtacttggggatgcgatcgatcttgtaattctctggcacaagaatgacatattctttggattgggcaccgatgccggggaaaaacctgtgttgcctaaaccgggtttgggaaaacctccgaggcctcctaagaggatggtgactgataaggcggatgatccagaactggataaggaaaatccagtgccggaagtgccaccagagattgcattgccggagacagccaaggagattgcaccgccaaagacagccaatggagattgcaccgccggagacagccatggagattcaagtgccggatgtgcccatagagattacagtggcagaaccagaggtggaatttgtggcaccagtcgggtcagacaaagatgaagtaccaggattggaatgggatggtacagagccagagatatttgaagacccttctcctgcgaaagaacccgaggtgccatgagtgattaggagccacgaatccaagtccaaatatgcgaacaaggagaagttcatgctaaccgtcttcagagggggtaaggaacgtgccaagctcagagatgacgacccccagaaggcttctgtgctagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttaggcaatataacagctcgatcaccgccagattgtttcggcgaagaaggttacgtatggctagatttctcagatctccacgccatatatcgtcaggataagatggacgtcaactatgtcagtgtttggtgcatgtgagtacgagttttaattaattagatgaaaaatatgtacaatacaactccatgtgattgttactaacaaacttcttctgtaggatgcaatacatggatgctaagaagaaaaaagaacccatcggcttcttggatccaactcggatctgccaaacacagcataccgttacgctagcaccagggtcagaccagctgaagggcaagaatccgaaagagatagcagaatacaagaagggcttgcacaaggagaaattgattactgtcgcacagtacattggacgagccttcttgtacttttaaaataagagagtcgtcatggccgcttataattttaagtaagtccggtacagttatcttgtatacatatgtcttattttagctgttactaactaataataatgttgttaatatgtagcgatcattatatctgtttactcatccaccctaaagacggaaccgtggtagtcttggatcctctcgattacaatcacaagcaatacaaagaatttctaaccatcttacagtagtaagttattatgactcttgcatttgtatatggatgtattacaaataaatatcctccttactctgaaacggtatgacatccatacagttcataccaatactacaagttcaagggtggagaacagacccgaacacgggagaagctgctagtacgtacctattggccggtaatactccactcactttatatattccaatagtttcactaattgcaaattataactacttttttctatgatatgttcttcagtgtcacaagcaaccgcgaggaacggtcctttgcgggtattatgcgtgcgaattccttaaggttaatggacggtacaggactaacgcggaggatgtaagtctctatactatgtactagacagctcttgatatttttgatactaatatattgattaatttcaatacatgcagttgccaagattagaatgtcgaacaagctttgacgatacaggtatcacaaatgtgcagcgtgatctgtgccacttcatccaccatgagtgctgtcatgtcaaaggagatttcttcgacccagagggtgccctagcggcaagtgacgaattcaaggatcttcaggagtggaacactactatgccataatgtaactagatgacgttatttaaagtgacaatgtaaaacaatattgtaatatatatattttggcaacacttttgatttatgcaatataagtagatttctcagtaccaaatgcttgataatcttccaatatatgtacctgcaagaatttctaataaataatttaaaagtaatttacggccaaattatatttaaatttcaatattttctacatatcttcgcaggcggaagttttcttttttgcaagcggacgattcctattttcgcaggcggaccggactagccaatgtccacctgcgaaaattatcttcgcagacggacggccgccccgcctgcgaagatcgcgatcttcacagtcgttggcttacaggcggacggccgccccgcctgcgaagacccttttcggccgcttgcgataatgcttttcctagtagtgggtattcgtcttttggtgcagatctttgcatcaacaactataccgatggctgggctcgaatcagatgcacctgaaaccaagtatggcctgttgatttggtcttttgcaggttcatgtcgatgaaaacgggctgactcaattcacatgcacggcggggtttgggtgggtggggctatgaaagaaattgggtttttttttgggaaatttcaaaacaagggtgatgattggggggaatttgaaacaagagcattaattggggatggtttatgcaattattttgatgactagatgcaagttatgtatatttctcaacatgtataaactttcaattagaaacttttttctacacctaaacatatactattaaaaacagagccatcagtactttccaaatccaaaacaaagtcgtcaaatctttccgaatcaaacccatccatcggtactttctaaaacaaaaccgttaaattattattcgtagaaagttatttagcacggcaacactatttgcatctgtgtaaaaatcaattcgacacacaaagtttgatcggaacagtgcaaaaattatttattaaaatagataaccttctacggtaacaatatttgtacatatgtataaaattgcaagtagaaagaaatataaaatttctatacacaaacttattttttaatgaagtgaaaaatgtttaaccataaattcagaaacactttatggcaccaatactgtacatgcataaactttcaataaaaagttattaaactttgtaaaaacaatctattatctatgaagtgaaaatattttatccgtaaattaatttatgaacttcctaggataaactttgtttacccacctctcaactttgcgtatcaccagaacaatttactcaagtaactaaaatagtatcggaaaaatgggaagggaggtattctcatgctgcatgaaacggaaaagaaaagaaaatacgtaccgcaaattcttgcgtagcctaaaattctgcatcaccacccgtaaaataacaagcagaccaggagacagtgactaaaaagaaaaatgagaacatagcgtgacactaccttcgcccataaatataaaagttttttttctatggatctacacgacagatttttccgtgcggtcgaatcagattttctcgtgcggaacttcggcccgtctagagcaaatcgtctgcgaaaatcactatttttgcgtgtgggtgcttatgccgcccgcacgggaaaataaaaatccaaaaaaaattcaaaaaatggaaactctaaccctagatccgggcaccccaccgccaccgccgccagatctgggtggggggcagctaccaccgccggtccccgtcgtcgtcgttggcagtggcccccgtttgcccgccgccgcctccccaccgtccacccgccgtgcgcacgccgctcccggtcaccctctgccgcgagcttgctgtcgtgcgcacaccgctcctggtcggcgagccacgccgctcccacccaccgccactcccgccactcgccgtcgagcctgccgctgagagccgcccagaggaggaggagaaggaagcacgcgccactcccggtccgcccaccgccatcgcgagcccgccgccgagagccgcccggaggaggagaaggaggcacacggcgccacggcacaggagaaggagaaggtgagagggagaggaaagtgagaggaggagaggataagtaggaatgagagaggagagaaggggccgggggagagaaagaaggaatttaaaattttttgaataggataggagggaactattatttttatgtgctgatagattaagaggcccgcacacgaaaataggcttattttcgcgtgtgggcctgttacgtgacccgcacacgaaaattgatttttctatgcgggcgacgacctggctccggtccctctatttttccgtgcagtctaacttacgggctgcatggaaataaaataggttggtgtccagaaaaatcaatcatgtatgtagtagtgatctaaattaaacaacggtcggaaaaaatgcataaatatttgtggacgaaagtagtagcaaacaagcgtgctctgaaagattaatcggtgcatctatcacatgggttggcgttcgctcgttaagatttcatgtttgacccgttgtagctcctccgctagcgagccaacacaaagattagtccacaggtaaaacttgactgaggtataggcttggtcgtctagtttcgtcttcagcactaaaacactaaacttatgaaaatagaaaactctagcaaggctcattatcaaccatcgtactcagcaagccacaccaataatacagtcatataagaaaagacaaagaggggtttctggctagttgcataaaggcagttgtaagcatctatagttgaatacagtaaaacaattaattaattatgttaacattaatctccgttgaataacgctacaccatattgaacaggtccaaccaaaccatctaaactacaccaatttattatgttaagttaattaatagtgagactaattacgactaacctcctcgatcgcccgtaactacatacatggctattcaaatagttttacactgaccagaggtgtacaactatacccatagaacacaatgccccatcatatcaccgtgccatgcctaacacgttgccatgcgagtgattatgataagatccttcgcataactcactccaaaccatccacatcacgatgagatttcacccccacccctaaaacaggggggggaggcccccaaatctagaagccgcttagccattaatccgtttctctataagtgaaggttaaatcccaaagcatcacctgataggtccatgtaagccaaaaaaacaggaccatccgatgatgaaaaaaaaaaattaaagagagccgtaggatcatatcagtaaaacaacctgacagagcgttctctcgagctttccaggcttccagcataccaataccacaccagaacctcccttggcttgctcacacatgggacatacagagcaaataaaagaagggaaaatcacatggcagaatactaactttggtatatcagcgaaaaaataatactataacaaataggtagttaaatgtcagattgttctttataaatcattaggtttgtacgattctaatataaatatacataataaaattggaaaatagtaaatttacacatgctataaaacttatgcactaatggaaaatgagtgaaggataagggtaatgctgtagcggagatggcaagaaggcaacgacttatgctacgatgaaggtgatgaaaaatattaataaaattatgtaaacttcattttagatattaatataaggtttggataaaatagcaacaaaagttcgttgtcgtactaatatagttgtcgaaactagatttcggcaataataaaagggggtggctatcaagctgaaaaagtgtatgggtttggagacaaaagatttatacaggttcaggccttcttattcaagaagtaataccctactcctgtccggggatgaatccgccgagtgtattattgattgtatgatttggagaaaatcaacatgtgcccctagaggcacccggaccccccttatatatgggaaagagtccgtgttacaaaagataatctatatccctaacggaatatgcaaatacagatcaaatacagtcgtagccgactaagtctcaaggtatttccttggtgtacaagttgagaaacaaacccgagacacaaataagatattctatctatattcggtatcctatattcagcccaaatatcatcgccgtgtagatatgggatatccataatctccacaatagtttattacatatcaaaataaaaataagtatttttacattccaagtagacctcctaacgattttattctctaaaacattcagaaaattatatataagatgaaaaattcaatatgttcccaatattttttttaattatgtacaatttattggcgactgcaccttttatgttggagtccatgtatttattaataatagtataaaccaataaataatctttctagaaacacagtataaattggtacgtcatctagcagtaaaagaataattagccataaatataagcatccgtaccaagtctagaacttaaatctgggtgtaggttctactataaggaacctaacctattaagatatgctcacatcgcgaccaataaataatattgtaaatgaacactcaaatcatttaataaaatctatttaatttataaatatactctaatcatttaattacaatttgattatttgaagaaaaagtacaaacaaacacttaaaaacatgtaaaggcactcaatatagaggaggttaatatcgcgcgaatgcacatctatatacacttggtttagttgaatgattaggaccaataaaacatggcctggtgtctcgagctcgcagctcgtcaatatgctaatagtaaataatgtgattatcccattagatgagctagtggtaattaagcatggctaagtatatctagctaggtcaacataactaacccaagccagtcaaattattatcgaatgtttcacaaaggatggatatcaagtaggcatggccacaagcaagcaaataggtattgcatattcccatgtaattagcaaaacatgtacaataatcattttaaaaagtaggctcaacatgcacaagggagaatatgtgacttgccttgcttcttcgattaattttctgaacgcttttcattgcggtggtgatcctccgaaatggcggattctacatgctagcacacaaactgaggaaaaaaccaagtaaacagtacatgaaaagtaaacaaacatgtagagctcaatttttgatgaatttcgcaagttgaatggcttaatttggagttcgtatgaattagttatgaattttacaacatttgagccatttaaatcaatttatggtattaaaatgatttatgatgtcatttattaattattcttcaacaggaaaaactaggattatgacgtcacccgggggagtggcgcccacaagtgggccccagctatcgatgactcaagggggaagggcacacgttggaccgagtcctcgcatggccccggacagtgtcccccacgtgttcagcgcagattggccggccacagccaggccaaggcatggcgcataatggaccgggtggccagcgccggcttgactgaaagtggcggttcacgtgaccagatggccgctggcagcaaccatctggcatgccggcgtgcgtaggatacggtggatgaagccggaaaggaagagtgggacctcaccgaacaatcgcgcgggcaacacgacttaggaggcatgacggtggcgagtgcttcccggcggcgcttcgtgggtcgacggcagaaaggggcttccggtggcggttcacgaaggcggaggggaggacaggctccaccatgacatagcgaacaaggtgatagagtttggaagaagaggtgtggcacggtgccacaagagaagatggcccgagatcggtggaaggaggaatctcacaggattgtgacgaagatggcaatccggtggcctttggcaccgatggggaggtaaccgagataggccttgatgaagcgaaaccaacagcacaagatgtgcagcgtttcggcagctagagcggcgttgtgtggcagttggaagaggtggtggctttgggaagatggtgaaagcgttgttccagtggtgttcggggacgatagaagggtggccgagcttcttcttgtcccggaaatgctggcggtggtggagtcatgacatggccaagactggagcggtggcaagcagcggctggaaggcgaagaacggcggcgtagcttgggtgccatggtgagggagtggtgagcaattgagctcggcgacatggaaaaatgagagggggaggttcgacggttctttcaatgggctcagggaggtgggtcatggccatggaggacggcaaccggtgcgaagtagggcgatgatgtgtgtgggaggtggcttaaatgggcagagatttttggggaaagtgggatggagatagggtgggggagtgacggcgacctagtccacgccattggaacagggtgctgggaaacggcgaaaaaggcggcggcgtgtttaacattatggttcggtggttgtaggtcagacataggggatagagctaacaggtgggcccccggccccacctgctggcgagcgagagagggggctggtgatccgactaggctatgggaactagtcgagcggggcggatgggccatgtggaagtgtgcggcctggttgagaggacgggagcgacgcggccgacgggacaggccgagcgagctagtccagtgcaagtgctaacagaggaggaggccagggccgacctagggagaggaagggaggaaggattggttggaaaaaacccaaagctgagggagaggatttttattcgtttttctatttaactgatctctgaaatgaactttgagctttaaaattcgatattgagcaatttaggtcacggagaagattgcaaaaatattcccagccatgattttgaaaggaaattttaagatatcgatcgtgccgcgtgcttgacaagcgtgctgccttagtttggttggacaaaactaatgccacaacttttttttatttgcatgtgcaaccgaactgattgaaaacaaatctgttaggcactgcgactggggcgacgataatgggcgtcagcgatcaccccccatccccctataccggcctctccccctttctcctcccccttcttctcttactactatacaataaattttaaaataataaaaaaacaaagttagaaaattttatgtataaaaatactatataaaaaaatatttgaatttaaatttaaatttgaatcgggtatataaaactttctacttataaactttgggtctataaactttaggtgtataaactttaggtgtatagaaatgctatatataaaaaaattgaatttaaattcaaattcaaatttgaatcgggtatataaacttttgacttataaactttgggtctataaactttaggtgtatagaaatactatatataaaaaattgaattcaaattcaaattaatatttgaattcaaattcaaatttgaatcgggtatatataaacttttgacttgtaaactttgggtctataaactttaggtgtataaactttagatgtatagaaatactatatataaaaaaatatttgaattcaaatttaaatttgaatcggatatataaacttttgacttataaactttgggcctgtaatctttaagtgtataaactttagatgtgtaaacttgaggtgtataaactttaggtgcataaattttctaaaataggaaagtaatgcggtgccaataaataaaagtggagggagaggggattgatcgccgggagcaattgatcgctcgttaggattctcgctgcgactgtatctacaagccaaacagatatgtctcaaaataaatcgatttctaatatctcaaaaaaaaactttaatagtaagggtaaaatatcaaaatacatctcttattaataggaaagtggtatttgtaggtggataaggtaaggggtgtattgaagacaaaaataaaacatctcaatatgtttctgtagagagggtagctcacacaactagaaaaagtgtttttccatgcggcccaatcacattttcacaggcgggcaagccatccgcctgcaactcaacacttacgaaaatacttgattttcgcaggcaagcaactggtccgcctgcgaaaatagcttcgagcgctaaaaaaaatgggcagccaccgccgttttcggcggtagcttcctattcacaatccagttcccacccattccctatccattcccaatccagttctcacccattctccatccaatccagtgaatccaaattcaatagagaaatcaccagttcatccggttcatccaaaatcaccagaatcaattctagcaaagaaaccaaataaaatcattcctaaaatcacggccgccgccttgccgtagttcgccgccaccgccgcacgtccgcgccgcgctgtcgtccgccggcgccgcacggccgtg

SEQ ID NO: 74719 - DNA, 14581 bp, Oryza sativa
  unsure (1)..(14581): unsure at all n locations
tgccgccatccgccaccaccgcctgccgccaccgccggtagccgccgccgcctccggccggcggccggggagaggaggagaggtcaggggagggtagaggccgacgagagaggagaggtgtggaggggaggagaggtgtgaagtggagggacgctggagacttagaaaaaatgtagctatcgcaagtctatttatattccaagtctattttcgcagtttcgcaagcggacagtaaatttcaccccgatttatatttttgtagacggtcatttggttctaaggatcatgtccgcctgtgaaaaaaagaccccccacgtcgggaaaaatgctttttatagtagtgtcacaggctaaacatgaatttattttagacaaatcttaaactttagagatcaacttgtttgaagtctaaaattattctcggggaaaatacatgcgtctacgtgcttgcgtgctaggtgttcgaaaccttcactgtaaaagatacattacttgcatgtagtcagaaaattttcagggttgtaccgtgttcgatgatgatgaattgtttgaacggagttcgaaaaattttggtggatacccacggaccagcaccagcgtggtacacacaggagcggatccagcgttatatgagtggtgtcagctaactcacttgcatgttgtgagttgagggtgacatcatcggcccaaaatcctggatccgctcctgaacaagcatgctctaaaagattaattggcgcatccatcacgtcggtgggcattggcttgttaagatttcatgtttgacccgttgtggctcctccgctagcgagccaaccgagtggattagttttccgtagcccctctttatctcactgaataagtagacgcttctccagctctcgcaagaattgtgaaaaacgaatggtatcctggcgcgcctcttcgcggaggcccatattcatacgtactgaaagtaattagaaatttattacgtgattagagcatctccagcaataggcctgattttagagtccccaaaagttaaatggggctacacctatttttcgagatcccaaataatggctccagctccaacagtaacccccatttgttagcctctatttctttttctcttctattttgatatatactacatatttatttcttgattcacagcagaataattcaaacataaatattaataatacataaaattcaaccatattcaaatccacaattccaaacaccacaattgaaatttaaattcatttttttctcttcatattgctggcagcgcctgtcagatgcaaaaacatcttggctgttctagatattgttgaagtgttccactaatatacttcaggaaaaatcctgagaaaacttgaaaccaaagtttcagtaatttgcacttcaaggaagagactagaagcgtgcaaaccaatgtcgtcttgactgttctaggtatatccgtatatctgttttgactacaaatcaatctgaactaatgaatattgatgtaccagctatgcttggtggacggtctaatatgcaaatcaatatgagccaaagataagcagtttgatcatgtaccacctctgctcggtggtggacgttcgcgacaataggaacatcaacagccactaccacagaaacaatttctatgtacaagacctttggtaggttgtagatggaccataacctgccgcatctggaaaaaatcgagcggcatttttacatatggcttcttaagatgcccatatagaaaaatcgattttcccatacgagtctaagacaggtctgcataattatccgcacgcgaaaaatcggatttttgcgtgcgggtgcgtcactcgcacgtaaaagtagcgatttttccaaaccttttcgcgcgtgcggttgtcccttccgcacgcgaaaacctattttggaccatacgcgaaaatccttttttagtaaagagcaatggtgctgctgccgatgagagcaaggccaagaaactcctgaagagggcgtcgtcgttcacagacagatcgtcgtcgtggtgagcgatggcgggtgcagggtagggatcaaggagctcgattgacaagttcaacggatgacgtcgggtagcgcagcggtcgatcggggtagacgaggacatgacagagggaaagggcaacagtggacagtggaaccaagagcgacatgagaaaagtgcgctggagatttttcatcgtgaaaaaaaaaagagagataggggctgaacctagagcccccacgattgagtactggggggagagatttgggtgtcttcctagggcctcgctggacctcgatttttctctcttcacctcaaaaactctttggaggtttagtttaggtgctctactggagatgctcttagaagatcattattgggttgaggcttagttattttgagtagtatctaaatacccctctgacggagcgtggggctcctcaccgggagaccgcgcgggcccccctttgccggttcggccgggggcgctaggtgaggttctaagcccccgatctgaggattgtcagcgagaagaagcgcacaagacacgggcgacgtagacaggttcgggccgctgagaagcgtaataccctactcctgtgttctggtggatctgtgtgtgaaggagttacaaagagctggagagcaagagagttcaaactctagagaccctcttcctctttttctctcctctccgagctcccctcttctccaagtgggcaaggtcctccttttatatctcaaggggatcccacatgcaccacttctacctactcttcttttgggtggggactcaccctatcttcccaaaaaagaaaaaactgacttgcgccttcgcctggaagctaaatcacagcttgtctttgagtgaggcccagcgtcatcactcgcctaacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaaacctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaatgagtgtgctgcgctgcattaaatgcagcgtggggcgctcgtccaacccgcaataaacgcggctaggtgagcgccgctgtgctcacctaacccacacacgtggcgccaaacccacaggaggtcggggcgccccagccctcggggccgaaacgggagcggcccgacccctcggggagacagagggaggggcggccacatcaccctcgggcccgacccccccgagggggtcaggccacgtgggtgaccgcggctgccccaaacctctagccaagatacccccggtcccatgtcaccgacagtagcccccggcgttatgccagggcgatcgccttcctcgaggaaagcgctcgggcgtgacgccactccttaagcctggtgacaggcggggccggtctctacaggcgggcaggaatccagtggtcgcaaatcgcgcgcatcggcaagggaaaccgaccgacaataatttgcggctttcttcaagaccgctacattacttaagtagcgcacgaatcgggacgagccggttcgtttcgcctggagatgtgatgatggtgcatcggtcggcgagcgtagttaacgcgcgcacgatatgtcccatctcgactgccacggccgcaaatccgcctcgtgcgccgcaaacgggcgagcgcgattagtggaggcgtggacgcgagagacgatggggcgaggtagtaggcgcggggatcgaggagcccggcatagcgttggcaagggtactaagacaccagggaagggatttgtttccttcctctcgccactcttccccttgcctttgccacttgtgctctgactctccgtttccggcgcctacnccctgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcccgcattacccggggcggtccgtcttcttcctctctttcgcaatggcagggctggtcccgccattctcttctttcttcatagatgttctggagctttatgatctccagatggcgcacctcacccccaacgcggtaatgacgttggccatcttcgcgcacctatgcgagatgttcatcggggtgcgcccatctctccggttgttccggtggttcttcaccgtacaaccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcacgcctccgacttccgagccagcccccggcgcaagcctccagctggcgggcgccggtagatctgggagacggctacaacgccgttcttgaccgcctggcaggtctgcgatcccaggggctcacgggggccatggtgttcggcgactaccttcgtcgccggatcgcgccgctccagcggtgcgcccggggcgcctgggagtacaccgggcccgaggacatcatgaggacccaccaggggcgtaaatgggactgggaccctgaggatttcaggatggtggtccaacgggtgctgaatctcagctccatggaggcatccctcatcccccaaggggtcctccccctctgctgcgatccagagcgcgccaacatcctgaccatcatgcaggaggtcggggcgtcgggggagcgggccccccgaggccacgatggcgcgggcgggagccgcaggggggaacaacctaccccaggagggggtcgtgcttctgggccccgtgataggggcccggggggcagccgccctgccgacgcccgggggaagaggaaacaggaggataccccctccccatctcctccccgagggggcggggcggtgcgtgccaacagcaggcgcccggagggtgctgtgccgacgtcgcagcccgagggggagcgaaaaaagaagcggctccgcaagatggggggggaccgaaccatgccgaggaaacctcatctccccccaaggtggtcgtttagccgacctcctcgcaggttcgtccccgcgcccactgcggcaagttttcattctcccatctcccaaggcaagttttcactcacccgtttttcgtcttctggtttttcttctgcctcagcgagatcccgtcgcgcccttcccgccattccaagtccggccggtctgaggccgaggagacggcgaccgcggaggcccggaggcggggagttgaccggcgagaagccgcagactgcctccgggaagccgaagaagctgcccaggaggcggtccgggctcgccaggctgaggaagccgcttgggaggaggccagactccgccgggccgaggagtccgtccgggagacggaggcggcgcgcgaacgccgggcggcctgccaagcccccgactcgactccgcccgaggcgacgacgacttccgaggccgcccacgacaaggccgcgggcgcgccgctcgggcccgacccttcgggcgatgcttggggcgagccagcttcggggaacgcccccgagtccggcacgtccatcggcgggccgagccgcgcggcgcccacaccgaggcggctctcccctctgccttccgctgccccactgagcgctgaacccctcctgcaggccttggccgctgcgaacaccacggtgttggacgggttaagcgcccagatggaggtcctgcaggcagagcgggcggaggtcgatgcggcgtgggcgcgcgtcgaagaggggcggcgctcggtggaagccatggtggaggcgggccgcaaggcacaccgccggcacgcctcagagctcgaggcccgtcgtagggacctggcagagatcgccagggaggtgaaggaggagcgggagactgccctcatcgccaccgccgtgttcaacgcggcgcgagacgacctctgcctccaatacgggagccgggcggcggagctagagaagaagctcgacgcgtcccggcagcgcgaagaggcccttgaggctcgcgccacggtgctggaggagcgcgcccgcgccctggacacgaaggaaagggaactggcgggtcgcgaggccgccgtcgccatccgggaggcaacgctggcggcgcacgaggccgcctgcgccgaagaggagtccgcactccgcctccgcgaggacgagctcactgggcgggagcgagctctcgaggaggccgaggccgcgacgcagcggcgggaggagcaggcgcgcctcaatctggaaggcgcccgcgccgagagggccgcactggatcagcgggccgctgaattcgaggcgcgggcgaaggagctggacgcgagagcgcgcagcggcggggcggccgcgggcgatggcgacctagccgcccgcctcgcagccaccgaacacactatcaccgagctgcagggcgcgctggactcgtccgccggggaggtcgaagccctccgcttggcgggcgaggtagggcccggcatgcttcgggacgccgtctcccgtctagaccgtgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggatggcgcacgcgcgagggtccgggacgccgccgaccacatcgtccacagcttcgagggtacggcccctcggctcgcgttcgcgctcgactccgacgaggagggcggtgacgacggtgcggacgacagcgacgacgaggccgacggcccgggggcgtcggagtgagcccccaggcccccgccaatcttaataacttttccttcttcttccgaggccttcgggcccccttcttgtataggctgatttaatttgtaatcaagtaaagaggaaatttctgcgtcaattaagtttgttgtgtgtatgagacgaggatggtctatgccgcggtccttctatgtcttggcttgaacgagggctcgtgcccaggtcccaaccttaagtggcgcgggtcggggctagtgcctggggagatccgcgtgtcgagactggccaggccgggagcgtggtgaccgagggttatggatgacccgattgtgggcctttgccgattcccacccggagatcaccacgccccggggcacggctcggttctgggccccgtttggcgattttagccggctcgggccaccgagggcagggtcgggcacgagcgtgctaattcaagccaagattcttcaaaagaaaacgatggcacagacacaatcctcaggaaatcgaaaatgcttttactgaaatacggaagagaaaaaagataaggatatgcatgtggtagcccccggccaaccctgcacgcccgggggggtacggggttggtccgagcccgaggcatgacacccgacccccactaggggtagaagcgacgaaggtgttcgatgttccacgggttaggcagctccgtgccgtttcccgtggccagccgaacggagcccggctgggggacgccgatcactcgatacggaccctcccacattggtgagagcttgctcagtccagcacgcgtttggacgcggcgtaggacgaggtcgtcgacgcagagtgatcgggcccggacgtgacgctaatggtagcgccgcaggctctgctggtagcgcgcggctcggagggccacgcgccgccttcgctcttccaagtagtcgaggtcgtctcggtgaagctgatcttgatcagcctcgcaatacatggtgacccgaggggaccttagggtgagctcagatgggaggaccgcctccgcgccgtagacaaggaagaaaggcatttccccggttgctcggcttggcgtggttcggttcgcccagagcaccgctggcagctcctcgatccacgagtcgccgtgcctcttgaggatgttgaaggtcttggttttaaggcccttgaggatttccgcgttggcgcgctccacttggccattgcttctggggtgggcgggggaggcgaagcatagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgactggataagcctcgggccacttagtgaacttgtcgacagcgacatacagatactcgaacccacccggggcccgcctgaacggacctagaatatcgagcccccagatagcaaacggccacgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaactaaggtgcgtgaggcgaagtgggctccgcactcgccttcatggatatcggccagaagctcgacaccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacgcctggatttcagtgatccaagcaatcaatctaggggagctgggagcgctccccttgggtcccgaggcctggactccgacgggcctcgggggccgttcaggcgcgtccgtctcccctagggggtcgggtcgcgccgacggctgggcaagcctttcttcaaaggcgtccgatggggtctgggctcgcgagtaagcgagccttgagagttcgtcggcgaccgcgttatcccgtctgggcacgtgccgaagctctatcccgtcgaaatggcgctccatacgccgcacctagcgcacgtaagcgtccatctgcgggtcagagcaccggtactccttacagacctggttaacgaccaactgggagtcgcctaacatcaggaggcggcggatcctcagtccagctgccactctgagtcccgcaaggagtccctcgtactccgccatattgttggtcgcccgaaagttgagacggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcggggacggagatgggctcaggggctggggtccactccgccacaaagtcggcgagggcctggctcttgatcgcgtggcgtggttcaaagcacaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccattagaatagcgtaaagcatcttctgggcctgagggtatcgggtcttggcgtcccggagggcctcactaacgaagtagacgggccgctgcacctatcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctagcaccgtcggacaagcaggcggagggccagctccggccatcgggggcctcgggccgccgttcggctcgggggcctctcctgcctgctctctcccaggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccctccaggtaaacggcccggagcatttgaggagcttaaataggggcagtgccttctctcccagcctcgatatgaaccgacttagggcggccatgcagccggttgacgcactgcacatccctaagcttgctgggggggtgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaatcaagtcatcaacataggcctcaacattgcgtcctatctggctacccaaagaaattcgagtagtacgttgaaaagtaggacccgcattctttaacccgaaaggcattgtcgtataacaataagttcctatgggggtaatgaaagcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaatgacgaccgggttcgccagccactccggatggatgacctcacggatgaatccggcctccagaagtcgcgtcacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgccgtccagaaaaccaccgattcgtgtggtcttggacgggccgtcgcccatggcaacctccttgaccgggacctcgtcgcacgtgatcatccgctgcctcggggcggctgggacggaggtgctgagcctctcgttgccaccctcgggcttggatgcggcggcgaggtggtccgcgcgctgctccatacaagcaagcgcgcctttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagtccacccgctctgtgcggaagttggcggaaccaccgagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctagtcgaaggtgagggcaacctccgaccaccgcgcccgccgtgtcgcctcatgggtaggggccgcggccagaagctctcgcttcatggccttgaagctccgacgagaagcgtgagcgcacgctcccccatcgacggtggcgatggtggccccaggctcctagaaccctaggtcatcgtcgccatcgtcgatgtcctcggctggggccttctgcttggcctcacttcgccggttgccggagggaagccgccggggcattgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggtgctccctgctgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgtcgccctgaccgagcggcggatccgggggcggccgaagctgccacaccggaaccggtggagttccaggtccaggcctcctccttgcgagccacatggtccgcgagctgaaaaagctccgcggtggtctggggctccttggaggcgatcttttcgagcatgcggttgtgccgcacgcctcccctgaacgcgtagattaccgcgtgtgcggggatgcatggtatggtgttgcggacttgacagaaccgctgaatatacgagcgaagagactcatcgtcccttcgctgtaccgcatgcaagtccgcttcttcacctgggcgcggatatgtgccttggaaattcatggtgaactgctggcacaaatcctcccaagagtggaccgacgcgggcggcaagttcattagccaaccccgcgcctgtcccttcagggccatggggaagaaattcgccatgaccctgtcgtcacccccggcggcctcgatcccggtcgtgtagacctggagaaactcggcggggttgacgcttccgtcatatttttcggtgatggtgggccggaaccttaggggccaacggacgttccgaaggctcgccacaaaggctcgacagccgacaccaccaaacgggggcatggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcttgacgagggaatggcagacgaacggcgggtaacggccgccgctcgccgcgccctccgcctcgacgacacggagccggcggtagcagcgccagaggccttggcggcggaggaccgcccaccggcgcctaggcgctgctgcgccgtcatgaccaagtcggccacgtcatccagccaacgtcgggctggagtctctggatcagggacgacgggcgggtgacgcaagagcgcgcccgcagcttggagcgcgccctggggcgtgctgccatcgccgtagacgaggaggcgacgctccccgtctcgccgtccttcttcatcgctcgtgggcggcgaagtcgcggatctttcgacccccttgagcgcctnnctccggctaagacttcggcaagagggggcggtggagtacgagctcgacggcgcgggttctgctccccgtcgtcaccgctagcgctcggagagaggttgtgcgccactgtccgttcggccattgggctgagccggagaagcttgacgcacacgaaagaggacgaggccttagaaaaacacacgcgccccctacctggcgcgccagatgacggagcgtggggctcctcaccgggagaccgcgcgggcccccctttgccggttcggccgggggcgctaggtgaggttctaagcccccgatctgaggattgtcagcgagaagaagcgcacaagacacgggcgacgtagacaggttcgggccgctgagaagcgtaataccctactcctgtgttctggtggatctgtgtgtgaaggagttacaaagagctggagagcaagagagttcaaactctagagaccctcttcctctttttctctcctctccgagctcccctcttctccaagtgggcaaggtcctccttttatatctcaaggggatcccacatgcaccacttctacctactcttcttttgggtggggactcaccctatctttccaaaaaagaaaaaactgacttgcgccttcgcctggaagctaaatcacagcttgtctttgagtgaggcccagcgtcatcactcgcctaacaacggggatcttcctggtactccctcattaatgggcggagatttgccatggctgttgttcgaatgaccctctgatgggataggccatacctac

SEQ ID NO: 74720 - DNA, 3576 bp, Oryza sativa
tctgcatgttcgcccctcttcatacaatgtcatgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagaaaagggcggccgtatcaccctcgggcccgacccccccccccccccgagggggttaggccacgtgggtgatcgtgtctgcctcaagtctctaagtcatgatactcccggtcccatgtgaaattttctttaaaaaaacatcatacggtaatttaggaaatgcatattaaggtggtgtttggatctagggactaatttttaagttcccatcgtatcgtatgttttgaaactaatttagagtattaaacatagattaataataaaactaattgcataaatgagagctaattagcgagacaaattttctaagcacaattaatctataattagcacatatttattatagcatcacataggctaatcatggattaattaggctcaatagatccgtctcgcgaattagtctagaattatgaaataagttttatcattaatctatatttaatacttctaatctaattaatatccaaacatccaatatgacatggacaaacagcccgattgaaaatcaatagtagacggcagccgtatataccgtctgggggtccccccattttctcccttttgtcctcccctttctccgtccggaggagccgaggagttgtcgtctgtccgtgggtctcgactccatcggtcttgcgcgctatctccgaggctccggcgacgcggctgggccttgtgcagcgacggccggctgctccgacgttagtccccggcgatcccatctctccgacggtttattttttttcctgcatctcttcaaacctctctaatgtttatttatgttcggtcgagtccaatgtactggagtaatgctttgagtttggttggaaaattcttgattcagttactgatgtagcaaaggatctcccgtttttaagtttggtgattgtgtgggttcaggtaagaaatggaagtggagaatttatagggcttttgttcgtctaatcccttatatatcccgtggagattggaggggattggggataataagccgttaccaggaaaaaaaaagagggttttttataattgaaatcctgcatcagccactatgatctgctagttgcatctccttttcaagcttaagctgattttgtgaattcgctatatatatggaaatggggattactgtggttgatgcaatatttttggcactcttgtagactgcagtggaattgctccgagagcagagctctccaggtctccatggatctggacaccacacgaaagcggccccgtgaaagtggcgtcgccgtcgatcggctcagcgcgttgccggactgcctcctccatgtcatcatgtccttcatgaaggccaggcaggtggtgcagacgtgcatgctgtccaagaggtgggagcacctctggcgcaccgtgccgtgcctcgatgtagatcatcgggagttccaaagcacaggtgaagctgcacagggcgacaatgaggtgtggcagaattttgaggattttgcggacaacctgatgcttcatcaccagattgcacacctggatacgttccagctgcatgttaataatgtgtatcgttggggtcaacatgcatctaggtggattcgtcgcagcatcaagtataacaccaaggttcctggcattcctcgcccgggattgagctgcagttcttggagcctcaaaagactacatctttctaacatttgtgtggatgatctgttcgcaaagcacattagctcaatgtgctgctctctggaggatttgaatctcaaaggatgcagatttgcattcaatgagatcacgtcccactcactgaagagcttggtgatcgacagctgcgacagcaagctttgtccttccaaactggttgtcacggctcctgccattgcctccctgtgccttattgtgaaattgtggtttttccccggcggtctcattgtaaatgaaatgccattcctttcgaaagcatccattcttgtttcagccacctacgacggaaagaacttccaacacaatcaaagcaagtttcttggtagcctctgtaatgtgacaactttagagctgtcaggttttcagacaatggtatgtattctgtcttcacagacttgcttcttctatacgtttaccttgtggtgccatttcagcattatatatttcagattatacctgaggaaccggttgagttaccagaattcaagaacctcaagatcttatcccttgacaagtgtgatcttagtgacaacttccagttattgaagcactttctgcagaactcgcctaatttggagaagctcacgttgcggctttgcgaggtattcatgctcttattttggccttaacattcttacataattaaatttggctcattattggacatcctttactatactgccaacagctgccaaaggattctaagaaaaggaaagggaaggccaaggcgaagaaaacacgtttggtggatatccggtgtgagaacctaaagcttactgaaatcatctacgatgctgatgatgtcctccaactggtcgggcttttgctgaacgattcagcaaatcttcctaagaacaacataaaactcagcaaagttgatcgttagtatggttagttcaggccctcttttgtgatgaccgattcttaggcctctcctgaattcacatgtcttgtctgtcttccgatgcactgtcagttgtgtagttgaaatgcacctatcttttgacttgtctaatcggtttaagactgctctgttctgttagctattgcatgtgttcttgcgcgctgtgatgctaggttaatgaagtgatagcgattgatacttatggctatgaacagaccaatttcttactatagagcatgttcaaaacgtatgatgatccatgctcctggttgcctagtacaatgtctacaatgagcacagcaaaagcacgtctctattgaaatttgctgtgccatgtttttttaggccttatacgtctctacagctaatatcatactatcaacaaaacgatttaataaacagcagatttatatgggtatagacgtataatggtgtttcatatcctaattcatggtgtgctctctcagcccctccattctgagatgcaagatgtttagattttgtcgtaagttgaacttatacttgatcatacagaatttttacaggtacctcaaggaactagtactacagggtacctgttgt

SEQ ID NO: 74721 - DNA, 8845 bp, Oryza sativa
cgattagccgataggtataggttgaacaatcggttgttggagacttggaacccagatgttgataacaattgcagactcgagtctcgggtgtgccaaaagcgtgtgtctgctgatagccgatagcttggtgtagaatcggttgaaggattcggtgccagtacttagcgctgaacgcctttggttgttgatgccaactgatgttaatgggactttggacgattacctgaaagcttgttgtagaattggatcggctggaagtccgatacaaatagattcaaatagttatataagaaatgaagcctttgctacaattggttaaaactaacttatgtataattattagcaaacctttctttatgaaagacaatcttgatagattggacttaaccaagatagtataaaattgaagtcgatatatatagatttatctaacaactacactaatctttataagccaatgtaacacttagaaccagtaaccagataacttatcgactagtactccgatgaaacataagcctaaaaactctcggcttaacaagacttagattatcagtagcaatctaaaagatcaaaactaactgagagagtatgagatataagcaaacgtgatagatataacaaatctatcttaaaatagcattatgtttaaagagacatcaacttgatcataatatcagaccgaaccgaggaagttctaagtcgatgttactctaaacaacaatgcaatcaaaagtagagacaatatatcagatagggaacacttgcttcggcccgaatagtatattggacctaactgaggaagtcctagtcacgccgttgtaagcgaaggtgatgtaacttacttctcgccggaggtcggacttaaccaacgtagcccatgctcgaaactaagaactcgccgggagtaaactagggtgacgatacgccgaaagttgtattgatcaactgatattttacaatgatctaggatgtacatgtttatacacccatgggtagatgagtgttcgaagcacccatgggtagatgagtggtcgaagcaacctcatcctaatgctattgaatgatgagtcttcgttgaatgatgacaatagatttatttttgatatttttgaggtggttcaaataatgtatggtaagtacattgaagaatcgacaggagtgggtctgtctttagacatgaggtgattgatcttgataaattggctgatcattggagaatataccatgactacttttcgaaagaacctatataccttcctctttattttagacgcaggtgcgtaatagtgaatactccctccgtcccataaaaaaccaacctagtatcagatgtgacacatactagtactatgaatctagatatacatatgtccagattcgtaatactagaatatgtcatatccggtcatagattcgttttttatgggacgaagggagtagtattttttcaatcttggtttgaattaccgacttgagtgcgcagtgccgttcaagtgcgcaacgcacgggaagtccgcaagtgcgtcggaacccgggtttcccttaccgtcggtaaccgtgcggttaccgggcttaccgcgggggtacggtaatataaataccgcagtaacctccttaaattcaaataaattttaaaaataatttaattttttgataaattttgcacggtttttcgcggtcaccgcgataaccgtgcttatcactggggcgcggtaaccccggccccgacggtttgggaaaccctggtcggaacacactattgcatcttcgtgccttcgggcttcatcggttcatccatggtccaactgggttcatccatggtccaactgaatcagcaacagccaacatgcaacagattacacatggaatcatagagtaaaggcagcaatcaggcatcagcagaagcagaagtgcagaacgacgggcgtcgccgtcggtcgacggcaacagcaagagaaacctgcgcggctcggacgaagtaattaatttgtttcgtttgatattatggaacggatgaagtaattgtatgcatgcatacatacaattaattaggacctcttctacattaaattagtacttttttaaatcctccatccttaagatgtctaattctattgaatgcatgtattatactctctccattccaaaatataagacacaaccaccctatatccaaagaccaaaaaacaattattatcacctctttgtttcaataatcccaactaatacaatacatgcacccagtagaattaagcatcttgatttaaaaaataataatctaggagagagaatttgcaattaattatcatgcatgcatgcacgccttatattatgaaacatctttaaaaagtagttgcgccctatattttagaacggatggagtatttattagggtgatctaaactaggagatgataataattgtttcttggtttttaggttaagggtggtagtgacttatatttttggaacggagggagtagcaaccggtactcacgaacatgcggactcgcgaagatataggaaaccaacaggtttgctagtggtagttggaaattaacgaagatcggaagatactatgatcatatgatcatatgcaacagtccggtccggttttgaagcctaatccagtacgtttcgctaccgaagctaaacaagatggaacagctagcgcgccgcgtaatactcagatccgatcgatcaaagcaacaactcacaacttcgcgcgcgcggcgcggctcggctgggggcgtccgccattgtcgtcgaccatggagatcgagggctcccgcaagcgcaagcgtactcccgccgccgccgccgccgccgaggaccggctgagcgagctgccggactgcctcctccacgacatcctgtcccacctcaaggcccggcaggtggtgcagacgtgcgtgctgtcgcggcggtggcgccacctctggcgctccgtgccgcgcctcgacgtcgactgcaaggatttctggtcgccgccgccggcgtcgacgcagcagcagcagcagcacgcggctctgttggcggcggagttcgccaggttcgaggacttcgccgacaacctcctgctccgccggagcgccgccgcgccgctggacgccctgcgcctgcgcgtcgacgagcgatgccagcgcaccacctacggcaggtgggtccgccgcgccatggtcatgcacgcgccggcggcgctcgaggtcgtccgccactacggcggcggcggcgccgcggcgccgctcttcgcggcgctgccgctgtccctgccctccggctgccaccgccgcctcacgaggctctgcctcgacggcgtcaccctccccgcggggttcgacgcgatgctcgcctcggggtcggggctccccgtcctggaggacctggagctcagggcagcccactacccgttcgcgcggatcgcctccgccacgctcaagaagctcgccgtcgagcgctgcggcggcggcggcgcgggctacctcaccagcgacgacggcggcgtggtcgtcatctccgccccgcgcctctcctcgctgcgcctcggcatctacctcgagcccaactggcccgccttcgccgtggaggggcccacgccgtccctcgtcgaagcatcgatccaagtcttccacgccaccgccattgatgcacatgcacctgagccgcagattacgcagaggatgagcttgctgaaatctctttgcaatctgcttgctggcatctcccacgtcagtagcctagagctgtcaggccttcatggactggtacgcgtcaaatccttcaattctcaatatatatagggagtggattctaatccctcgaggggatatcccctcgtatacctttttcttctaaattcgatgcaaatagttgtgaaaaaatctgaaaaaaattgacaatgtagagtataatgatacctattagtccaccaaaattcatgttcaaattcgatctacacatcgagaaacaaaaaagacaaatttagatataaacagtacactactattcatacgctgaatttgtcttttttatatctcgacgtgtgagttgagtttggacttaagattttgtgaagttgtatatatgtgttgtatgaatgttgtcaaatttttccagaatttttcataaccatttagatggtttttgagcaaacgagggaacatcccctcgagggattagaatagtttcccatatatatatatatatatatatatatatatatatatatatatatatatatatatatatatatatatatatatattcctctttccgttttatatttaattctttagttaaactttattaagtttgatcaagtttataaaaaaaattagcaacatctaaaatatcaaatcagtttcattaaaattaacataagatatactttgataatatatttattttgtattgaaaataccactatttttttctataaactctttcaaagttgaagaattttgactagggaaagagtaaaacgacttataatatgaaaatgagggagtacttcgttttgaaacatctgtgccaaaggagtatttcagaaatttcagaacaacattttttttgaattcttaacaaattttggtcaaatttaaatagatttctaccaaatttaaaaacaagaaggaaaattcgggaaaaatagtttcatgccaataccgaggatgcaaacatttacttctggcactgaaaccgaaccgtataaaataaaagagaaatgttactatccttgaggagatatcaaggagtatcatagtcgtatatcgtcctaaagagagatcggacattgagaggtgccgtatatagtatttcgtaaaatttggtgcctcaaggacataacaaagactctagagggattgttcctgttacattatcattgatttggtaattctgaactaattaactgttcctataattaactagctactcctggttttctgtatttcaggtgatgccattgcaaggagagggaaatgatccttacaatcaagcaccagcaggccagcactatcataatccagacaagaacctagctcagtattatcaagcattgcctcccatctttcagtatcaacaaccagttcagtattatgatataccaccactccatcctctctttccaccttataattaccagcatcctaattgggcggcgcaacaccgtcaacctatgcccctgttgcaaacaatgctggatgacaaccatggcggattgccggtgttctctaacctaacaaccatggtgcttcgcgagtgcaatatccatgtaaatgacagcatgaaaatgctgtggcgtttcctgcagaacacccctgcgctggagaagctcactcttcagaattgcaaggtaaacagcatgcaaacttttatttccttttagttaatttaccttgcaatatatgtatacatctttagaattttgactctattaatatttgctttggttttactaattaatatacatttgtcgttgccgaaaatagttctcaaatggtgctgatgttaggaaacatggtcctaagttgaagatctcttccagcttaaagtttgtggatatcatatacaaagatgtgaatcaccatgatggcgaagaagatgagtatgaagacgaagatgaagacaaagatgaacatcctgaggaagttaataaggttttgttcataatgtcaagaaaattgaaagatgttactgtcaaagttaagaaagtagatggatatcaatagtatttttagttgttttccgttgttgggaaaaaccattgtatttaatctatcgcgtacagtttgtctacttcgaaacttaatcgcttactatttttctcgcatgaatcatgaatggataatcacatatactgttcataatagcaaattaaaaccatttgtaacaagttgttttaatgatattcatagatttattagagtgagtagtatgtgagcgtggtggatccaacaatccaaccccaagtcatggatgtaaaattatactccctccgtttcaaaatgtttgacaccgttgactttttagcacatgtttaactgttcgtcttattaaaaaaatttatgaaatatgtaaaactatatatgtacatgaaagtatatctaacaatgaatcaaatgatatgaaaaaaataaataattacttaaattttttttgaataagacgaatggtcaaacatgtgataaaaagtcaacggtgtaaaatattttgaaacggatggagtagtattctactgtaatcaggcaatacgaattacgaagcgcactcgtttatgatccaaccatgggatacaaagctcctgaattcctgatgctaacgaatgcacagcttttgtagcttgatatctattgaatgaaattgacgtgtcgcccgtttgttaaaataaacttttacagcttgatcgttgggcccaaacaaagtgataagtcgtaaacacagagcaacaaaaaataatttatgaatattttttttcatttacggattagcaatttaaaagccagttctgaaaaataagctacgatatgaaaacctcaaaattatctttaaaatcaaaattcggttgcccatgggtttgtaattgagaaaaaaaaatccaagaccattagttttttttggacaaattaagaccatagtacctggtttgtgggcttaaattagattgggccggccgtgctgagaagcctgagatttggccaggcctgactggcgagaaggcccaatttcatgctgggcccactctctgcttcctgggtcgccctcctccgtgacgcaccttgactgcccccggtttttcctaatctccgatttaattaacttttatccccaattatatcccctccttttatctaatttcctttccttattttttttcctctctctctctctctctctctctctctcttttcccccacctcgctctctcctctcttcctcttcccccaatctccgacagttgccaaattcccttcccacccccaaacccaaaccccagcgacgacggcgacgacgcgcagcagacgaaagcgagcgagaggcgagagaaatcccatcgtttcccaaaccctaaccccctcctcctcctcctccagatctcggcggccgcgcggctgatgcgaggtgagccccgtccgccctagggtttgcggcggggtgcgtggtggtggtggttgggccgggggggacggggccctcctgctcgcgggggtgggggttgggtggggatggcggcggcgcgcgcgcacgtgaaggacccggcgcaccggaccaaggtggtgctccggaggctgccgccggcgatcgcgcagcaggccgtcgtggaacaggtcgacgcgcgcttcggcggccggtacgactggtcgtgcttccgccccggcaatgccaggtaacgcgcgattcctctcgccttgctccctccgtgtgcgtcgtgcgggtgcgtgcgtgcgtgcgtgcgtgtggttggggggcgtcgggggcacgtttggtctgtagctagggattgggttcgaagctgtttattagcctgcgaattgtgtacggggaggtaccaccccatgaaatttcgttagtagatttcattggctggttttgattgagtagctgtggccagcaattagcattctataatcgtgcaatttacagatacaagtttggactgtttgcctctatctagtgcatttggttatgtctagcaacaaataggttgctgtgatcaagtagttactgagttttaagtttgcaatcctaactgattgtgggccatttacagttctttcgcgttgttgtgatctcgaagcatagtggattgtgtacttcaaattgtagctaggatattttggaggtgtattttagtttattcttattagatttaatattagctgtgaccaaattattgcttggagatagtgcccaccttcttagttttgttgcataattttagctgtaagtgaactaaatgtgcttttgattgcagctagtataagtgaggtcaatatgttttttttttataaaaaaaattaccttaccttgccattttggctgctggagtaagaggttttgttctgtttgttcatttttatgcttctgtaggattgccttaagacatgctagttatagagaaaatttcctataagaaaacatgcacactgcaaaactacttggcagcattgagccttttttagtttgtgctgagtgatgtgcaacgtactgtggccattcgtatgtagctagtgattcaattgttatgtctgcaattcttaactcattgccgtggaagctaaatgatagtggcattctccacttcatttttattctcatttttctgacaatgttattgcttgtccagccaaaagaatcacagatattctcgactctaccttaacttcaagggcccagaagatgtcgttgaatttgctgaggtcttcaatggtcatgtgtttgtgaatgaaaagggtaactttcacatttatgtaccaacgtttctttttgccatgcaaatttatattcaggattcagaacttatattctgattatgtcaatgttgtcactatcaaaactagatacacatgtagcaatataagcagtgtggatctttgtacaaactaatagtgcaacatagagaatcagaatgaaattgcaattattgagcatttacatagtctttgaattggagattgatcttgtcgaataggattttgggactaaacagtaggttttgcatatttttccctattcaacttattgatgtctagtattatttttccctttttgattagtgcgcagcaaagaaaatattcaactgtaactatataaattccaatattatggaaatagtttaaattgag

SEQ ID NO: 74722 - DNA, 16249 bp, Oryza sativa
ctgcattaaatgcggcgtggggcgctcgtccaacccgcaataaacgcggttaggtgagcgccgttgtgctcacctaacccacacacgtggagccaaacccacagggggtcggggcgccccagccctcggggccgaaacgggagcggcccgacccctcggggagacagagggaggggcggccacatcaccctcgggcccgacccccccccccccccgagggggtcaggccacgtgggtgaccgcggctgccccaaacctctagccaagatacccccggtcccatgtcaccgacaccctctatcctagaaaatagctatttttagttatgtgtatgtatagccaaaagtagctatatattgagacatagagaagtatacaagttcgcaatgatattaataattaaggactaattaactgcttaacaagatctaatttctaactttaacgtttgttctatatttatttatacacaatcattatcctccaaaatcaaattataccaaatgacgcttcgaaaatgccaccaagaacattacccagagcgcatagagaagtgtcactttgcagcgaactgtatttactgtgatactaggccaaagaattgtgagaaagggtagtatatctgactattgaattcaagtccatatcatctatcacttgttgcaagttaattaccttgcaaaattgcttatattttaccacctatatatgatggcatcatattcaggagagagatgaaaaatggattaatgtgttatatggattaccgtgttatattaaaacaacaataaattagagagagataatataactaatgagaagaatatattagtatttgaaatggtaatgatgtttgtttttttaattatctctttcaacgcactttcctttggctagttttatgcaattgattagttggtttgaaagcataactaaaattgtggtaccagtaatgtccaagagtcctaagttacaatcattattatatctgaaattcctatgatggtgcaaaataaaaacatccctaaaatgctaaggcaagtttactagggagggaatacaacgaaagtaattaatagaaaaaaggttttgaactgataaaacttttgatttgcggacccagatatgcaagagggtacaaatcatcttattttagataaagttttgtcagtgttctagattccccatatatgtgaactaggctctgcggagcccaccatattctaaatcatgtaaagaatcaagtctcatatgtatggtaaaagtcctgagtacacaaggaaggagtgccggataaggaaagagaaatagagttctattctggtccgactagtatatcacagatcatgtcatgtacgaaatcaagcctcatatgtatggtaaagtctgtacacaagcgagaagtctcggataaagaaagagaaatagaatcctattctagctcgactagtactacatggataatatccatatttgcttccctagttatacttcgacatggggtacgtaactaagggtataaatacaagcttatgcaagcccaatacaagccaagagggatacaaagccacctccaatctcaccaagttcattctcatggaagccaataacagctagccatcgaccatatacctgagctttacgctaatatacatataatggtaaaactggctccggccaacaaaaatagagctattacccatcatcaggggcccgaacatgtataaaaatccttgtctctcttgctctctttataactttgtttgcattctcatatcagcgcatcccaacgtactctaaacaaatcatataggtacggatcctgtgatcggtgcataatccatcgacaagtttgaactctgaaaatcaacttattgtcaaatggagggaatatatatttgaatgcaacaaacaaattatgtttcttttactcttggaatgtcataaaatccccctcccaaaaaaaaagtgaaattagaaaaataccactactatttatgatatcggctacgtgtcactgaaatttagagaaattggaaccgtgccactcagtcgtgttttccatccacttttctgtcatacccgttaattctattcttgccggccacctccggcggcgagcgacggtgtgggaagcggcggaaggaaacggagatgagcaagagcgcaaggaagcgtttgtgcagggtgctcaactgccggaagctgttggacaaggcgtgcatgcacgcggcgcagaacgagctcctcctgctccgtatggtggtgcaggtgctcttcttaaagcacgcgcgtgcggcggcggtggcgggacggcacgctgcggccaccgagctgccgagcaatatcaaggcgctaccgcagtccaagacccaggtcgcgggaggacgacacggaccgcgtggacgagcagcggctccgcgtgctcgccgccggcgcgtcgccgggggacgactggagcgtggagggcctgcggcacacggcgtccaagatcgccacgctgcggatgaagctggaggaggacgaccacgacggcgccggtgatgacgacgaggagttcgtgcggaggcagcaggccgggctggtgcaaggatagaaattgacggagatgacagaaaagtggatggaaaataggacggagtgatacggttttaatttttctaaatttcagtggcacttagctaacattatgaatattagtggtattttttaaatttcgtatatttgtaatggtatgaatccaattaactttttttatgactctcaaattttccattcatcattctgagatgtcatcacaaaaaagtcgtcatccagattcccaagccaacatactactaatcaaatttagtgttcagttatttgaaacagactattgagccgatagttgctgcagactatttacttgattacggttttttgagattgctgacagatgtgctcatagtgaggaagctgttcgacgcaatgatggcaagggaaaggcacggaggacatagcattgagtaagaaagaagaccaagcacatgaaagaagccaggatagcctaggaaagaagaacaagaagcgcatggcagaatgggaggtactcgcagcaaatcgagaaccgcttcaaccctggcgaaacaaaagtcaaggagaggctcccggctaaaagtggcacctagctagtgtacaaaacaagctcgcactccttggccggctgccatgtctttcacccaaagatgaatcgccagatggcccatccaacggaccagcgagtacgagtcatcgagaacaaatatagcggccccccaagtcttcggatgatgaggatgaggatgactatcctaacgccaatcacagagtggcctatatcttatgaggatcaacatcctacatattcttcctcaagggagtaaaaaaggacgaacgcgatgtttgctccatctcccagggacaagtgacaaagcttctctggtcggatcagtgtggggtcacctagtttgagctcagtaccacaaatatctacacacgatcatctcggattttgatcacacacggattgatatccagaacagttttcgattatttatacaagtatgttttacatcaaactagctattagaattattaaaggtgcaaagatccaaactaagacaaccttcttcaaataaaaagattcaaatctactaaaaattccacaggcaatctcgagtgtagactaggcctagaaaaacttgtcaccgttgaagatttcatcactttctaaggcttcttcatagtattggtcttctatatgttaaattatgtaagagtgagaacttatctacccaacaaaacacaatataaccacgtgtataagagatatgaatagaagtatcttaagcatgcaaaaaaaatatattacctacatcatttttcactgctggggaaggccacattagtcccggttcacaaccccttttagtctcgattgtgcaacagggatacacaatccaggactaaagataagtatttaataacgggactaaaaatccatctttagtaccggtcagtaacacgaacgggtactaatgatttttttattttttttaattctttttattgcttgcgatttttttatgtaatacatatttatatagaagtatattatattcacggtagcgctacgtgaagcgctgcgctctacgcaacacggtggcgcgactcacagcgatgaggatctctgaatttttccttttttcctccaccgaccgcgttttttgtttctccccgcacctgccgtctccaggaccagagcacttcctccaacaggtctccacgtggcctccccaattcctttttcttggtcagtaaaaaatttcctgatcaaaatcacggttaggtcatcaaaaaaaaattcctgataaaaaacaggtttcgaccatcagtaaaaaagtgaaatcaggtttccaccatcagttaaaaaaaaatgagaacggccctgcagtaaaaattttactccccgagcacaattatacgagtacttgttaaggttagtaatatttttactctagtatatttataaatccctttctcaaggtggtcatagtagtatatttataaatcatcgccaatggatacaacccacctcaaggaaggaatggtcatggcggcggctccggaactatgccaccgctcgacgccaacagctggaccacgacacgcgatgccgctctccgccatcaccaacgactccgtgccatccttgagatttggcgattgcgtctactgtagatataaaaaaaggactgaaaaagagaaaaaatggttggatacggtgggatggctggccggagacggtataaatactactccctccatcctaaaatataacaacttttaggtttcaggatttgtcttaaaatataacaacttctccaccaacattctcttcccaaccactcacaaccctccaccatttacttttcccacctacctccactactcatccaatcacaaccctccaccattcacttctatctactttcttagggcctattcactttgatgtcattttcaactgtatcaaattttgataaagttgccaaaaaagtggctacatttagtttgctgctaaatttttgtaactatataagaaatcctgccaaaattttggtaacttattaaaattttagcaactatgccaaaattttggcaatgccaaaatttggtaaggttttttttcatcaaagtgaacaggcccttaataaccgtgtcaaactctaaaacattttatattctgggacggataaagtaacattttattatggtaaaaaattactacctttatcgtttgggtggacaaggacgcacagtgaccagagtcaagtgggattcgtatagcagtaaaaaaattactagcacgttagccggaccctgaggtgttacaaaccgcccgtcgctccaccgccgctgccgccgccggaacgagatcctctgacttagctcgttctaagtcagaggcgcacagtacgctgatgtgggtatttttaaccatccgatccgcagcgaacggacgagattgattgctacagtactttcctgaacagtaaccgtgaccggtatgttgctacagtactatatcggaggcactacagcgcatgactcagattactgtgcgcctctgacttagaacgtgtttaagtcagaggagccggttcatccgccgccaaatcccggatgggaagcactcccctctcccggcttctcccgaatgagtaaaaaagtatggatcatattatctgtagaatattagttatgtcagtaacaaaattgttttattaatcctttgtattattttaccttttattaatattttgtattcttttctccacattcatccggtagtagttcagtacaaataaaatttactgaacaatatacgtcactggatattttttttactgaaggatagttatacggtaactgaacagaaccatctgtatgccgaacaaaaaattgctgtgatagttaaaaatttactcctcaagtgttggtcgttcgatccatataggtgggaagcgggactctatgtgatagtaaaaaaattacccagataaatgaggagtgggtgggtgttgtgaggtgagctatttagttaaacagcacgtacgtagagtagttctatgctgtcgaaaggacaactgcgcacgtcgaaggacgtggttactcaatagtgttggaaacagtagatgtattaatttaatatttttcttaggatcccgcttatatgtccctagggggctatttataattctattacaggttcccccattagggtttaggttttataggggaatttacatggttgtctttatgaaagggacatttacatgggtacacagtgtaatttggatatatgggcctctaataggctaatgggcgaacattggcctaatggcaaacgggcctgatggttcgactggccccttgggcctccttgaagttggacttgttgtgacgaagtctccttccttcggcgtacacccttcgccatttactcttcgcccaaaatgcctttggtctcgcgggataccagcgcaactgttcggctttcgccgtctttgcttcatagtcttcgccatgagggcttcgcccaaatggacttgacgccttgagcttgaatcctcgctggttacatggtttcggcaggcctggtcggggggtctcacgacataccgccaacaagccccacacaggcaagggtgagataggagcttcggccgagatcgtgcaaaccatgtggtatggtaggaggcgccccccctttcgaccgacgctcctgccgaaacctatattggagtcctgcagaaaatgcgtataccttgtgcgtatgtatttttacggttagtgattattcttagttttcgccttttgcaaacggcgaagccatccttatttcttcctgtgggccgcaatgaacagcgacgggcttcccttcgtgggcctagcactgtgcggctcaatgaatgggaatttaccatttcgcctacccttgtgacacgtggcagcttacgatttggtgggaaggcgaatcgacgcctgggtgggttatatattcccccccccccccgttttcaccgccgcacccccgtcattttcaccgtgagctttctctttctccgcctctcacttcacagcgctcttgagtcaatagaccattccactgttcccctcttcgccaccgcccacacttttcgccatggcccctcgcaagccaaacccagcctccgcgataggccctgatcccagcaagatagatgacgacaccaccgcctatcttgggacttcgctcgtggacgaggatgagttggcgaagatggttacctccggcttgttggcggaaaatcaggccttcgccccgggaaaggctgtggtgccgaagcccagcgacaaccggacggtggtattcgccgtgttcttcgaggcgggacttcgttttccgtgcaacgtgctgtggctagagatcctttgcctttttcaggtggagctcccccaactgagcccatcggctctcgtccggatcgccatctttcactgggcgtgtcggaccgctaggttcgaaccgagagcggggctgttcgacgctattttttatgccaccgtaaattcgaaaacggtggtcacgcccgcagggatgaaaaagatagcgttcgggagcgtaaacttcaacgttcgtcccaagcactccgatctttggccggtcaacgccgccatgtccaagtgggaccgccactggatgtcgaagtggttctatcactccatccttttcgaggccgggtccgagtcagcgaaagctctccgatggcatcgcagggcgatcgcaccgaaccaaaagcccaaggtcaccgtcgacggcgccatagaagctcggtttgccttgcttcgcaaggtctgctcccgtcttagctgctgtgacctggtgaaagagttttgcatgcttcggatcttccctctctcctagacgtggcaagtcgaggtgagcccagacgaagaggtcgatggcttgacgagactcatcatgccagaaggggcgaacagtgagtctttgatttcctacatttatccgtgcttcgctctttcgtcctgttcggtgcttaatatgataacacgcttcgtttttgcagcgttaactcttgcccaggccgacactgaagctcggaagatgattggcgatgtgtcggtcgccgaatacagccagctgcttatgcggcaggcggccggccgggcgaaccggttgtacgacggcgaacttcctccccgggcgaagcccttcaaggccgatggggatgaagggacttctagaaaatggatgcgcgggcaagtcaaacttgctcctcggaagcaaaaggcccctgccgccaccgactctgacgccgatgactaagacactgccgacgacaatgatggcgaaggggaaggggaggatgaggaggaggtagaggttgcggtctaaacggccgtggacgtgcccaccgacaactgcactgagacgcacggctacaccccaactccaagccccgaccatgccgaaatcggggtggagtcgaacagctcccccctccgcctcaaggatttggagggggcgaagacgctggtctcgattgcagcggccagggtggcgaaggggggttcagttaagaagacctccaaaaagaaagggctcgtcgatgtcgctcgcatctttagcgatgatgagtcctcggatgggacccctacttcgcccgctagtcggagtctgggtctttcgaccgctcctggtgctgcggcagacgcgggcgaaacgggcggtagcactgcagccgggacttcagcttctgctgaccgggttgtgaagtccgcggccaggcttttcggaagccctgtgcgcaaaccggtggcttcgccgctcgccatccaaaaggggaagaaaacggtcgccgaaacatcggtttcagactattctcttgcggcgccccgcttcgcccctgctgatttcgagacttgagcggatctcatccccttcatcgagggggtaagcaatcttgtttctccggctggcagcccaagcctgttcaccgagttgaacgagttcgacgaaggctgttccgccatcaagagcttggcagtccgggtacgtcgttcgtttttccttctttttactcgtcgtttttcgacaacttatgttaacgatcaccctcttttcttttgaactagattcttgtggcccattgttctactgagtgaaccatacgggctcgccttgacggcttcaaataccgtcttcgagctaaagacgacgaattaggccgcaagaacctggagatggagggcctcgccaacacgctcaaggagacgaaggctgggaacaaacggctccaagttgaggtcgagaaggggagcgaggcaaaggccgagatcaagcgtctcaaggccgaactcaaaaaggagaaagaacattccgccgctcttaccgactactataatctcaccgagccgaagatcgaggctcttcgtgaagaggtcagcaagttagaggcgaccgctgagagagacgcacagcggttcgcgcaggaaatggcgaaagccactgaatccgccaagaccgcttgctgtacacttcgccttgccctcactgacatggggggcaaaggtgcgaggagtccctagcgaagatgcctccgcttttgacttctcggagtggactcaacaggccggccttgcggtctctgattgcgtcaccgcgtacggcgattgttgtgcacgtgtgtcggcggctttcaccatgggactgctgcaacagttcgggagcgagcacatcgccgagtttccaaattttgcgaagggggactgggaggtcagttctcaggatgtttcgcctgcactccatgcctggcgtaagtagttctggcaaaaggatggccgatctactgccaaggcgcgtctgcttgagcacttggcgaaggcagaggcagcggatcaggccgaagagcctgcggccaaagagtgtggaggagatgcaggagccagggtggacatcggccaagatcacccagaggtgtgaggccctccgcccgctttttagattttgtagatttcttttggcattttccgtggagggcgaacaatgtaaatttggccaatggccctcctcctttcatattgtagccgaaaacggcgtttttaatatatgaaatagatgtcccaagcttagctaactattatgcttgatgcctttggtacatattcttgcatcgtttcgcatacgaaatggagggttacgcttttcttccactctatgtgttttttctagttttaactttgcactttgccatttgccctttctatactgtcttagcagggtcttcgccgaaaattgtgttcggccctcctttgggaattggcgaagtaaaaatgaaaagtttgtggcggtgaagggtttgccgaaggtccggtgtccatttcggcctgtttaccgcgagatggtcataaacggcaatagttacaaggttttaaaagttgccggctggatgcggacgcaccccgggtggaccctggacgactacgactgtgtccatgtggaacgtcgagaggatatgattcgcttttggcgaaaccattagaggaccgatcgtcaggaagcgattgcccagcgtcgttatagtatagtttgtgtttcgcccccttctcctcttagggtagtgtataatgttagtagtgatgacgagccaagtttgccaaatcacaccttagggagtggtgggtgttttgggggcgaagatgtatttttttgtaagctaggctgtaaagcccgttattttctttcacctgtaccatgttgtatggcatgtattcttcgatatcttttgaagttaataaagatgtgttttgtttcctttccgctattgttcgcatagtcacctttcgtgctttcgttaggtcgaaacatgtcggcccccttgcatatattagcgaaataggtctactgacttttcagttttcgacttccgctttcgatctgtggtattctgtgcagaaagaagcgtttgtgttttcacatagatcgagtataacggtgttcggttatttattccccgaaacaagctgtcgtggtttcaacgttcgacgagcgatgcttcggccgattcatttcgcccccctggcgttttcgctgatcaggcgtttgccttggggtttttccacgaattatcattcacacaagtaaaaaaggcgaaagacacaagaattttatactggttcgggcgtccaggatagataatagccctacatccagttttctttttttttccttttcctcttttttttgtatttttgtgccgtagggcttacataacaagagatgccaaaaggcctatacaatagtatttacatttttacaagttggcaaatggggtgccaccccttctagacatagaaacgcttaagagaagcagcgttccagcagtggtcgaactcttcaccttccaatgtcgccaagcgaaaagagcccgtcctggacctgtgcttgatgaggtatggcccttcccattttgattcaagctttccgaccgccactgggttcgccttcttccttaggacgagatggccaggcaatagcttcgccagtcgaacttttttgttgtaagttgtcgaggtgcttgtggcgtatttacgcatgtgttccagtgcttcgactctcaccccttcgaggagttcgagcgacacctcgcgcccatcttcgcctctagagaacattacccttcgcgaattagcccctatctctgttggggtcattgcttcgtcaccatagagaagcatgaacggcctgaacttggttggccttgtgggtgtcgtccgaagggcccagagaatggatagcatttcgtctggccatttacccttcgccgccccctcaagccttttcttgagcgcctccaggatcttgtcgtttgtacgttcggccgtcccattcgactgtgggtgcgccaccgaggtgaacctgatttccaggtttagccctttgcacatctctctgaacttgtcggagtcgaattgcttaccattgtcagtgataaattcctttggcactccgaaacggcaaacaatgtttttccatacaaatttctgtactgctgccgaagtgattgccccaagcggttcagcttcgatccaacgggagaagtattcgattgctacaattgtaaacttgtacccatttcgtgctaccgggaaagggctgatgatgtctaacccccatctggcgaaaggctagactggtgcgataggttgcagctcataatgggatgctgcttggcttcggctataccgctgacagctttcgtacttcttagcttgctcaacacaaactttcagcacggtgggccaatacaccccctggtgaaacactttggaagcaaccgttcttgcggcttgatgagcaccgcacagccccttgtgtatttctttcgccatttcctcgccttcggcaaaggagatgcagtgaagcaggggttggagcaccccggtgcgatacagctgccctgagaccaacttgtatcttgcggctctgagttgtaggcgcttcgcttctgcttcgtcctccgggagccaaccgttcttgaggtactttatgaacggtgtttgccagtcttcagggtcttcgcccagttctgcctggtcgattgccatgatgtccaggctctctgtgggcacaattggtgtgtacaagacttcaaagatgatgcctggcgaatgtgggcctccacaagcagcggatttcgctagggcgtctgcttccttgttctggcctctaggtaagtgttagaccgttatgccggtgaaacacttttccatagatcgaacaacctccagatacctcttcattccttcttcttttggttcaaaagatttgtcaacatgacttgcctccagcttggagtctgttcggatgagcaagcgtcgaacccccactgctttcgcctttcttaggcccaacagtacagcttcgtattctgccgtgttgttggtcgtgtcgaactgcagccttgcagcgtaccgaatcggcacgccccctggcggagcgacaactgctacggcgctcgcccccttgtgcgaccacgagccgtccgagtacatcacccaaggttgtttggcaggctcgggtttaggggcgaatgctggcgtccattcggccacaaagtcggctaggatttgggacttgatggcagtacgggcgacaaaatgcaggtcgaagggagataactccgccgcccacttgctgagccggccagtaatttccttgccccggagcacttcgcccaaaggatactgtaatggcacagtgactttgtgggcctgaaagtagtgtttaagcttgcgcgaagccatcactagggcgtaagcaagcttttccatttcaatgtatcttattttcgccccttgcaaagcttcggagacgaaatacactggtttctggcctgactctgtctcttggatgaggattgcattgaccgccactggcgaagctgctagatagagtagcagatcgcttcccggtgctgggctgaccaaatcgggtgggctttgcagatattgcttcagctcgtcgaacgctgcttggcattcgggtgtccagctaaactttcccgcgccccggagggtcttgaagaagggcaaacctctttcggctgctgttgagaggaatcgacagagcgccgcaattcggcctgcgagcttttgtacttcgcgtacgctcgataggggcttcatttgctgaatggcatcgattttctcggggttcgcctcgatacccctttcagaaacaagaaaacccaacaacttgcccgcgcgaacaccaaaaacacacttctcagggtttagcttcatacccgccgtgcgtaagttgtcgaaggtcttctataagtcggacacatggttgaaagccttgcggctttttacgatgatatcgtccacataggcctctacatttcaccccaactgcttgtaaaggaccttgcacaccagcttggcgaaggttgctccggtgttcctcagaccgaaaggcatcctgaggtggcaaaaagtgccgaacggcgtgatgaagactgtcttggggatgtcggccggattcatgtggatctggtgatagccggagtacgcatccaaaaagctcatgagttcgcagccagctgtcgaatcaacaagctggtcgatccgcgacaggggggagtcgtctttcaggcacaccttgttgaggtctgtgaaatcgacgcacaagcgccatttgccgttcgacttccacaccaatatggggttcgccaaccactcggggtggtcgatctctcggaccaccccggccttgatcagcttttgcacttcggcttttgctgcctcttggagatcagcggacatcttgcgcagcttctgtttccttggcctggcatccggcttgacagccagatgatgcatgatgaggtccgtcgaaacacctcccacttcgtcggggccccaggcgaagatgtcaatgttctttttgagcaccttcaggatgttctcggcttccctttcacccaggtcgccccctagcagaacaaattttgtgggatcgacgtcgtcgatctgcatcttgaccaccttgccatggggggcaggcttcggcatgtgctttgcacggtcgtgcggttcggcctcaacattgtgcactgccctgttaattgcggccaaatcgccctttgatgtagccgaaggttgaagccccttgatcatgatcacgcctgccggaccaggcatcttgagtttgaggtagttgtggtgggagatggcttcgaacttgtttaaggttgcgcggccaaagatggcgttgtagttgtatgggatgtcgacgatgtcaaagagtatttgctcttcgcgcctattctcatctgtgccgaaagccaccgccagctgtacttggcccaggacttgaactgcttcgccgccgaaaccacgaagggaggttggtgcttgagtgagggctagggttggcaaccccattttggcataagcttcggcgaagatgacattggccgaactgcctccgtcgaccaggatttgccgaacttcaaagccagctacctcggccgagatcaccaagggttcttgatgcgggaatagcactccttcggcatcttccggtccgaaagaaatttgctgattcaagtaccgtggagccccatcgctcgccgaagcgatgttgtgcaccgttcgcagctgcatcttcttttgtcattttgacggttgagctggcggatcggctcttgtaatcacttggattactctgtgcatgtcttggcgctgttcggccgggggtgcttgttcttgaacagcctcgcgaggtgcttcgacaggtgctccttgttgtgacattggatcttgagcattgccgcgttgccaaatgtttcggcattgttcggtggtgtgcgaagagcatccatgataggcgcagtagaggtcttttctaaccttcttgcgaacaggctggtgatggctgcttgcttgttgggcgtcgaactccttgcggagggcttgtacttcttcaacggccatcactgccttgcccgcactggggtgggattggacgactcttgattcccctgctcagcggtagccccttttcgcccccctgccttgttcggcaccagctgtggatacggcgtggtgaagggcaaagtcatggcttgcgcatgaggttgggtcacagcattcggttgcccggctccgaacggcgatgcttggggggccgccatggattggtcgaatgtaggctgggtccatgccatggtgacctggttcggcgcttgattcgttccgaagcctggtgtcgttgcctgtggtcgaatggttggtgattgagtggcagtatttgggtcgaactgcagtccttgagtccacgacaaagcccctggattgggctggttcgacggtagccaactaggtgcaccttgactcatattcccttctggctgggccgaaagagttgcacttgaggtattgtggggttggttgagttgctggaggaaagcttgaaactgcgcttgcaaggctgaggtcccttccgtccttgcttgtggcgcctgaacaggtaccgatgggtgtgcttgggcagcgaccggccgaacttgtgcttgtacgtgaggggtccggtgcgtggttgcggccgaaggctgcccggtgaaccatgttggtacttgcatgacttgctgcgatgagg

SEQ ID NO: 74723 - DNA, 798 bp, Oryza sativa
aatatatcacagtagaaattgataacctaacttgcattttggaggctggagaccatcctacaaacaccaccttttgttactatttattggttactgatgtatgttattgctattctttcttatacacttcatagcattttaacattttcagatgcctattttcagcatgctggtataattgacattcatgttaagttattttcttatttttggtattcaagttaaaaaagaggttgacttttgatggttgcaagcaagcactgcttataatgtgatatattttaggtcggaacataagttaatacttttaatgtaatcaaggtgttgagttttccttcaacagtcgagcacatgcttgtaaatttaattttggactatgcttttttgttttaaattttattgtcatgcatgcggcctatggttcctgtcaggtgctcaatttaaagctcttgtggaatatgcaccatcgcaacaggtccccaagtcaaacacgaagaaagatgctcgtcaaggaactataatgaaaggtcctagacaatcatttaatctcattctccatcctgtaggtgacacaatttcatatttatcattacttcaaacttagctggcatcttttttgggatttaatatccagatccggaatacttggagtttcttgaatcgatttcaaagcctgctgagcatctgccaagtgctgaaattcagctcgaaaggaaagaagctgaaagggcaggtaaagtattgtttgtaatatcagattataattatgcctttcaaagatgccaaggggctgcagga

SEQ ID NO: 74724 - DNA, 1364 bp, Oryza sativa
cttttgtttataaccagactgagccacaaactaagccttagccactagacatgtggaagtacggtagtgctttgcaacagaggcccgaagactggtccttttatggccgaggtgctactatcaaaaccatgcaccccgagcccagcctaaaaccattttgagggttttgaatagagggggaggtgtgaatccaattcccaataatccatccattccatagtgtccaggtgatgagaatattcccaaagtctagagttgtaaaaccacctaatgttgcctaattaaccagcgaagcatctacctaaattcatactagtggtaccatgagtagagtgtccactagttggggttttgtttattctagggtgaacaaggtaataataacaataacaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctatacgaccaacagaaatgaaaagggtttttactctaataaactccatataacaagtaggaacaaagcacaaaaatgggttcttgacttcttaaggaaaaattagagacttgaacggtccaattccgagttcaaatggccaagttatggccatttaaagtttatatgctctttaaatgaatatttgcgaatttcttcatttaaaatttaatttaaaaaggggtttattgcgtcagccgaggggaaggggcacgcggaccgggtccacaggagtggggcccatgcggcagcctcacggtccacggtggaccaggtgcacccgggctcacaccggccggcgtcgtgggtaacacgcatcagccgcacccgagggcgcgggcggctgatgaccgggccccacgcggcagccactcggcccgcccgaaggcggccactcggcgcggccggcgggaggcggtgcccgcgcccctattgtcaccgacggcggccataggcacggcggagcggcggccgagagaggggaagggaagggggaaaagaggcggcggtccacggctcaccctaggtcgacggcgacgacgaaaaaggcggccggagcggaggaaggcggcggcgcggctcgggtcgacggggtcgacgacgttccggcggtcggcgaactcggcaagggggtggacggggtcgacggcggtgcggcgaagccggaggaggcgacgccggggcgggagacggtcccggcgagcggagaaggccggcc

SEQ ID NO: 74725 - DNA, 9306 bp, Oryza sativa
aaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtcccaggaggcaaggtacaccaaaagttgatacatttcagagtttatcaagaggaagcgtaaataattaatttattacatgggcggcgaaggcccagcacacacaaagacaaacgggaaacagcggaagactagggcgactaccacaggtgcttgacggcaggcacgagctagacaccaaaaccttcatcttctaggaactcctcttctgggtttgggaaaaattgagcaagactgagtacaaccaccgtactcagcaagacatacccacaagtgcagaataaatgcaagggagtacaagggagccataatatagggggttagggattgcagtaaacagcattaaaagtcacttagttgctccaacctactttgtaaacacagtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacaataacttgggtacattgctaggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccaacctagccatagacgagagtaccgacccaacccctcctacggccggaacctccgggacaggtaggcaggactgagcccctagcagcaggacactggccctgtgccatgacatcttgactaccgggccgcagctcgtgtagccttcatttgccctagagatgtccatcgacccccgacttcgtccatctccatccgtgtacttttgtttataaccagactgagccacaaactaagccttacccactagatatgtggaagtacggtagtgctttgcaacagaggcccgaagaccggtccttatatggccgaggtgctactatcaaaaccatgcaccccgagtccagcctaaaaccattttgagggttttgaatagagggggaggtgtgaatccaattccgaataatccatccattccatagtgtccaggtgatgagaatattcccgaaatctagagttgtaaaaccacctaatgttacctaattaaccagcgaagcatctacctaaattcatactagtggtaccatgagtagagtgtcaactagctggggttttctttaatctagggtgaacaaggtaataatatcaataacaatagtaataaggtcataacaaaggtaaataggcatggctaaataaaacagtgataacgcgggaatttaaataaagcgataatgcaataatttaaatcaaaataattttataaactgggatttaatatgttcaaggatcatgtgacttgccttactcactttcccaaacatcggcttcaacctccacgaagagcggatcttccgaagctgcagcgtctacacgaccaacggaaaagaaaaggcttttactctaataaactccatataacaagcaggaacaaagcacaaaaatggattcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggaagggggcgcggaccgggtccatgggagtggggcccacgaggcagcctcacggtccacggtggatcgggtgcacccgggctcacaccggccggcgccgtgggtcccacgcgtcacccgcacccgtgggcgcgggcggctgacgaccgggccccacgcggcagccactcggcccgcccgaaggcggccacttggcgcggccggcgggaggcggcgcccgcgcccctatggacgccggcggcggccataatcacggtggagcggcggccgagagaggggaagggaagggggaaaagaggcagcggtccacggctcaccctaggtcgacggcgacgacgaaaaaggcggccggagcggaggaaggcggcggcgcggctcgggtcgacggggtcgacggcgttccggcggtcggcgaactcggcgagggggtggacggggtcgacggcggcgacggaggaaggagagagcgacggcgcgagctcgattccggcgaggaggaagggcggcgagtggcggaaacggacagaggaggtgcggggagggtttaaatagggttggaagggggagagagcggccggaggggaagcaaaccggcgcgggaggtcggccgccatcaatggcgctgccgagatttgcgggggcaaatccgcccgtttgaacacaagagagagagggaaaaatggggggaaagggagaggggatcacggggagtgatttcccccactttattgcacgcggggacggcgggatgcggcggatttggcggcggcggcggcgcttggcgcaggcggagcggcgggaggatggggatgacgggtgggccccacccgtcagcgagggtggcgggcgggcccgcccgtcagcggcgcgcgcgcggggagaggctgagtgggccgcggggagaggagagagagagagggggggaggagagatgggccggcccggcccaagggagggaagggggacttttaaggtttttctttttataaaactttttcaactttgtttatttcttagtaattattatttgtgctctgaaaattccactaaaatttatttacaccttttaggcttttaggaaaaatacaaaaatcccctaagccttatttgacttttaactttgcacattttaattgttggaggctttcacacggattttaattattctaggcataatttaaaggatatattttagagtcgttttgggacatgacaccttgcttgttagattggtctacgtttcgtatatttcatctgtgctaatattgtagtataaagtggtatcggagtaatagtcgatacacgttaggtttgctcaatcggctatgctgtgagcatacataatccctactttgaagcacatttagatattaagtgatttatactgtctcggcatatcgcccgatctatcccaatcacttgatccaaatgtgctttcattggatagattgcgtactgctgacgtctacagccgattgggtagatctaataatttctatgccttatattcccttgctgatctgatgcaagtaacatcggcttggctccgaacaatacgttatcggcaatccagccgatcggctatcgttgatggatttaactttgttcctttttctttcttgctggttgcaggatcaaaccaactagcgcgctcggaacccgaaagcaattttggacctgcgctagagttaagcagatctctcaggccagtacgtgtgttttccgcatcaacacactttttggcatgcccggtgggaccgactttcgtaaaattttcttcatggcaagcctcaagtagagagaagttgatccagaaaatgtcatcccaataacaatggacaagctgaccctggagcagaaggcagaatttgaaaagatgagagatgacttgcaaaacgattcctgcattcattcgcacagactcgttccgacaccatggtccagaaatataaggtagttctgtcgaacaacgatgacgcggaaacaagttctggcaaagacgacaaagccaagggcaacaatcaggaggaagatctcgaggcgctcagatgtatgcaagaccaggttgattatgccgttcatcatgctttggtcaaccaatcaggagtacttgtcaacatgttgaccaacatgatcaaatatgtggttgacggcacgatagctgagcatcaagccaaaggtccagtttttctgcctggagggtttttccaaactacaaaactgtcagcatggacaggcatcaacccatctcgagtgccgccccagaacagccgatggcttcagttgtgccccctgggggcaaggtccatcaacatcggcacaagggcagccaggattcaatccttacgttctgatcaggccacaaccgcaacatgcagggcataacatccctcggatctctccagaacaagtcgcatctatgttcagaccaagacagccgatagttgagacgattccgcaaataaccatgggacaactttcgcctatcccacaacaacagccaactatcggcacctagtttaaccctgatcaacacatcgtacaccaaactcctcaacctcacctaaggggcaaccttaattttcagtaccagccccactcacctcagatacagtatcggctaggaggagcgcctcagccccagtacctgcctcaatacaaccaactggatcaggtgccgcagtagatccagggagcacctcagcagaagccttgggcagatatgatagccaatgtgatgagggaacaattcgggcacaagcctaaggatagtgagaacttgtatcggcatccatacccagaatattttgagagagtaccattatcgaacaggtataaggtcccagatttctcgaagttctcaggacaggacaatgtgacaacatatgaacatgtcagctgattcttagtccagtgcagggagtcatcagctaccgatgctttaagggtcagattgtttcctctgtctctgtcaagattggccttcacgtggttttcatcattgccatataattttgtacaaagttgggccgatctggagaaacagttccataagtacttttatagcagttccataagtacttttatagcgggattcattagatgaagttgtccgatttaacgtcaatcaaacagaagcatgacaaatcggttcaagattatatccagagattcagagatatgaggaacaggtgctttagtttggctttaacagattcccagcttgccgatctcgctttccaaggcctactggtgccaatcaaggagaagttctcagcccaggaattcgagagtctagctcacctagctcagaaggtgacggcacacgagcaaaggtttcttgaggctagaaaggcatataaaaaggtgaacaatgttagcacatatgtctctgaaaccgaagaggatgaggaccctgaggtagcaatagctgaatgggcaaggaacaaatgagtggtcacgtgccaatgggtcaaggactctggaaaggaggaaaaaattgatttcgacatcaccaaagacgataggatcttcgatttattgcttcgggagaaacaaatccaccttcctgctggtcatgtaattccatctgctacagagctagggaagagaaaatactgcaagtggcataacacaaggtctcacaacaccaatgagtgcacagtcttcaggcagcagatccaatccgccattgagcagggaagaatcaagttcgacgacccaaagaaatccatggagatcgacggcaatccttttcctgtcacaatggtccacacaagcgaggggatagccaatagaagaagctatcggcccaatgccgctatgatcatcagcaaatatcaagggaagcttgagaggcagaaagaggagtgttacaaagacaacaacaatttcgatcctcattgggactacaaattctttagattctactaaaacgaagggatgaggttaccctcgaaggaaggttgcccgtgatgcagtgatgccgacgaaaaccacgtcggtagttcaagccaatttcgtcccggaaaggaaaatcggtcggtgcagaagaagctgcctgttgatcagagattgggacttgctagccgattggtttctattggattatattgctatactatattatcatcagctgattgccttcatatcattatatacattggacatatagccgattgctcaaaaccctatcgccatcggctggtatcggcatcggctggaattactccatgggcttgtcaactgatcggctcattgatctgctatttgcatatcttgtcagttgcaggatcaaactgactggcacgcccacatctcaccaaactttggacctgcactggagctaagcagatctcccaggccagtgtgtgtttttcgcgtcaacaggttgttaacgattatagagtgttttattgagtagttcagctactagcttggtggtatcagtgattagtagcttttttttgagagttttattaagtttgtttctaaaccatgtagatgaaataacagaattggaacttgtttggtcaagtatatcagttattaattctatgacaccagaaaattacattgtttcatcgcatttaaaggctacaggtatttttcttttttacggagtgatcaaaccggatcaagggataaactactgcaaattatatcttctcgccctagtggacttctttatggagtgaactatatcaaatgttttgcttttgatgctgatctaattagtctgctgatcgttacggagatgttggtcatttccaactcttaatcttgctaatttttttccttcttttgctccttgataggctcgcttggcaaggaatctcccccacaaaattcagaaaagaggagggactgcataatcaggtactgcatactccccctcacagcttcagtaatgcttgcatgaaaaagttattaaaacaggctctctcaaaacaaaattcatttctttgccagttactaagcttaccgtctttaacaactgagaattgctttattaaagaaaaatcaaagtaaatatgagtgatcttgagtgttgtaaatttgatggtataacagcatagaagcacatggattttatgctgctatgttgctgtaacacaagtttgccaaacatttatgcagcatctccatgttctatctagtagtggtttattttgtgtacaacagtgagatattactcccaatgaaatttctacagatttttataaacatattgaaatatgatccattctctaaaaatatgaatgatttgcactatatcatgtaataatctagctcataatgtattacttactttgttgtattttaatcatgaatgatttgcactacgatatttccacatttggttgattaagtatctgccaatcaattgccattcatcctttttattttctgggagcaattttaccatcattttttgcattgcacctttgactgatatttctaagcattgctatttccttttgagtacctcgacaaacagagttgagcccattgtatatcctataactgattaatgcttgtaggtatggatctatttgagcttcaacaaagccctatcagaattttgacatttcctgtgcatgtcaaaggttctgaatagatacacttcaccatttccttttattgcaggataacatttttagctattgttttcggttaattttcaacatatatagattcatctaggttgacattgacgatcagcgattgtgccaactttattcagttaaaacctgatctagccatttgcagttgtgcaactgccgttgataattttttttccttcttggtatagtcacatcattagtttgttgtatatgcatgtaggcacttattatttatcatgtgcagattttatccattggcataagttatactaatatctgttgttttatcctttgtgttcacaaaattctgtattgttgaagatca

SEQ ID NO: 74726 - DNA, 19831 bp, Oryza sativa
aggactaaagatctcggggggcctgacaaggcctgacagatttagaaccgggactaaagatcatttttagtcccggttggtaacaccaaccgggactaaagatcaaatatgcccgctgtagccaccaaccgggacttaagatcatttttagtcccggtttttagtggaactaagattattgtggatttcgggcgaccgaccaaagacggtttctccaccagtgatgataactataacacaattcgtcttgttgtttataatgcacattcttccatctagcaacaactgtggtttagctgtcctccatctaattgacccccttgtgattttaaaagaaaaaattgataccaaatgtttgcccccgaagcttctatgcccatttgcgggagatttacttcgatccagcaaaaaatatatcgaggtacgatcctcatggtattaaatcgtttccgatccttaaatccagctgggcagaatggcattgttagatccaacaattggaaacaatttggtatcgcgagatatttgtacctcgagatactttttgttggaccggagcaaatctccatttgcttatatgccaaaccatggagatacagacaattcatcactgatctgccagggttgaaaacaaggaattccagttcgatctacggtgtttgtatccctccacatccattcatatacaatagccagtgtcttcgtcgtatacgtggatattgtctgccgtttacgtccgttgccttcttattcaattccatccattttattttctctgaccaattggctcaattggctagccaattggaacatggccttaggtgctatgttaagattgacgagaggacccaaagagttcacgagggtcagtctttcggccagggacaaaacttcttcgttttttatctctgcaataattgttatttaatgttaacttgtttcaattgcaaagagagagggtgacattttcttttaagaggcaaaagctttgtcattttatattgatagataagagtaaagtcataacaagctaagtactacctccttgtacaaatgtttgacgttggctagtacaattttgagctaacaaattaaacgtcaaacgaaaaagaatggatggagtaatatttatagggcgaaatcgaggtaggacactactctccacagggaatggtctctgtaagcctaacagctctcgtcatgatccaggttctcgcctcctccttgattttggccacgatcatggctggcgttgtggctaggcgccgaaaaattctggcattacgctcgcaccagagctcccaagtcacgaggatgatcaccaactttaacgctttccgcatgacgtatggcgtgtttgaaactttgtaccaccaatcttcttcattggcgtaggctttccatttgtttatgcggagatcgatttttgtccaactctgtagtgtgctccagattctctttgaaatcctacggttggcgagaagataaagagccgattctagcgaggcacagcagagtgggaaaaagtggtggttcgtccatcccctcttctacagcctgtctaccgtcgaaactctatttttgattacgagccatgagaagactttgcactttggcggctcccaacatttccttattgattggttgaagattgttcatgctgcccccatgaattgcattctataagccaaattacttgagtagactccattagccataaacttccaagtgatggtatcccgttgcgcgttgagaggagccatgcactggatcattgtccacagttagacaaattggcatagatggactgttgtgcactgatatattcttgcgcttggaggctgcgaagatggccggcgccaatttgtttcgggtcttatcttccaaccaatgtgagtgccgaaatctcgccatattaccgtcccccaaagtgatggtcgttgctgctgcaaagagatctctatcctcttggtcacaggggaccgtggtgccactccatggttgtctggatcggtccactcgtaccacagccatataattctcagagccctagcgaaacgatcgagatcaaacacccctagtccacccaaatctttgggtctacagaccttgtcccagctaactctgcatttttttccccctgaaatttcctcacctcctacccaaaggaatttgcgtctcgtctttcgagggagtgcaggaccccgtccgagttctttattgccgtgaaggagcaaatctacggtccttgaggaggtactatgaggtaccaaaaattcagtataaaatttggtacctcatgataccttatagtacctaggtaccaagaggtaccaaatttacaatagaaaaagtggtacctcctcaagaggtagatggattgcaccgtaaggactaacttggtcagggtcgttctgcctgccgccgacatcagtttgccttgccaaggagctagccgcgtgcgacatttaccaaggagtggttgaacatggaccattttaagcttggagatcgatcgcaagcagtaggctatgttacttcattgggaagctagtgatgtttgcatggaaggcctgtaggatgccctggaggtctctcccattgcaacggatgggcacaatttgtctttttggcacgttggttcggagccctggcacctctccgaaagaatatagtatgcgaaccaggtatcccatgtcgcacatcgtcgggcatgagacatatcctcgtacaaatctgaatagatagtttgtccaaatttatagtataatatattccatactccaattcatcttaaatcctttatatattaggggaggagggagcatgtgtctttatcaatagtttgtatatgatggacctaatttctcttccttgataatatatatactacctatttctgaaaaatccgcgagaaggcgtagggtaaccttttagtaataatatttctcactccgtttctaaatatttgacaccgactttttagcatatatttgaccgttcgtcttattcaaaaacttttgtgaaatatgtaaaactatatgtacacatataagtatatttaacaatgaatcaaatgataggaaaagaattaataattaattaaattttttgaatacgatgaacggttaaacatatttaaaaaagttaacggcgtcaaatatttagaaacggagggagtactttgtgctgaaaaaacatgatttctttcgtctctatccaaaagagtcgtctctctatctcctcttcctaacagagaaatagtgatgatttgtagcctgtacaaacaagactagctaggaatcttttgggagcgctctaaactaagacgtgcctaatgacatgtctttatttatgctgcttaattaattaaggctgctgatagcctggtagaggaaactgaaccaaaacaattagcaattcggcacctatgggccaatcattatgtaatttctcggtatcacgagcctctagatccatgcgacaagttcctaagctagtctatataaagggatgagtcatatacgagctatgagcatcacattcatcctacacacctactgcagaaagctagtgagaacttggtaatctcccttgttcctgctatatacataatggcgccgacgcaggtgatactctcttatcctatcataatatatgggtgatcgagtgattttgttactctctctgttctatacattctggtctaacgttttggtttcaccttccctcctctatattcactgacatatactccctccatcccaaaatatttgacgccgttgactcttttaaacatgtatcaaatgatagaaaaagaattaataattacataaatttatatcatttgaagttacgtatattagtgatgagcatatgtgtgtgatatactaatgtaactatcaactatgcacccatctaaagatgttatgattaatcatcattataaatttaagcttattattactgccagaatctatagacacatttaaaagaaagagagttgtgcaaatgcgcaacttaatatactagtttgtctgatcaagggcggacgtcggattggctcaactccttctggaccagccgaccaacctatggttgtgtggttgtgtttagtcccttcaaacttccaaaaattccatcacatcaaatgtttggacacatgcatggagcattaaatgtagatgaaaaaaatcaattgtacagtttgcatgtaaattgtgagacggatcttttgagcctaattacgccatgatttgacaatgtggtgatagagtaaacatttgctaatgatggattaattaggcttaataaatccgtctcgtagtttacaggtggaatctataatttgttttgttattagtctacgtttaatactttaaatgtgtgttcatatacttaaaaataatttggaggaggaactaaactgtaacgctccgcttttcgtgagtcgttaaaaactaactcggcaaaatcctaattgcgaaaattttcgttcttttgtgagagtctaagttgtgccaaggatttcaatttaatcccgttgttccccctcatcgcaatcaaaatcctccacctcgaaaattcctcttctgattcgagtctctgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgacttctccttgaattccccttgatacatccctaaaccctcgagttcgaatatcaaatttgaactcgaatccaaaccctaaatctctccaatcctatccaaatcagttctctcagaaaaagtctaaatagcgtccctcttggctgtgggccgtttctcccttgctcggcccattctcccctctcggctgctcctcctcctccccgcacgtgcgctgcatgcgccgagagagaggcatcgcctctcttctttctctctcgttttctcgctccctctctgttctctctcgcgccgacaccgcttcccgccgtcgccgcccaaaacctccaccgccttcgcccattcccacgcgcgcctagcgaggtggccgaccggccggtcgccgccaacgccagcgctgccgccatcgccgatttttcccgctgccgccattcgattttcggccgtgccgctcgttcccgcgcacgcgcgctcgctcgaggccagccgctcggtcgccgccgcgtcagccctgacgccgcccgtgaccacgcgtcgcctagccccgcctgtgcgcatgcgtccaagggagggaggcagagccccagtctcgctccctctccctttcctttatcctgaaacagcaaggagcagagctccctttcttctccacctttttccttttgcccgaccaccatcggcgtcaccgcctgccaccaccttgaccacgccagctcgtcgtccttgcacccttgaccgcctatgtcggttccccctcccaaaccgcctcttctccatctataaagcccaggccgagcctccctatctcattctctctcggcatctctcttccaccgccaccgcgcctttgttgccgccttgcagctgccgaccctcccttcgccgtcgcgcgtgctggtgaagccggcgtgtgcgcgaggagccgaagaggactccggccacccttcttcttccccttccctggcccaaggccggagaactcgccccgcgccgtcgaccgcccatcactgcccgcccggttcggtagtgcctcctcccgtttcccttcctcgctctccctcgccccctctagtctgcgtgatagctcggtggcactcccgaacacgcgtagacgccgcccctagacccgccgccgcccggcctggcctcgccgccgttgccgcccgctcccggaagccgccgctcgtcgccagccctccttggtgctcttccgccccatccgacgccggaagtggactccttgaaccccggagatgcttccaccgcctcgaattgaatcctcgtcgcccctccaccgggtttgccctttttctcaccgccggcgagggccgccgcgattcgtcgtcgccggtctccccgccgcgaatccgagccggtggcacactttatctcctccgtctcattattgcggtgtgctccctccctctcgaatcatcgcgacaagcttctgagaactcggccgccgtccgccgtccatctcggcctccccttcttcctcctcccgccggcccgcgtggctgccacgtaggcgccacgtcggagccacatcggccgcgaccgggtcagcacgaccagcctgccgcctccccctccctcgaccggtgcgcgcggtccacggagagccctatggctgcgcgtaggcccgccgcctctcggtccatccggcgcaccgcccgtgcgccatcttcaccaaaccctagcgccgcccccgcgtgaacccattcctccatgaacccagccgccgacaggtgggcccgtcccgggaccccgcatggtggacagcggtccacccggttggtctcctccccctcccacgccccattgggccgccctcctcgcggccgtgccggcccattaggctcgcccgagctgcgcaagtccctcgggccgcgccaatgccacccgagacaagtctgattcacatccctcgtccatttcctttttccaaaggatttaataaatccttttcctttagacagaaaatccaaataatcttaggaaatccatatctcctcaaccgctcgtccgattgaccccgttccacttccagtaattccgtaaaattgagatctatataatggcactactaattagtctaaataggatccttcttttggtcttttgtttaggtttttgattgtttgcgtatagttgcggttaccggattttcgtcgatcgcgggttttcttgaaggttcgtgaagcttcgtgaagaccttgagcaaggcaagtcaccctttgatcaattgcccctataattgaaaagtcattattattttgtttgaaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccctcaaaacccgacatgtggtgtcggtgtgttggaaaataaaatgaattgtgaaaactcgcgatgcgggggttgcgcctatgtggcactgtcccgtattcgcatgtaaggaccgattcctgtgggaaactcatcgaacataatcaaagtgcaaccacaaggtggaatgggacaccctgtctaagtaactagtcggttcagggaaaccacgcatgccaatattgggaacgccggggcggggtcggttggagccaaaccgggttcctggtaatgcaagaacgagaagcttgctgaattaccgatcgaggtggttggagtttgatttgtgaacgcctaaaatggcctatgtttctgtgaggatttgatccttctatgtggcatgaggtatccctgggtcggcttgggaaaggttttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttttggtgtgggaatcgtaaccagaatcagcctatgtggcagatggatgacctgagtggtcagaaacgaatctgtgtgattcgggatgtctgtgggcatcatagactaggcttcccgagtggaagcggattgctttgctgctgggcagcaggactctaggagtccgagaaaatgaaaaaggctctgggagccgattaatcaagtggaatggctctgggagccgagaagtaatgatctgacccaggaggtcggtacatttccaattgagctgttgaaaagcatctcttaagtcgatttgagacgcaagtctcttttcgacccaaacttaaaagaaataaatcacttagtgatttcaaaatgtcttcaaacaaaagatttgcaaaacaaccttgcctctcttccaagcttggattaaacacctaagttcccgtgacttgctgagtacgaaagtactcacccttgctctatataaatatatatatatatagttcctccgccctgaagagaagataaagtgaagtgaagattagggtttcgtcctatttcccagccgtcgcctgtggtgttgggtgttagaccgttggtttcgctactgctgttgttgttgatgttcgcctcgtccgtgtcgtcggttgtattctcgggctgtctgagctgcaacctaagttaaggtaaataagtcccctatttattttaaggattgctatgattcatatttgtctccgtgggtaccagcactatgtcctaggactggtaccgagatcgcggtttcgtaggaagcggttcgcgccgttttccctacgacacactcctgtcaggtgccgttgtacagcggtatcagattggggtgtgacataaacacggcctatatatactgcagtactacccctactatactagggtagattagctactatggataaacatttttttttgcggggatactatagttaaacttgagatgatgggctttcacattcaggccttaggacatggcccaaagtgaccagtgagacctatcccaccttcagattctgtgtaaattaatatatgtctatgaaattattggttactgcctactataaagacacttaaatttggagcaaatttatagtccttgatgaggtatatcactttttctaatataaatttgatacttcttaatacctgctccctccgtcccaaaaaaaatccaatcctaagtttgaatctggacagtgtcttcatttgtaggattatattgggtttttttagacggagggagtaggtattaggaggtacaaaattttacactaaatttttggtatctcatgttatctcctcaatgactgtaaaattgctctaaatttatattctttttgaaaaaaaaatgaagacactacatatgagaaatttaatttcttttccgtgaaacaacttaaatgcatttggatttattaacggtcaaattgatgcatgcatatgtttcccgcttaaaaaatatgcttgtttactgtctcttctttctgaaatgccatacattgcttacatatatacatattataattaggaaaagaaggaagtatgtttcgttttacatatgaatacgtattcaaatgaacattattaactgtttaataatataatagatgttcaagaaaggcttaaataaatcagcaccctaccgttgtgatgtatatataggctgctgggaaggtgacgctgcgcagcgaaccaaaggagaaggcgatcccgagtaacgaagagcgcaaggaatggcctgtcctggtgcacgtggtggcgccggcgaaaacggagcgtttccccatcgacctggtggcggtgctggacgtgagcggcagcatgacgaaggcgacgtcgatgcacgggtggacgaggctggacctggttaagggcgccatgaagatggtcaccaacaagctcggcgccggtgaccgcctcgccatcgtgccgttcaacggcaaggtcgtcgccgccggcgcgacgcggctgatggagatgaccacgaaaggccgcgcggatgccaatgcgaaggtgaaccagctcaaggccggtggcgacaccaagttcctgccagccctgaagcatgcctcgggcctcctggacagccgtcccgccggcgacaagcagtaccggccaggcttcatcttcctgctctccgacggccaggacaacggcgtccttgacgacaagctgggcggcgtccggtacccagcacacactttcggcatgtgccagagccggtgcaaccccaagtcgatggtgcacattgccaccgccaccaaaagggagctaccaccccatcgacgacaaactctccaacgtcgcgcaagcgcttgccgtcttcctcagcggaatcacgtccgccgtcgccgtcaacgcgcgcgtccaactgcacgtcgccgacaactccggcgtgctcatcaacaagatcgactccggagcctacgacaagacgatcgagagcgggaacgggaaggcgtcgtccaagggcaccatcaacgtcggcgtcttgtccgctgaggaggacaagaagttcatcgtctacctcgatgtgccaaagctggagaacgctcaggcgaagccgccgcagctgctgctaacggtggccggtgagtatagcacaccggctggcggacggaaggtggagaatatggaggagtccagcgtacaagtcgagaggcctgcgcctgcgggcggcgcaacgaaaaccggcgatcatctcgtgacgtggtcggaggcggtcatggtggagatggtgagggtcaaggtggtcagcatcgtgaaggaggtgttgaagaagcacgagcacgacgaggagccggaccagaagcagatggccaaggatctcatggaggaatgggacaagttcatcaaggagaccccagccgggaaggacgcagcggagcgcctcaaggagaagcttcccaagcatcacgtcgaggatatgcgcaggagcctgaccaaggaggagcacgacggcgtgctgtacctctactcgtggctggcgagccaccagacgcagcaggccaccaccatggcgtcgtcgccgccggccggcgtcagcggatggttccaccagcagtacatgaagcaggtggccgtcgacgcggagttcgacgcgtgcggcatccagcccggggtagagacgaccgagatcgacgcgacggcggactgcggctgcgtcgtgggccttcaggacaggatcgaccgccggctggagctctggtccaacctcaagcgcgaggcgccgctcatgttccagccgtccgaggacgccgagtcgcaccacctcaccgccgttttccgcgaggcgtcgctcgatgccatcaaccgtgccatgcaccacgacatgtacctggtacgtacgattacacgtacccaccttactagctactcctccgtctcaaaatatatgaacatatgaccgaacaaggacatttcctagaatctatactcctccgtctcaaaatatataaacctatgactgaacaagacatttcctagaatatgtactccatcatctcaaaatataagaacctataaccgaatatggcattccctataatctagacagatagatggcctatctaaatttgtagtatttggaaatgtttcatctagttatatatatgtttctatagaaaaaatgcccgtgcgttgcaacgggtaaaattatttttgatcgtatacatttactctttttgggccaaaagattatttcttcgttccatttatgttccagcccagcccgctacctctctctacttggcctgagtctctttgacctagctttgacctagcccagaagtgaagctataggccatcctccccatcaaatcgtatcgaacctttctcgatctcccattaaatcgtatcgaatctttatcgatctcccctaattggttaagggtttctgatgcacttgatctactcttttgtttttatcaaaatctaagcgaatctataaaactcaagatataaacgctgacttttaaatagagattagatccgataaactaaagcggaattgaaaggaaaaattatggggaaaataataagggagtagtggggaatcgatttttacgaccaattgaaggaaggaatgcggagaaaaaggaaaaaaaaaagagaacaggaaaaggaggaaaaaacggcgggtgaaaaaaaggaaaaaagaagcgaaggcaaaaaaaaatggaggaacggtaaaaacggaaaaaaaaaggcgaaaataacaaaaaaaaaagtgacggacgaaaaaaaatacaaaaaccttacgtatttttataataggtatagatatagatatagattttccttattttacggaagacggaaactcttttgtcgcaccttttttgggatcgggcagaacaaaatttttgcccttttctcgcgcttgattttttttcatacagtaatttttctttcctttttttcaacggaatttccaagtgagtcggaagttttgtttttaatgggaatcggaccttttttttcgtttttttctcagcgttttatttttcacggacgacggaagcaggttttactttttaagtagtagtagatatcctgagacggaagtagtaagtagcgagttactctcctcatcccaaaataaataacaccgtggaatatttgaactcattttattatatacgtgcaggccgtcgtgcatgcgagcaacctgaggcgatgctactccggcgccgggaagcagcagctgcatggatacggctcgtcggagctgcctgcacatgatgatgaagcgctgccggcgacgcgtgctgttgaaaaacacagcgagtgaatgatcgagccaccgtgcaagctatggcgtaacggtggacgatcgattgaataagccggcgacggcgaggtttatcaattcctccactttgatttcagtattgttatggggagaaaagagtcaagaaaaataataagatagacgaccacctcgtcccccatgggacgagtgccagtctgcttgtgcgcttttccttacgcaagtgtgctcgtgtctttgtgatcaatcaatcaagtcaaatttatttcgtcaatcgcgcatgtattcgtcattctggctaattgcattgtgtgtaacataactcttttcttctaatacagtgacgtgcaatccttttgcgcgttcgcgaaaaaaaaaacgcatgtattcgtcgtcagtttgctcaagtttaatgaacgaatgtttaataattcgaatctttatccgtactgctcaccgtattataatgttatcaatatttgatatttgtattactccctacatccaattttaagcgtagccatgagttttcttatccaactttgatcgttcatcttttttaatctttttatgattagtatttttattgttactagaaaaaatgcccatacgttgcaccggataacaactttttttaaactgagcaatgaattgaaacattatggtcgctatgtattatgattaaaaaagttaataaaaattattctttggttttaggcctaaagcccattctttctttcttggttttcctatgctcgcacggccctccgtcgtcttcaacctctacctagtcccgtgcctgtataccagagctgatcctccccacaagatcccttctttccatttttttctctgatcgaattcgcaaaatttatcaattgaaggagaaaatacatggggagaccgatcgaagtgcaggcagcactagggtttggtccggcgatgatgagataaaaaccggatggaaaaaccgggtttggtccggcgacgatgagataaaaaaccagcgaaaaacaaaccaaataaaaaaaggggggaaaaaccagcgaaaaaacaaaccaaataaaaaaaggggggaaaaaggaaatcggataaaaaaagtagcgaaaaacagaaaataaaaatgaatcataaaataaaaagagagacggagcaaaagattaaccggaagccttgcgtattttttaattaggtatagaattgttttgatgattgggctaccactttagcatacctggagcaagttgaaccgccacatcaaaaaaaatattgttttcaaacactgaaggagtccatttgaattgattgttgaaattgggggagatgttatattcggttgtgcggttaagggatgcgatttgatcaagggcaagagaggagggataataaatatacttacgattttgctatatctcactcgaaagattttttcttatctctcactcgattttctcacttaaatttatagtgcattttcttgtaatctacagtgtaatttatgaaacttacactataacttttgtaagttacactgtaattttttaatcttcacatgtaaattttaaattttgtattggatttggtctttttcttgaggatatggtaatttagtgtccattatggtgtttcttaattgcttttttccttttattatatctatcggattttaatccaaagattaaaaatctgtgtgatacgatcataaaaatctttcgaaagatatataggtactcccatatacttatgaagatttgggacatttctggtccatctttcttttttttttcacatgccagcccacttctcctctcctgggccactcttctttctcctcctcggcccaacatatgtctggcccatcaagctagctcaggttgcctttctccctttctctaactggcgcgtcgggcccgctggcagcgtcatcgtcttcctctagatgggatagaaatcccgttgccgcacagggtcgaagtcgatgcccttctcaaatataatttctccactgcttctccttccaaattggatgcgaaaatggaatcccctcaatctcctctccgttttcgctcaaccaattttggttaagcccaacgaaatcccgcggattttgagtcgtttctatccttcgcacggacaatatcaatataaatccctttttatccttcgcgcagagaacgtcgatatgaatcggattagtgaatccgacgacggacgaaaaacccataccggaagccttacatattttttaagtaggtatagattagataataaaacatgaataatactttctgcgtgacttatatttttaatttttttttaaaaaaaattatcgaataagatggacgattaatggttgctctgaaaataggatggagggagtatttgtttagtacatttttattaaactttactgaaggttataggtaaatttatttcaaaaatttgtgagtataaaataattttatttgattcatattttctaaaagaatattgttgattaaaaatacatataaaatatatcttaatatttaatatattaatttattttatatgtatttttaaccaacaatattcttttaggaagtagtatgaatcaaataaaattaatatattttttgcaaggataaaataattttatttatatgaatgaaataaaattatttccagcctaccatctattgtttctagatacacacgttcttgtaattcgatacccttaaaatagtgtaaggtgaggtatctttatgcttgtggatttatatgtaacaataaccaataccaactatatgatcaactaaaaaatccaggcatgggtaatatttcacctcaaaactcgtgcagatcaatgttgactcaggcacatgtttatctgaaaccaatttacactatttttatgtcatgtaaagctgtctgcctctagattatatacttacatatttatatatttatatggagacatataatatgctagctaagtcaaagataatatatatagagaggttggagaaagctcgctgcttgtttaagagagaaattaacatgcgttggactggatatcaagcccaatcaaccagcgctccgaatcttcgatgctaggagggcgagccgccttcaacacttacgtgatcacttctccagcccaactaaattgggatgttaggagggatcagagagcttaatttgcagaggcagcaagcacatccatgggatgctggtgatcatgcatgcatgagtagatcatatggcatcatgcgttcggctacaaaattgtgtgatcatgcatacaggcatttacaagaccaaccagcacttctcagcccaactaaattttggcgcccacacacttgccatatgggcattgtcgtcgccgaagctggtgatgcgcaatgctagaccgagatcacgatcgagaatcaggagaccaagattaacgagtagggaagtttaacaagatctggtgatttgtctttaattagcaattttttttcgtccggtatatctcatgaatagaactaattatcaaacattttacctttgtcgttaatagtagtcacttttatctaatctatctatatattattaagaaccttgaaatgagacatcacatttatcgtatattagaaattcccatattaataggagaaaaaggaaacaaaaatttaccattaaatcatgttgggcatggattataattggattataatggcatagattaattggtatagttgtatgtaaagtataattcattactattataaaaattgaagatgtttttgccggtactttagtacgtcatccgtatataagtcagtttttaatttcgttcacttttggaaatacatattcatatttgagtcgatttttaaattcgttcacttttggaactacagagggagtcgtacaagaaatctctttaaaaaactagcatgctaacttgagacgattggattcctaattgcagcccatgattttctaaaacacatgtatatttaagcgaattcccgtagtgaatttaatcttaactaaaccatataacaataataagattaaaataactttcacccgttgcaacacatgagcattttttctagtatatctataaatatagaagttttagttgtgtatgaaatctaagagttgtatataaaatttggaccttacaaatatgaaaactaagagttatatatgaaatccaaatatacttctatatataaaggttcctatacaaataactataatttaaacatgaaatcggatgaaatacgtatgagtataattggtaaattaataacagtcgaacaaacatgagtacggacggatgaagattgcagataactcaggaacatcatccaaatcttatcaagtattaaatatatccaaatcttatccaatgttaaatatattttatagggttaaaatgggatgatccattagggatagaattaatgttaaatgattttgctgcagaagataccgattatgttgcagccgcatatctattcctggttagaggtataacaaaattgataggtaaaatcagataaggccatttaaatttgtttcaccccaataactcacttctaaccatacatctgctagcatgatatatggaaagttattttcaatggaaaattatgtctgtgaggttgttctcagattttgcagtgttgggtgaaaagatagaacatcgaaagaaagtaactaatacacacgatcgatccatctcaaaaagaaaacaagaaatttttttaaaaaagcatggaccattcatgtttctatactggtcagacatgcacaatacgtgtgttcctatgcccgtgtaattattttgcattcaaatatcagaaatagagtttgatcattttacagtcttttaactgaacgcccaatactgcaaggcttttaactgaacgctcaatgcaaactatttgattgagctccatttggcaaatgtccttacacggccaacaaggcaacaactgatatgcatacataggcccaacaattcatcttgtccctgattgagttattcatgcatgctaggtaagtcctatgttactttcagtaggaataagttcactttgactcccttaaaagtgacccgaatctaatccgtgaccctcaaccccaaaaccggataggataactccccgaactattaaaaccaatgcaatttgactccctcggcggttttggagagcggtttcgctgacatgtcgtctacgtggcagtgtgttgacgaaaaaatcgaacacaccggcctgggagatctgcttaactcctgtgcaggtccaaagattgatgagatgcgggagtgccagtcagtttgatcctgcaactgacaagatatacaaacagcaaatcaatgagccgatcggctgacaagccgatggagtagttccagccgatgccgataccagccgatagtgatagagtttggagctatcggctatatgtccaatgtagatgatgatataaaggcaatcggctgatgataattaatatgattaaacaatataatccagtagaaaccagtcggctaataatggtatgatagaaaaagcactgatccaaaggttaaagcatacatcggccgtaggtccgatgtcataaaatccacaagattagatcaacagtaaaacctttgttgcgatcggctaaatccaatatgtatgtatatgcaatccttacaagccgatgcaacgtccagataactcatcggctgaaaccccgatgaaacccttattggcagtcaaaaagcagactagagattatggttctaagtacgagttagtagatcaaactcaactaatgcagcactaagtatgaaaagaaacacaatatctagataatcaagccgttgactgagttttcagggtggtagatatctaagctaatctaatctagcaaggcgatttagccgataccggcagaaaccctaaaacaagaagcagccgatagagctaaattgatatgctaagactagattaacagagacatatgataaataggtaggcaagtatatcatccaaaccagagcaatccaagaagtcgaatgtcctgatgcagccttgaacgacgccgacgtagacgatataattgcctgggccgacggaacattggacttaccccttagccggagatcgaacaccgatgcagccccgcgtcaggtgccaagttccgccggaacgtagaaacaaaagtaaaagtaaaaagggtggtgatgcgccgaattgtattgatcgtagagatagattacatagaccccaagtgtacatatttatacccatgggttgatacaagtccttgtcggacaagaaagaaattttcctaaagataaaaggaaaagataaagtccttataggacactaaacacacttttctaaagataaaaggtaactaacaaactattcctaattaatagataaactgccatgccgcatcctctttaaactcggtcacttagggataagcttcctttagtagatttatttccttaaccgaatatagcaggaatccgactattggcgactagataactcccatcggctgattccgagatactgcagccgataatgattctaagccgatgacgtctttgccgattaccactgttaacacagtgttgacccggtctgctgttgacgtggcgcttaggtggcattagaattaaaaatatacatgtgggacccatttgtcattcacacaaaggaaaaatttgtggggcccactgacatgtgggtctatcccttcttcctcctcgctctctctccctcctatctctctttcccccccttccgcagttcggcgagcaggggccagtacagcggcggagtggtgtgctgcgggcgggagggcggcggagtggcgggtggcgggcggcgggcgggagggcagcggcgttggggagacgagtcggacctcgagggagccgtaggcacgcgcggcggcgacctaggacttgcccgttggcccgcttattgtggacttctgcccttggacgatggcgccgccccacgcttgcgggagctgcatccggacgacgacgggaaggagcagacgccagcaagccatgctctaggggctctaggaggcagccgcaagatggagctcggcgagggggctttagggcagcggcgccggcagtgatggggatggctctctgtctctctcgtcttctcc

SEQ ID NO: 74727 - DNA, 2696 bp, Oryza sativa
caagacaggacagaatgtctgcttggaggaagctgcaacaagctgcagttcaaaagaaaacacgtccatttttcagggcagtggataagcatggtcggatgtatgcaggtatgtattgtttctttttgaatgattctgatgatctgatcagcaggtaaattggcaggatcaataagtagtggcttgttttactaaaaacaacttgattaggattagcaacagacattgacttcttatgtcaatagatactaccatcaatggagctccttagaattaagattagtgttgcttctcgttttgcttctttttattaataatttctgatttaatgcccatctcttctgagttaaggtattttttgaactaccacaaggccttagaaaactatatacaaaaatataagttcaataagatccatgttttcctgcttgtctaagcattggtgtctccttttgtcttacaggtggtctagatcggcctattcagaggcccttcatattgcgggattggagatttggtcactataaaatggaaggcttgcaggatcctttgagttgctttataagatgcatttttgcaccattttcacgccaaaagaagattcactacatagaagatgatgttatttcttattctattaactgatgccctgctactatagttgctactttaagttcagtttcttatgttgcaaccaaaaacacatccatgttttggtgagtcaagagcaacaatgcattttgcttttcgattctttgtgcatgttacctatttagaacatctagtttggaatcttttgtaggttattacttttttcttgatgaagtaaataaaaagagtcttggaaatggaaagttcaacttcttcaggtaattactacatgggtttactatttgtataatagtacacatttagattccatacacttattttattctcatctcctttttttggtttaagatgtgtttgatctaatgtcatgtagattgtattctaaatatcttctaagccaaaatatcttttgtggatctacttttgctggctcatagctatgtcctgcacttcttaattgaagatgcttcctgggaagtgtttgggtgaacagatgggcacctgcctaccttatttagatctctgaccctccaggctacatccagatctgtgcgtgtagacacgttcaagtagtgagttaatggttcctattgtttcctcatatagatttttttacttttctattgtaaaaaaaaacacttttcacccactgtatataggaaatgaataaattcttttcatttatagtgtaagattcagtcttaattcatggagctgaggcataagtagtagaaggaaatgaataagatttgcaaattgcagcagaggaattcaagggttttgttatcccataacttgtgtacgtgagttttcatattaaacagtggtactacatttttgacatgcaaagcctagctgcctaagccatcagatgcatttggagggatcattgcagatgtatcctcctgcatgacctcatggaatcatgcacgtttcacatttccaaatttcacacagccagattttattggaaaaattactggtttgttaactggccttccaaacctttttttatgggcatggcatgcattttatttactaggatgtggcatgtattctttagtggaactagccactaacttctttattcatgctgcattacaatctaaaaagaactaaactttatatgcacacagccctatattcataatctggaatgtggtattttttatccacaaccccgtaatcactaaccacacctctcctgtacagtttttctaatatatataattaaccataggggcctccctactgttcttcattcaaagaaactggtgtcatgatgtcggtcttttgactagggatcttaactagggcgaatatcaaaagaccatacatctttagtacaattgtcatgcaaatttattctcatgtggtgtcatttattttcagtgaaacaaaaacagggggaaaagaaagtatctcacaggagaaacaagggagcatataatcatatgattttttatattatggcgcatattgcgttacatgagctatttagtacagaacaggaagttgtttagttgccttacagggctattgatgccattgcaatcatacgtaagcagtatatatttaggaaagacttttgtgttatcgccttttgaagtacataagcaaatagtagatcatcagtgttcattatttcagtattataggattgcagagctggtaatgatctgtggaccaagggatggcagaatgatcaattgttcttgataacttgatgagctctctccattagtaccactggttttggtatggcacaggtaatcttctcctccttctctggtatctggaaagctgatgcagggaaggttttcgtaatcccagcaatgctcttgcagatgagtttcccagtcttttgttcatcaagggcaatctcctctactggtacccacaccatgagctccctagtcttgatccctttgactttcttgatcctccccttctctgcaaaagcagtgatctcagtgccataagataccaaccttcctaagctttggaagacatggtctatcctcttcttttgcttgagccacacaaatccagtttcctcaacatagccacactccattatgtcc

SEQ ID NO: 74728 - DNA, 6327 bp, Oryza sativa
ccgctgaacttttatataggtcggaatcaatcaggaccgtctataagatgggacggctccaacttctcccgcattgggccgggcgccgttcccagccgcccacactattgggccgcgtgtaatctcacagaataagttcactttatgtccctaaagttatccctgaatctgttcctaggccgcacacaccattgggccacgtgtaatctcctcacagaataagttcactttatgtccctaaagttgtccctgaatttgttcccaggcctcctacactattggtcacctcatgggccgcgtgcacgctccgcatggaataagttcacttgaggtcccttaagttgaactttttttatttcattaggaatagattttcttaaagagctcatatcatctaaaactaaaccctaatcatttaatattttaatatttggtataatttatgtttacccgttgcaatgtacgggggtattttttttagtatacatatatgtgatcacggtctctgtttggatagacactaaaaaaaaattgtctagacgagcaaaactgatcacggattttctgcccgcctttacacaaacgactggaaatcgacatttccacaggtgccctgcgtgatcatttccttgttcactgacagccatggaaatcactactgataggcattaaagtgtatagtacctccttgtcaaaatgtatgaggccgttaattttatgcagaccattcaacaagtaataacaaaaataaatgatatttaggcacggggccgggaagcacaacgggggtggcaccactggacgtcggcgtccacggcgctccggcttacctcgggcgaaacagaggcgaggccggtggagagggggcggctgcgaggcttggcgcggctccagtcgacggggaggtgcggccggaactcgccggtgcggtggagagaggaggtggcgcgggaagacgtttgggagggctcggcttgctgggaggaggcaaaaggggaagaacgggaggggcggcgccattttataggccgagaggaggagggaacggccggagggagctcgccggccggccatccatggcggccaatcaaggaggattaaatccggcgaatttaatccgaattaagaggggaaatcaagggggaattgatgatgaggaggagaggaaccgattttcgcaatcactttggaggagaaaccactggggagggagatcaagaggcggccgcgcttctgttcagccgtgagaagaacaggcgacggctcggctggaggaggaagacgacccagcggctgggccagctgggccacgcggaggattagaaacagactttatccgcggagagtgaggaaggttgggccgagcaagggaggcgaggagatgggctaaggagaaggaaaaaggcccacgagggagggagagagagagagagaggaggaaggggaggaggggggcgctgatacgcgatcagccgcgcgcgcgcggtcagtcgctccccctctagtctcttctctgtatctactatacttatgtatatactacatatacacacatatatacatatgtatatatgtgtgtatatatatatatttataaatatatttttaatatataaaaaatatatacacatatatacaaactttgtatccgatgtatacgaattttatatacatatgtattaaaaaattaaaaaaataagaaattacatcacgtatacaaagtttgtatacacgtatgtaaagtttgtatacgcgtatataaactttgcatacgcgtatacaaactttgcatacgtacgaatacaaactagcttggtatacatacgaatacaaactttgtattcatacatcttaaaaaaaactaaaaaaacagaagagaaaccgaaaaaaaaagaaaaactaaactgaaccgaaaccaaaaaaagggaaaaaaaaaagggcaaaccgaacagaaacggaaaacatggaaaaaacaaaaaaaaacagaaaactcgctctcccgtgcggcgcgtccgccgccccctctcctcgcgcgacacgtgtccagtcatgcggggaggggcgcgcgcgagtaatagccttctcgaggggaggaggacaataagacttctgccatgggctgagagagagggaggactttgggccgaaaatgacccaaagggagagaggatttatttttaggttttctatttttagttaactctgaaattggtttttgttgcttaataaatatttttgctgctctgaaaatttgagtaaaaattgagggctcctctttgaccatggagaatttaagaaaaatactccaggccacatttgaatttttcttgtacgcattttaatgtttgccatttcctttttgaattttaattaatttattatttcttttagagaatgatttttaaaacgggatgaatttatcaggttgtgacattaaaggagtccgactacttgaagacctcatttatcactccgttcggtgcgtactgctacatcatgatgccttttggcctgaagaacgctgaagctatgttaccaacgcataattaagagatgtttgcagtcacagctcgagcgcaatgtggagccatatatcgatgatgttgtcatcatcaagacctagcaaaaggtcaacttgattgctgacctggaagaaaccttccaaaacatacgtgcctttaggatgaagttgaacccgtagaagtaccgtcagggaagctgcttggtttcatggtgtcgtatcgcggcatcgaggccaacctggagaagatcaacgctatacgcgatataaaaccaccgaccactcggaaggatgtcaaaaactcaccgagtgcttggcggttctcagttgatttatttccaaggtggagaacgaggcatgcccttcttcaagttgctaaagaagacaaacgatttctaatggacgcccgaaacccaacgagcttttgaagattttagatttcaatagtttcctcacaatatatttctcgtgctggcttcacctcatccataggagcctttgctactttatgcattggcgagaataggagcgagacattcaaaaagctcaaaggcctatttatttcatcggtgaagttttggccgaccgcaaaatgtggtatccacaagtctagaagttattgtatggagtgctgatcacggtcaggaagcaagcacattattttcaaagtcacttggtcactatggtcacgtcttttccactcggtgacgttcttcacaatcgtgaagctttcggcaaattacaaagtgggctctagagataatggcattcgatatagccttcaaagcccgaacatcaattaagtcacaggtcttagcagattttgttgccgagtgaatggaaattcaagaagggacaccaatggagaagctggagtactggactatgtattttgatgagtctccatctctggcgtgctccaaatccatcccctttcccccatactagcccgtccagtttggccatcttgtgacagcaaagcaccgctgcaagaggaccgatgcttggaaaggaaatcgccgcagccttcaacgcccatctcatggcgctaccatcatcattgcaacatgctacgtggttgctttgccgtcgcctacccgtcctcccaccacggtggcctcgccgccacgccactctagccttgccgtcctcctaccatgccaagctcgctgccacaccactgtaggctgcgcaccatgcttgacgaccacgagcctccgtgccaccctcgctgaccgcacttgtccccgcgttgccgacgcctcctctatcgacctttgcgcctccgtgatgtgggctccagccgcacaggcggtgcctccgaccacgccagtccactgtgccacttgctgcttctgcctcacacaggcctcacgttgccgtggcctcaccgtgttggtcttctcggcagtccgcgccacgccggccatgccgcctcgccgccagcccgcctccacgctacgctggttgtccgccgacacatcctctcccggcaacactccctgcgccgggcacccactgccttgcgcaacagccagatccaaccaagagagggttggatccgggtgtgaaggtgttagatccgcccctccaatggccatggtgactgtcgccgtgcattgcctactcttcctgtgccaagaggggtttctgccgaagatgtggccttggctccaccttcctagctcaccaccggctttttcgtcagtgagctccggcggtggctaggtagaggaggggcagcgcgggtggctagggttccatccctgagccgcccacacatgggcgacgcagaggaaaaagtctggttccgtctcagaaatattgcgtcaatttccggatgtgaccaaacgcctatgtaaatgacttatgtgctgcctggaaaaatgtttccattaagtagtgagtataatttctaaaattactgatattagagtgcatgacatgaacgattatacgatatctttatctttatctttacctacttaaaaaacaaaatctgcttcaaacaaaaaaaattatttctccgttggtcctcctggtccgacgacttctcctgctcgagtcgtccatggcgccacacgggcaccatgtcgccaccacatcgacctatctttccatgtgttttctcctctaattaattgcaaaaatcgattgttcactcctccctcatcctttcctttgtgattttctttttcaattcggatttaattcactagatttaatctcggtttaacggttatcaatgatggttagacagctatcttcccccggttgttcctatcccaagttttgcggattcactccgattttggaaaaaacggaaagaggagatcgagtggatccaaagctctcaatcaattttgggagatcatagatttgatagggatgattggctccggtaccatacaggcacataactgtctactggaagttaagagagacaggctatgaagggaggtaggtaggagacgccttttcaattttaaagtatagcgatactaatgttttaatttaattattcatcagctcataatagctattttattactggaaaaaagtttttacccgttgcaacgcacatttatttttttttctagtaataataaaaatacaaaactgccggcagggcaaatgcgctacacagtaagataaattttagcatgacctttttttgccatgtttttattgtcatcaacactttatttaaattttccatacaataaacgagtatatatatctcatacggtccaacagtaactaggtgacgatgaggggcacagccttgagaggggtagccataacaaggatatcgttgcttgtgtaccgctcggtgacgtccacctcctcagccgacatgcctttgggcaggtgccactcgaacgcatgcagcaatgacgcgactgtaaatggcacgacgagctctaccattggcaaagcagggcacagccttcggccagacccaagcggaataaacttggcctgcttcccccacaagtccagctccgtcttgcccaagaaacggtccggcaagaagtcgtccggtctctcccatgcggtagagtcacgcattatcgcccatgagttgaagatcaccgtcgtgcccttggacacggcgtagccgccgatcctcacgccgtcctcgaccaccaggtgcggcaacaggaggggtgccacagggtgcagccgcatcgactccttcactgcggcctggaggtacggaaggttcaccacatcggcctccgtgatcgtcccattgcctccaagtgcggccttcatctctgctcgcgtggtggccatcacattagggttgcgcagcagttctgccatggcccactccaccgtgatcttggtcgtctcggtccctgctgcaaggatgtcaaacaaaaggattttcacgtcacggcgagagagcttgccggtggacatgagcacaaggagagagtccagcacatccttgcactggtcgtcggtgccctgggctaaacggcagtcaattatgctgtccaggatatggaggactcgactcatgtgtatggccgtccagtggcgaatgccttgcaaatctagcggccggagcagcgggaagaaatcggacgcgttcggcttcgcaagtattgcaacgatatcctccataagatcccttaaattggggtgggcatcgacggagagaagcacgttcgccaggaggtcgaacatgccatggtacaggacctggccgatatcaacctcctgcccagcgcggcgacggaagctgtccaccatgtcgaaacaccttacgctcgcgggcgctgcgcgccacgccg

SEQ ID NO: 74729 - DNA, 3435 bp, Oryza sativa
gcgagaagacgtgcgttaccgagatcctgcgcagggtcttccatagaggatcgtagctcggcagccaaaccattgatcgttccgcgtgcgcgagcgcacgtctcgtgtccgggaccgtgcgcgccgcaaggcgccgatcgtgcttggcgaatgcttcccacgcagcgtcgcgcgaggagatgaacacggtggtgacgaggccaagcttgagcgtcatcacggggccatgggcgtgagccaggcttgcgagtttgtggtggaggttgccgccgcgcaggtcgagtaggttaccgactatgggcagcgtcctggggccaggcggccgctgcccatcaccccttctgtttgttcccacgtaacagagtagtaggacagcaagtgatatccccagaaaccacaacccacttgccattttgtgcgttgcagacttgtagttaatttgaaaccataagaatggtacccgccctatatatatagttatatacctcgagctttccaaggccagtttcgtccgttcctcaaccttccgctatcaccgtgggagattttttttgtcactatggccccgttcttttctccgacaaaagttagatattcgtggcacacttttcaaactgctaaacggtgcgtttcatgtaaaacttaattaatcataagttaatagcacctcattttacgtaaaacacttaattttcatcttcatttacatgagtttcaaacaccaccaatagctaacattcagccccctcctcccacttgtcagatatggatccaacagtagaattcgctcttagggctcctttggaacaaagcaaaaatagaggatttttataggattgaaatcctatgcaaaataatggaatgagcattatatttgagattcctacaaaattccaatagaatggcttgattcataggaattttggaggatttctaacacgaggttagaccacatggaaaacttttcttaggtctatctttctccttaaatcttatacttttccaatgaagcgtacaaacaaataagtttcacaaaattcctgcattttgaaattcctagttatcaattaaacatgccaactctcaattcctacgttttcatgtttctatgttttttaattcatgtgttccaaaggagccctttatttggtgtggttttgcttgatgttacattttaaaatacaaagatgtatcaatattcgagtatgcaatttgatttaagagaaattatattatttggcaccggcatgcgctcaattaattttcaaactagttatcaaccctgtataccgcacgggccaatgattatacaaaacatttatctattttttacaattataacattcaaataaagtttaatttatttgatcactatttttaattatattttcatttcagtgttatataattacgctccaatttcaggacagtgatttcaatgcatgctattgacttcaacagaaaaaactatgcgtgcaatgtcatgagtagatctatactgaaacaatgaaggaccgtctatattagtccttctggataatatcgctaccaagatgctataattataacaaacaattctagatagatttttatcataagagtggaaagtgtggacgctttttcgtggccaacataagatcactaacaatttgtggtgtaaacaacagagtcgccaaattcgatagatcaaaacctgctagcaaagccgatttcaagattaattcactttcgtggaattacacgactaatttacaagcaaattagcaaagaagataaatatcgtacttacgtgacgacgaacgagtagtttccgagcaaactaccaaagcataatcttctcggtttcgtggagaagcacgattatttttcagcgcaaaaggcaaagattaactaaattctaggattgctagaactcagccatgaaaacgaaatagaaaataacaggaaagtaaagaacgggaaaatagtatattgacaattgtttggggtccccattaaccgtacatccgcatatacatatatagatatatatatatatatatatatatatatatatatatatatatatatatatatatatatatagaaagtaatgaaagggccacgtaatctgaaaaacaatggccatcggatgaatgtttggataaaagatgaccatccgatcatagatatccatgcagcaaaagaaaatacttttagcgtcttctagcgtctcccctttgacacatgaataaaagaggcacttccctccggtttcttctagcgtctcccctttgacacatggcaaggaaaaaagagtccacaacatgaaaaatacactataggatattgatttgcatggaaaatgactacactactgtttgatctcgtgctgattaattaaatttgagaagtgaaataagtaaaacaaacatacatgaattggtgttgtgtaaaaaaaataaagatattgctgtagtagtatgtaatttatgggctacttcgcagtagtaacatttaggggcaagacagcaagaccactataattgtaaaaaaaaaatttaagatctttaacaaagatgcatctcatggtcgcacaaatgcacaactttgagtggctaatatgtaatggaaacctataaaaatactgtaggatgtaaaaatagacgtataaattaaatttgtacatgtcataccaagtaaaacttttactcctaaattaaaccataagtaaaagtttcagttaggatgacgtagataaatctcaaacatccatttttcatcctacaatagataaacaaagtcaagaatgatgtcccatgcatttacacaacaattttttatctaagggtttgtgtttaagaggaggagaacagagaagatcgaaaaaaaatacacaaaacgagttgtactattacgcatgattaattgagtattttttaaaaaagatttaaaaatgaattaatacaattttttaataaaattttctatagaacttcttttgaaaaaaaatacatcatttagcagttcgaaaaacgtgcgcacgaataacaatgaagattttctcccaaatcactattgccgaacacagccatgtttttattcaaatagaagttactgaaggattttcaatttgaaattcttgtggaaaaaacttctaaattattatatttttcaatccaaattgcaattaatcttatgatgtattaattagttaatcctaaattgcatttgatatgttctttctggtttattgagaccaacattgagctgggctgcaaaggaaattaatatggaattatgaatgtgccttttttcgctatttcaataatatgatttatagtagaacgatgttaaaagaaaactagtatatatatatatatatatatgtatatgtatatgtatatgtatatgtatatatatgtatatatatatggatatatatgtatatatatg

SEQ ID NO: 74730 - DNA, 2564 bp, Oryza sativa
ccgaccccatgtggaaagggagagggtatcacgggaaatatttccccccgctttattgcacgcggggacgacgggaggcggcgggattcgcggcggcggcggcgctagggcgcgggcgaggcggcgggagcggcgggaggtcggggaagacgggtgggccccacccgtcagcgagggtggcgggcgggcccgcccgtcagcggcgcgcgcgcgggaagaggccgagtgggccgcggggagaggagagagagagagggggggaggagagattggccgggccggcccaagggagggaagggggacttttacggtttttctttttataaaactttttcaactttgtttatttattagtaattattatttgtgctctaaaaattccactaaaatttatttacaccttttaggcttttaggaaatatacaaaaatcccctaagccttatttgacttttaactttgcacattttaattgttggaggctttcacacggattttaattattctaggcataatttaaaggatatattttagagttattttgggacgtgacagctgtggttcatgctcttaaaatctggcggcattatctcattggaaatcgctgcgaaatatattccgatcataagagtttgaaatacatcttcactcagtcggatctgaatcttcggcagagaagatggttagagctcatcaaggattatgatgtgggaatccactatcaccctagtaaggccaacgtggtcacagacgcgctgagtcgaaaaagccgttgcaacactcttggcatccgtggcattccaccggagcttaatcaacagttggaagccctgaacctaagcatcgttagccatggattcttggctacgctagaagccaagcctaccttgctcgatcaaatccgtgaggctcagaagaatgatccagatatgcatgggatcctcaagaatatgaaacagggtaaagccgctggtttcacagaagatgaacaaggaaccctctggaacggaaatcgtgtatgcgttccggacgacaaggaacttaaacagttgatacttcaggaagctcacgaaagtccttattccatccaccctagcagcacgaagatgtacttggacttgaaagagaaatactggtgggttagtatgaagcgggaaattgcagagctcgtggctttgtgatgtgtgccagcgtgtcaaagcagagcaccaacgatcggccggacttcttcaacctctccaagtaccagaatggaaatgggatgaaattgggatggatttcatcaccggacttccaaaaacccaaggcggatatgattctatatgggtagtcgtggaccgactaaccaaggtagctcggtttattcctgtgaagaccacctatggagggaacaaactagctgaactctacttcgctaggatcgtcagtctccatgacgttcctaagaaaattgtatctgataggggaagccaattcacctctcacttctggaagaagatccaagaagagttgggtacccgattaaatttcagcaccgcgtatcacccgcaaaccgatggacagaccaagcgtctaaatcagatcctagaagatatgctccgtgcctgtgttctagattttgggaagacctgggataagagtctcccctatgccgagttctcctacaataacagctaccaagccagcatacaaatggcaccttatgaagcgttgtatggccgcaaatgccgaacaccactattgtgggaccaagtcggggaaagccaagtgttcgggactgatatcctgagagaagctgaagctaaagtcagatccattcgggataatctaaaggtggcacagtcccagcagaagagttatgcagataaccgacgccgtaacctggaattcgcagtggacgattttgtgtaccttcgggtcacgccattgcggggtgtacacaggttccagacgaaagggaagctcgcacctaggtttgtgggtcctttccgcatcattgctcgacgcggagaagtagcttaccagttggagctgcccacctcattgggcaacgtgcatgatgtgttccatgtgtcgcaactcaagaaatgtcttcgaatgccatccgagcaggccgattcagagcaaattgaagttcgcgaagacttgacctatgtagagaagccggtgaagattctggacaccatggagctgggaattggaccgttcaagtctctaatttttccttaagaagtcaagaacccatttttgtgctttgttcctgcttgttatatggagtttattagagtaaaagctttttcttttccgttggtcgtgtagaagctgcagcttcggaagatccactctacgtggaggctgaagccgacgtttcgaaaagcgagcaaggcaagtcacatcatccttgaacatattgaatcccagtttataaaattattttgatttaaattattgcattatcgctttatttatattcccgcgttatcactgttttatttagccatgcctattcacctttgttatgaccttattattattgttattgttattattaacttgttcaccctag

SEQ ID NO: 74731 - DNA, 1802 bp, Oryza sativa
ctgcaccccccgctctgggcgtccccagccgaagttcccttaggttcctcagagactttgtcaagacggcgtaaagggacattaggttaggtttcaacgctaggtgtctttcgtggtaagggatctctgggtaaaacacttggcgatattgtgcacctgatatcaacattgttgaagtagaggtaatgggagaatcgctacacctctggtcaagaaccaggtagtagtcgtaactcaaccactagaagtgaatgtacgagagatcggtacgattgactggttgagaaccagtgagtaggtgtctctcgatcatttgaagttgtggtgcatggactgctgcgttattgctgtagccgtacctcgaccatctgaggttgcggtgcgagagattgctacgcactggttcgaggaccagcggacaagtagaattatctcttggacaccaatagaggttgcggtttgagagattgctacgcactagttcgaggaccagcgaacgtgtagaattatctctcaaacaccaatgaaggttgaggtgtgggagattgctacgtactggttcgagaaccagcgagcgagtagaatcatctctcgaacaccaatggaagtggcgggagattgctacgtactggttcgagaaccagcgagcaagtagaatcatctctcgaacaccaatggaagtttgcggtgcgggagattgctacgtactggttcgaggaccagtgagcgagtagaatcatctctcgaacaccaatggaagttgcggtgcgggagattgctacgtactggttcgagaaccagcgagcgagtagaatcatctctcgaacaccaatggaggttgcggtgcgggagattgctacgtactggttcgagaaccagcgagcgagtagaatcatctctcgaacaccaatggaagcactagagttggtttattacatgtgtatctcatgtggccagcatgactcacacacccaacttgtagcatatccggatgtccgttcgcaatcatgtcgggtgatcaagccgacaacgttcacgaggaattatccgttaacaacatttttctcaaatagtccagccacggccggcgctatgagataggtcgtcggtctttgttggtaggttgggcgcgacgactctgcatttgtcgagattgttctcaataatgcggtgtacttgatcacaacctacttgagtgctcaattattcctgaaaaatattttctagaagacaagatatatagcagataatatcaagtgtgtactcaaaaaactacatggattttctagcattatcaggatataacgagcatatataaatatcaggcattatgtaaaccgtaaacaagcatgatttatatggaagaaaatagagtgaaccctgtcacgtcccaaaacgactctaaaatatatccttaaaattatgcctagaataattaaaatctgtgtgcaagccttcaacaattaaaatgtgcaaagttaaaagtcaaataaggcttggaggatttttgtatatttcctaaaagcctaaaatgcataaataaattttagtggaattttcagagcacaaataataattgttaagaaataaacaaagttaaaatgattttataaaaagaaaaactctagaaagtcccctatccctccctctccctcttgggccggctcggcccatctctctccccctctctcctctcccccgcggcccatccggcctctccccgcgcgcgccgctgacgggcgggaccgcccgccaccctcgctgacgggtggggcccacccgtcatccccttcctcccgccg

SEQ ID NO: 74732 - DNA, 587 bp, Oryza sativa
atgcagaatgtgcattaaaatccccgtccaggaccggccggggtacacaaacgacaatgttgacattcagatccacgtcttacaaacatcataaaagtcttacataaatgcagcggaaaaaggaagacaacaggagctaagccttgactagaactgcagcgggaacaccactccacaagcaccctcgatggcacggacgaagcctactcctcggagaaacctccatctgacacatactcgaactctggggttgggaaaaaaaatagagcaagactgagtactacccactgtactcagcaagtcataccggaataggggtatgatgcagggaattatcaaaggagagctagagtggttcatttgcataaagcgagcatttataaacagaagttgaaagatttaaacagttgtaataattaattattattaactatccactgtccaacgctatcccacgttacgacaggcccaaccatccacctaaactatccaaattcaaaagattacactagggtgagactaatcacggtgaatctggttgaccgcctataaccacgggaacggctactcgaatagttttactctga

SEQ ID NO: 74733 - DNA, 2079 bp, Oryza sativa
ttcaattgaaagcgatttttgttgtccatccttcctgacaagatgtagtgtacaagtcattctttagttcagcctcgctcacttggtatcacagaagcataacctagacgtaactaattcagtatagaagcaaaaagtgcaacagcaacaacgagggtggaaactagaaagaaggatttattatgttccttagtttattcagtcacgaaagagtgactttaaaaaaatgtacacttcttccaaagtgaaaattatgagatgtcttacttatggaatgctcctacatgctgaggttgttcttgctgacaccctcgtttctatgagaagattaatctaacatagcaagtagatagtttactgcaaacaaaatggataataaacctgatgtttcaaaaaaactagaggaactcatgcatgatgtacccaaaggaaaccggttcttgacacactacaaatctgtggtagttcttttccatctcgaaaacgaatcaaggctgtgtttggaatcagctgttcccaacatgcaaagtgcgcacggaaaacagggcggtccattagagcgtgattagttaagcattagctttttttcaaaaaatggattaatatgatttttaagcaacttttgtatagaaactttttacaaaaaaacacaccgtttagcagtttgaaaagcgtgcgcgcggaatacgatggagatgggttgggaaccctggattccgaacacagcccaagtctatccaaaaagtttagacaagaaaacacgtaacaagttggtttgcaagaatacgaattacgtcaatcctgcactataggtagagcaaaatggtgatttctcgtaaatctctcgaatggtgatttaagaatttagtgcaaacctaactcttgctataaaatcaaatgttcggtaccgcatcaacggaacaataaaaagcacttggcataccataattttgtcattcttgttgaaattttgtaacataaaatgcatgaggccacacgaccttaatgttcaacgtgtcatgcattagtgaaataatagctcacaaaacataacaaatatagctagataacggttgcaatccttaccaaactaacgtataaagcgagcgatgagtcatatcattatctttctagcctgctaaccatcacgtacactttccgatcccaaaaaatgacaacttctatggatgaacctggacaatgtttagggtttagggatgaatctggacaaatgattgtctaggttcatccctagaagtgggtttctccttatgggacggagggagtatatttgatggacacaaaagttactttcgtgatgaaatcaaaggggatttgttgaggcacctaatagaacatatgtccaaatgacatgactcacttggatcctaataggacatgaaagcaaaactagcactccaaagcaaccaatgaggaattgaaagaaaataagtgccatcgcatctataaatagacaatgaaaaccctccccatcgttcacacagttcaagcattatacagtaaaaaagaaagatctagtgtcctgtcgcaatgaagatcattttcatctttgctcttcttgctattgctgcatgcagcgcctctgcgcagtttgatgttttaggtcaaagttataggcaatattagctgcagtcgcctctcctgctacagcaacaggtgcttagcccatataatgagttcgtaaggcagcagtatggcatagcggcaagccccttattgcaatcagctgcgtttcaactgagaaacaaccaagtctggcaacagctcagggtggtggcgcagcagtctcactatcaaggtattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtggttcggaagttaaaaataagctcatatatcatcatatatttcacctgag

SEQ ID NO: 74734 - DNA, 961 bp, Oryza sativa
tgttataatccccttgtactccccttgcatttattctgcacttgtgggtgtgtcttgttgagtacggtggttgtactcagtcttgcacaatttttcccaaacccagaagaggagttcctggaagatgaaggctttggtgtctagctcgtgcctgccgtcaagcgcctgtggtcgtcgccctagtcttccgctatttttcgtttgtcttcatgtgtgctgggccttcgccgcccatgtaataaattaactatttacgcttccgcttgttaaactctgaattgtatcaacttttggtgtaccttgcctcctgggacaaggaataatgcacgcacgtaaggaatgcccgttgggttaattccggtcgtgacaatatgttatctaccctaggtactatggtgcacccagtaccattaccacccttggttgtgtcttgtaatgagttttaacagtatagtggttcggaagttaaaaataagctcagatatcatcatatgtgacatgtgaaactttgggtgatataaatggaaaaaagttgtctttcatatttaaatactatgcctctataaggatatatcctagtacgttgtcgtgactaattaccatcatcggtactctacaattttattgtgtgcttacattcgatccgaagctactttgtttttaagatataaatggagcgtataaaggatgtccgtccttttattccaataagaacaaacacaaagcacatatggcaaatactaaatccactacaacaaaatcatagaccatacaaagcaggtaaagatgtagcaatccacattgattcttcatccactactacaacaagcgcatatgaaaggcggcatatgcatgatcattgtgaatatgacatgcccttgtcgagcaacgtgtcacttcatgcaaatatgttgtttcaagcgacatcaatatatggttacaaaattttaaacattggtat

SEQ ID NO: 74735 - DNA, 18794 bp, Oryza sativa
cctctttcgatccctgaaggggtttttgccttctagatgtctaggggttcaaagaggaccagaggagatatatatgtgtttggatatgttgatatatgagctgatatatgccttactatatatatactccagaattgcactgaggattacatatccaattcagacatgcaaaccttaccagttgcaatattgtaaattacatgtccaattttgtagtttcatcttcctcatcataaaaaaattatgttgtgtcatgtgcatctactttgttttccccatgtcaactagattatttctccaacacatgtggaacagtgtggaaaatacatcctcatcaacagtaataagcacagtgctaacaaattaagaaaaaagtcttttcatgtgttctccaaaaccctaatcacacttgagaaaagagagctgcaacaagaattgatagattgtacgatccatcgccgtcaacaaatgtggaacgaataaaaaatttgctttgggagctcatcacagctaaagtctccagaacaaaaaccgtacatgacattattgcagcacttgatcatatcaaacgtatggaccagaaaggctgcaggcacatgtatgtcatgtgtaagctttttcaaactgagtactgtatctaattaacagcagaaactgaaaggaaatcctatgaattcctcaaagataatatcaattttttaaacgaaagtcagctttatatagactatacaggggttaggaagaaagtctatattcagtacctcgactattcatatagtttgatttccattgctcaacaatattggataaaactcacttgtccattattaaaactatgaaaatgataacttggctaggcttatacgtggctttatgttaatatatatgcttctgggtggcgaaccaaaagaagaagacccattaggttatccatgtagtactatgattctagtcttctaggcatattctccccgcctcaatttttttctgtttaaaaggaaagaggacttgagatgcagagaatgtagcagatgagattgctaagaaaatgatgatgaggcaagccaccttacccaaaactttttacaaaaaagggggatgtcgaagagatgaaaacccaagttctctcctacagctgctcgtggcaccaaaagcctcagggatcgtgttgcgtgacgctaaacaggactagctgtgagcgaggccaaggacctaaccctcaatttaggcgaaccacgccgtgtactcgggacactagctcgaagcaggccttgagcacgctatattaatatggtaggacgtggcacgtctctccctcgtgtcgcacacctgatcttgcatttaatgcgaaggatgcaaatccgatggccacgcgcatggagaggagtggatgacaagacgacgcatgctgaccgtggaacaagcatcatcacccctaaaaagttgggagcgtgggttgtcagctgacataggtccttaacccggtgtactcgttgttagaggccgacgagtgggccaggctagcgccacccttggtttcgtcaccaactcctaggccacgcatcgagaccaggtgcaatgggctagcttgtagttggccacccatcatcgagcgatgggactagcctttcctaactcatgtgtacatgaagcccacttgtaagcgactgcccaatgtggtgcccctcgggctataaggggattcacaccttgaaaacccattaaggatagaaaccctcgcgagctttagagaaagaaacaatgcactttatgcatattgcagtaaataatccagttaagaacttaataggagtaggcttcactgctccctgctattggagctcgggctttgactagggaacattaattatctaagaattttttttttcagaagatcagtgcatttattgagaagaagacaaccattttatataaagcacaatattttattttgagacaatattcctttgactaagaatatctataaaaataagatgttttaaatgaaaatagtcatatattatgatagttgtttaataataaatctagtaacatcaattttatatgattgattttttttatttttatactatttcttgtcaaagttaaaaatatttgacttgacaatattataaaaatacttatattttgagctgaatagaatatttggctaacggggatatgaccatcattcgcaagcagcttacgatataaaatggagagagcatatatatatatatatatatttggtagtgatcattattctcatttggaaagtagtgtgtgaatatttaatactagcctccaagttggtgcagtgacagctagctagcaaatggtgtgaaataaacccacggctgcagttcatgcaccggcggccgccgccgccggcgtgcgagagatcgagccaggcggtgggccccaccgtctcgttgttaagtagctatctcgcacgtgcccgaaattcgatccaaagccgatcgagaagttgatcaagcaagcgaagctggcgattgaccgatcggatcgagtcgtcgtggtcctctggtcggcgacacgtcagctagccacgtcaccggtagtcacgcgcctatcacgggggatgtgggccccacccgctctgccgtccacgtcagcttcagctaccgtcaccggccgttagataactgtccgccgtctgttaatgcgtgattagctgcgttataggttagtgtacactacaccaacagtgtgcgttgttccatctgaacggttgctacggccggctacttggattttggatagtgctattgctataagcctacaatatatagtatcaaatagtatataacacgatgcatgatatatgcatttaaatctcaccaaataatgctataatagtatcgaattaatatatatatgtgtacatatagtagttgcagaaacaacaaatttctatataatagcatctccatccgataatgaccgcattcagttgttcacaacagtgataataaaactaatgattactctggggactagctagtcggagtcgacgttgtgcacgcacgcacgtttagttaattaatcggtcattacgtcacaagccaacaatagaacttactactccgtaaatatgaaaaattgtaatacttcccttttcataaatataaaaaattttggacttctctattcaccctaaaatgtaaggaaattttgagtgctacatttttctaatctatcttggttgttgcatcgctaaacttagataattttcaatcaagcgagctcttaaacatcaaagtagtttttccgcaacattaaactttggcaagcaatccggaatcaaatgtgttaattacttgtgaacatagagagcaatattactacatccgtcttaaaatatactccctccgtttctaaatatttgatgccattgattttttttaaatatgtttgaccgttcgtcttattaaaaataaataaataattattaattttttcctatcatttgattcattgttaattatactttaatgtatacatatagttttacatatttaaaaaaattgaataagacgaacggttaaatatgtgctaaacagtcaacgatgttaaatactactccctccgtattttaatatatgataccgttgactttttgataaacgtttgacctttcgtcttattcaaaaaatttatgtaaatataatttattttattgtaacttgatttatcaacaaatgttcttacataagtatttttatatttgcataaaaattttaaataagacgagtggtcaaacgttggttaaaaagtcaacggcgttatacattaaaattaaaatacggagggagaggaagtataataattttagatatgcacgtgcaggtatatagattttagtacgagaggaatttattatggatgatgatgaaaaagaggggaaaagtagcatggtattacgtggcggtcggcgagcggcgacgttgggccagggccagggcggcgatcgactgactgactggtcgatactcatggttgtgtcgtggtcgtaacttgcgtacaaaagtctgaccgtttacctaagcagctggcactgatggcgccacactgctacactgttatttttctttctttctttctttctttctttctttctttcccacagtttattaggaggagctgcgtaccactggcactgcactatgcatatatactttactaggatatatgtactgctcactcttccgtctcttaatatatatgtattttttatgacttaagatttataccataattaactaaaagaatatcggtgcgtcacaacatgtaaagacatttttttcaatggtacaataactgttaggagctaagaaaaaaattgaaacattacgatcactacacactataattgaaaaaacttaattataagcattgcttggttttgggccgaaagtctgttcattcatttctttttaactaggtgataccccgcgcattgctgcgggaattttaaaaaaatggttacagaaagaataatagtggtacagttatagtatatcacctctaaagcaaataataatactgaaagcttgacctatcaagcttagtgatcaaacgataacattacgatgaagtatcagaaaaatatttaggcagtacatgcaaatcttgtcatgcatcacttttacctaactcaacagatgctaatctacatacatatcatatggaactattgacttacttttcctgtagaatagtacatatatgttcaacgaaaatcatgttaaactcttacgatgattgcattgatatcaaaaggaaagactggttaatgaaaaatgacaaatggtctgtgccaagactgctaaagtaaacaaaattgtctgtcaagcaacctgtaagtgacaaacacgatgagaaaattatatagtgcatttagaaattttactattgctcacacataatttcattaatatatctcggaacagatttgttcaacctcaaagagtgcttgttgtgaatacggttgatatacctattgtaacggagaggctttactgctagtaaaatttcctcgtaaaagaatgagtaacttattgaataattaaagaagactaaactactttttttagagaggaggccatacggcccggatttttttgaaagccacacacggcagagcagaagactaaactattctagaaaataaattagtgaattgaacattgaacaccaaaccgaccgtttcttgtaatgtgtgcgaagaaacagaaaggtaagggagtgattttaccatagtttgcaatagatcttatactgctaaaaaatacaatgtcaattcaaagagggaaaaagaccaatatatttgctatcttcagtggcgagaaaaaaaatcaagtatagacattagagcacacacataaggcgatagaaaaaccaagctcctgtattctttaaaaaaaacacaaaataaattcagttgatattgtagtagtatataagataaaggaaggagttacctgggacaacgattggatcaacgatgacatggcaaatcaatgaaaataacagtggcgaggtgatccagaaatcaggaaagcacaacacatctgtatgttaagaactgcaactgatgaattgcattagcggataatcatgccgatgaaatcatgaaatccattgacaatatgaaatctcgcttttcatagatatgccaatggtgtgaactgtgtgaacaaaaatataaatgggcatatggccacaatagctgaatcaacaggattgaagactcaggcaaaaaaaactactcaaataaatcgacaatattcaaaaagagatgatggaggtcgcaggctcgtagccgaacaggtgcaaagaaggcgagatgctgcacgacacactggcggaaggggatcaggtgcactcgtattaacaaagagaaagaaacggctgagcccctgctggaggaagatgatccgtcggcggcgctgcttcatattctcatgagtcagtgtctgttggggttcaggggcagcggtcgcctgattttgacagtttctaatgtaaatgcttgtgattaagtgaggcgaatgagaagtgattaccatctctgctggtggttgaggatgagggaggggccatttgatttcaccatggatggcgtcagggctcccgacgtttctccccatcggcgcatcgctacatggatcgctccagtcgtttctcccgcgactgaggcgaacgaatgccgcaccactctccccattggcgcatcgctgcatggatcgctcccgatgtttctcccgcgacccaggcgaacggatgccgcaccacacctcgccgtgcactgtccctaccaactcctgcgcgcgaccgtgcgcgccgcaccaggcggttcgccgcactacgccgtcgccgctccgattcaggaagtcgggctcgggaggatgagagagacacatcgaaccctaaatcactcattgggccgcgggctgcgatacactgatatgggtctccttcgctgcctcacgcctgtgaagtccctcgcttcctcacgtctgcgaagtcagccttttcatgaaaacgactgagatgcgatgtaatcatccgatccaacggctgccaattaatgatgacgtggaacactgaggtttgagatttaggagattaattgcacttagtgggggataactttataggaagaagggattagtcccagaacacatgcctcttatctccattcgctcgtcctgcctcccttcggcccaatcgacaagtgaattcgtaggcctagctagcacatgctcccttctctcgttgccaggccagaaccacgcgctacattagcgtcttcaatctccaaaggatagtcctgtgctcctatcctccccatcaaatataatcgaatcttcctcatatctcgaaattggttgagggttctcctctttcagtccccccaaaccggagtgaatctgcattcaatttcgcaaaactctaggataaaaaggatcaggtaagctattggttggtcattgttggcgaccgttaaatagagattaaggctgacgaattaaagccaaattaaaaggaaaaatcatgaggaaaatgatgagggaggagtggggaatcgatttttaaaagcacatagagggcagaccgacgtgacgacggcgctagtgttccaccaggagagaagagcggggcatcatttgaaggcacgcactgcgaagcaggccgagacgagtgatggctaggccgagctctaacgaactgactgagagacgacgacggacagaaaaaagagctacagaagccttacatatttttaattaggtatggatataaatataaacatttttaggcgtgtaatgattctaatgcatagaaatataagcatttttcaacaatcagaagctcataaagataagaaattcaaaattctgaatttctaccagttacgcgattggaagaaatatttttattcatctttaatctttgttcaacaatctagaaatacttattttagaacgacagggggagtcgtttttgttctgtgtatgatatttatgcttttctacacgttcctgaaaggatggaccatagttccagcgacttaaattcattcggcccatcaaactgcgacccaaatacggcctactaaactctgcacaaaaggccttagaatcgagcccagataattaattaagcctatcaccgaagcaaattagaattttattaatttattttttaaaaaaagatttacactcctcccagacaatcttttaaaaaataaatataaataaatttcagcaaattaaggtcgagagatcacctctcactagttagcaagtcctacctatgcggccatccaagcacaagcttcttccatccaatcaaaaacaaaaacaagatggatggtcatcttccttccatgcatgggagcatccaaattaatctaccaagaacaccctataatatatatgcatcgccatgatcgaagcgaggaagaagaagaagaagaagctgcagttgcagcagcagcagcagcaactagtaactaataaagtgatgacgatggatcgtcccaacgtcgccgtggccgcggtggggctgctagtggcggcggtggcggcgacgctgccggcgccgtcgtgggggcagcagcagccagccaacaagctcatcaccagcacctccggctccggcaaagggttgtccaagtggctggcgatgaaccaggaggagtacgtggagaagaaggcgctgcacaccatggccaccgcggaggagctcggcgggaagaagctggacgcgaacctgacggcggcggaggaggccaaggtgacgtgggtgatcgaccccaaggggacgccgggcgacaccaccttcaccaccatcacggcggcgctggagaaggtccccgaggggaacaagaagcgcgtcatcctcgacctcaagcccggcgccgagttccgggagaagatcttcctcaacctcagcaagcccttcatcaccttcaagtccgaccccaagaacccggcggtgatcgcctggagcgacacggcggcgaccaggggcaaggacggcaagcccgtcggcaccgtggggagcaccaccgtcgccatcgagtccgactacttcgtggcgcatggcgtcgtgttcaagaacgacgcgccgatggccaagcccggcgccgagggcggccaggcggtggcgctccgcctcttcggcaccaaggcggccatctacaactgcaccatcgacggcggccaggacacgctgtacgaccacaagggcctccactacatcaaggattgcctcatcatgggcagcgtcgacttcatcttcgggttcgggagatcgtactacgagggctgcaccatcgtctccgtcaccaaggaggtgtccgtgctgacggcgcagcagaggagcaagaccatcgagggcgccctcgagagcggcttctccttcaagaactgcagcatcaagggagaagggcagatctacctggggcgagcatggggggaatcgtcgcgggtggtgtacgcctacaccgacatgtccaaggaggtggtgcccgtgggttgggacggctggaacatcgccaagccggagagcagcgggatctactacggcgagttcaagtgcaccggccccggctccgacgccaagaagagggtgggttgggcgctcgacctcaccgaggagcaggccaagcccttcatcggcacgcactacatctacggcgactcctggctcatcccaccagagtaattaattactacttttgtttttacatcgattaattaattaacactctctctttttcatattatgaatcgctttgatttcttttgcatttttttcaagtttaaccaaattttattggaaaacatatcaacacaattttttaagaaaagaacaaacatattataaaaatatattcaactttacatttagttaaactattttttaaaaatgctgctaaattttttgaaaaaaaattgatcaaatataaataagtttgacaaaaaaaatcaaaacaaagttacattttatatgaaatggaaggtgtaatcaattaattatgctagtacaaattaatatattctaattgttggtgtaacatcaaatagcgggacatcaacgtcatctagctcagcttcaacgtcgagcaactcaaccgcggaagcaccgacggcgagtagtaactcaactgcatcggctaataaaaaggaaagcaattcaactgcagaagcgccgacggcgactagctactcaactgcgtcagcgacgacgagtaattccactgcgtcagcgaaggcgactaattactcgagttcaagtccaccggcaaaaggcaagtagttaatacaagtgcagcggcgacgacggcgccgacgcgatgaatcgcgttcattggggccaaccaattctgttttggaagcccgtttaattgttcattctttgtgtcaatttgggccggattaatcaatcggccggctacttagatgtttcacgtacgtgtaacagttgtattttcttcccatttcgtttgggtcttttatcagtgtacgcatcttcaaaactatagtgaattttacacatgttttccttttgaaaatgactcttgaagacttgtgctctatacttatgttgcaattaactttcgggaacgaaaacgatcaacagaataggcatcttaccgtgattaaaacgggggtaacaagtacatcccacttgttccatggctaataagtcgtgcaaaggtaaggagcttattaactggttagatttcttgtgatggaaccaatccacccgagttcaatgtcaatacaagtaccgaaaagaacgtgtttgcctattgcaatatcgtgtacgtggggataagattgctcactaggtaggcacacagttattctttgcacctctgtctcattaagtttctctagatttcagcattcaaactgtgatttaaacttttaagcacatttgctagaagcaacattgaagccttgatggtgtggtacgtacatttgtttgcagaagacgataatttcttatttgggggggtgtttggacgatccaggggctaaactttaatccctgtcatatcggatgaatttggaatattaaacaaagactacttataaaactaattacataaataagagctaattcacgtgataaatttttttaagcctaattaatccataattagcgtatgtttactgtagcatcacgtaggctaatcatggattaattagtctcaatagattcgtctcgcgaattagtccagggttatagaatgggttttatcaataatctacgtttaatatttataattagtgtccaaacatccaatgtgataaggattaaaaagttttagttctatccaaacagggcctaggctagcaacagcgcctgcgcataagttgagaacatgctagaagaagctcggttccagtttgcaatgggcaaaagaaaaaaaatattataatatatcataacaaaatattttttatcaaatatgtacttaattgtttgcttattttaagatctgttaccacttgtttaaataaaatgttggactattaattccataatattcgaaaataaaaagaagacaaattataaaaactgcaagagcaatagtgggtggcatattccccaccaaaggcttttaaagtagttagattgttttcctttcattcagttactgtattaattgtgtgtatatactccaatgtacgatagtataatttagtgatcagtagtacactacaagtacatagtttttttttctgaggattttatgttcataatatatagtactttctgtgtatgatatttatgcattttgacacgttccagaaaaggctggatcataatagctaattttagccccacaaatacactcttacttgctccatatttcagaatttaagatgttttggttttgtcagaaatcaaatttattcaagtttgatcaggtttataaaataatgtattccatattcatttctcgttggcatgttcgaaattacttcaatgagatgttttctttgtctaccttttatcaatgcagtaatattattctcaccagaaaaatataatgtttgctttaagaaaagttattaggatgtaataattagtgtagcaatataatttgccgcatattctattttagtgcatgtgagatttgttacagcaacaaagtagattgaaatgggaaacggatcgagtagtaacatatagaacgccaaattaattttattaaatctagctaccatgaaatgtatttttataataggttttcttttttacaaatattgctatgttttttattaaattaacttggttaaacatcttacattagggaatatagagtaccagcgaccaaaattgggcgcatcaaatgaactgcgacccaaaatgcaacctctaaatcctgcacaaaaggccttaaaatcgagccaagatatcatcgaagcaaattaaggtcgagagatcgccggtcaccaaattagcaagaagtgcttgctacctatccggccatccaagcacgaacattttccccaaaaatggatggccagccatgtcccttccatccatggaagttccaaattaatccgccaagatcgatcaccctatatacgcatcgcgccatgatgggcagggacagaacgaattagctgcatactgcagcaactaataaacgatggatcgtcccaacctcgccgtggccgtggtggggctactggcggtggtggcggcgacgctgccggcgccgtcatggcagttcttcgacctattcctccccgccggccccagccaccgctcctccggcggagggtttggcaagtgggtgctgatgaaccacgaggagtacgtcgagaagaagtcgctgtacgccatgaaggccgccggcgacatcggcgggaagaccatcgacgcgagcctctcggcggcggaggaggccaaggtgacgtgggtggttgaccccaaggggacgccgggcgacaccaccttcaccaccatcgcggcggcgctcgagaaggtccccgaggggaacaccaagcgcgtcatcctcgacctcaagcccggcgccgagttccgggagaagctcctcctcaacatcactaagccctacatcaccttcaagtccgaccctgccaacccggcggtgatcgcctggaacgacatggctgccaccaggggcaaggacggcaagcccgtcggcaccgtcgggagcaccaccgtcgccgtcgagtccgactacttcatggcctacggcgtcgtcttcaagaacgacgcgccgctggccaagccgggtgccgagggtggccaggcggtggcgctccgcctgttcggcaccaaggcagccatctacaactgcaccatcgacggcgggcaggacaccctatacgatcacaagggactccactacatcaaggatagcctcatcatgggcagcgtcgacttcatctttggattcgggagatcactctacgagggctgcaccatcgtctccgtcaccaaggaggtgtccgtgctgacggcgcagcagaggaccaagaccatcgagggcgccatagaaagtggcttctccttcaagaactgcagcatcaaaggacaagggcagatctacctcggccgggcatggggggattcgtcgcgggtggtgtactcctacacggacatgtccaaggaggtggtgccgatagggtgggatggctggaacatcgccaagccggagagcagcgggatctactacggcgagttcaagtgcaccggccccggctccgacgccaagaagagggtgggttgggcgcttgacctcaccgcggatcaggccaagcccttcatcggcacgcactacatctatggcgactcatggatcctcccgccaccagagtaattactcctctctccatttcaaaacatagggcgtattttgtgttgttaggagataagggtttaaccaatgattgcttctccaatatattatatttgtgccgcaaaagtataatacttttgaagacgaatctaaataatatttcttatgcttcacaaaagttatattataaaagagtaatggtctatagaaaacagagtagtggttggttaaaatcttgttctaacaaagtaaaataaaccctataacgtgaaacatagggagtactatttttacattaactttctttggtatttcgattttggggtaacatcgaatagcgggaaatcagcggcatctacctcgacggcgagtaaatcaaccgcatcggcgatacccaggaactcaactgcaccggcgacggcaacggaaagtaactcaactgcaccggcgacacccagcaactcaactgcaccggtgacggcaagtaattcaactgcaccggcgacggcgagtagttcaaacccacctgccacgaagagttactcgggtccaccggcgacgccaagtgcttcaagcacaccggcaaaggcgagtagataagtgcagcggcggcgcggtgagtcacaacttcatctacggcaattgaaggatcctcccgccaccaaagtgattcaaatatttcggagtaactattaccaatttaattgggcccaatcaattctgttttggaggcccgtttgttctttgtgttgtgttaattgggccggattggtcggccggccacatagatgtgtaacatttgtatttttttcccaattcatttttggtcttctatcagtgtacgcaccttcaaaatggtgaatttttacagaagtttttgaagaagacttgtgctctgtatgcgtggcaatttactttaacgatcgacacgacggcatctaattctgacgaaaacgagagataaccaatacatacacatagtattaggctatgttcggcaccctgggttgggaacccatgtcccacgcacaaaaaagatagcgatccattagcgtgtatttaattaagtattagctttttttttcaaaaatagatcaatatgatttttttaagcaactttcgtattgaaactttttataaaaaaaatatactatttagcagtttgaaagacgtgtgcgcgaaaaacgagagggggagttgggaacctggggcaaagaacaaagcctagtaaagctagcagttcgtacaagagtgtggtaattgtgaattatccagggtctgcataaaatcgagtttaattcttcgtgtggttctgataagttccttgctgtacagtgtataatttggtttttagagaacgacaaatggataaacagcgtgttctagaactgtacatagaacagtgactcaaattaaggatgagaaatgggtggatcagggacgacacatgctatacatctctccaaattgttatccatttcgtctgtgttcagcatcagttggcctaattaaaactgataatcaacaactttaaaaaataacttatggcttatatatatataatcctgagcgatttaatgccaatacgaaccccaaaaaatcaattgaaaaactaaaataaaagttccaattttaacaatggcttatatttaagcaatcggtgcttctcttgctacacatttataggagtagagtatggattttgcagtgacaattaaagccaaacacacaaaattcacgataaaattaagaaaaccacacaaaaaaaaagtgagccatgcatagcgagagccaagtggcaatcctctagtacactcgcagctgtggcccccgcaaaatctgccacgagccaccaaaccccgccacgtgtcgaggtgggccccaccaacgaccggactactcccgcctcctcatccggttcccgccactcctatttatttcccaaaaaaataataaaaacaaaattcgacgaagaaaaaaaaaataaaattcggcggtaaataagcggggcgaaggaagaagaaaatcacggaaatgccactaccggcgttcgtggcggcggcggcgaggctcgccgtcctcgtggccgcggcggcgacggcggccaatgccgcctcctacgcgcggtaccggcggcgccacctccgccgcatccccagccccatcgacgagtccgccgatcccctcgccgacttccgcgcctttccctcctccgacgctgacgactcaggttcgtctcactcactttcgtttccctctgtaaagccctagccatgtaagcgctaatcgttgaggtcaatggattattgcattggggttgggagattatgtatttgattagtctttgtggatgcccagttgggaggttttaggttttatcaatttttgagatggggaattgttggcataatcgatttgaatttaatcaattaatccttatattcaattagttttttgatcaattagtcaatgtcaatacgagagtactgaaaagaactttgtttgcccattgcaaatgtcctgttacatcatacatggggataagattactcactataggcacagttatgctttgcacctctctctcattaattttctctataaattcgagcattcaaactgtgttttaacatttaaggccatcactggctggaagcaacaattgtcaaggcaatatggaagccctgatggtgtggcatatttgtttgcagaggaggataatttcttctttgggctagcaacagcgcctgcgcatgttgaggacaggctagaagatgcttggctccagtttgcaactgaaacttcctgcgatgacaatggaaacgtgcgcgaccagaggccagtagatgcactgatggcatctgctgctggtgatggaggctcccagcaatcttggaggtcaacaggtggggaaaatattggtgatagagagcagaggaaaccacttagggtagccatggaggctatgctcagggggtttgaaattcttgctgagagtggagaatctgctggcggcgataactgcagccacaatgttgctgcttggcataatgttccatgcccgtaagtacatgagtatagaatctctaatgagctaatttatctcagttctgtactccaaagaacaaatctccttgcctgtaaagtcacctagagtcacttctcatcttaactatctctccaggaagagttgttgtctttcaatattgtagcttctttccaagtctagatatgacttcgatagtgctactatgtagtggtgggtcccaaggataaaaaacgaatgcatgcttttaaaaaaagtaattcaagattctagctttccttccaaatgtagatgtctttggatgttgtatgttagcaaactctgatcatttttttttcaggcaagaaaggcttagattttggtctgatcctgatgctgagttgaaacttgctaaggagaccggcatcagcgttttccgcatgggggtagattgggcaaggttaatgcctgaggaaccaaccgaagaattgaagagctcagtaagttcatagttatgcacgtgcctctttttacctttatattcatccttctttttccagcatgatgatctcagtaccggtgaaataagatagacatctctttctctaggttaattttgcagcacttgagcggtatagatggatcattcaaagggttcgcgaatatggaatgaaagtaatgcttactctgtttcatcactcacttccaccttgggctggaaaatatggcgggtggaagatggaaaaaactgtcacctatttcatggattttgtgaggtaccttttgagggcagtcaaattgacctgccaatacattctctccattgggaattgttcaataatttattagattttgatagttggggctgtgcaggcttgttgttgatcgtgtatccaatttagtggactactgggtgattttcaatgaacctcacgtttttgtgatgctaacttattgtgccggtgcttggcctggtggagaccctaatgcaattgaagtagcaacatctactctgccaactggtgtatacaatcaggctttgcattggatggctattgcacattctgaagcctatgactacatacattcgaaaaggttggttctacataatgtattatttgcagtgcccttattccagtgattacctggtattttttattcgataatcaaggagttggtttcctctggttttcttattatttatttcttgattaacagcaagaacgaaaggaagccaatagttggtgttgcacaccatgtatcgtttacaaggccatatgggctatttgatgttgctgctgtcgcgctagctaactcattgaccctttttccttacgtggatagcatatgtgataaattggacttcattggaatcaactactatggacaggtaagcaaattatttgctgcttaatgaatggctatgtaagtgaccgagttaattctcccatttccatgcaggaggttatatcaggacctggtctaaagcttgtggataatgatgagtatagtgaatctggtcgtggggtttatcctgatgggctgttccgcatcctgattcaattcaatgaacgatataagagattaaatataccttttgtcattactgaaaatggagtttctgatgagactgatctgatacggaaaccatatatactggaacacttgttagccacatacgctgccatcattatggtcctttcttaacctttaagcaaacatgttttagtctgtgctcatggagatggaacttccaacacttaaacaacataatgttttatagggtgtccgtgtacttggttatttgttttggacaacatcagataattgggaatgggcggatggctatggtcccaagtttgggcttgttgctgttgaccgtgctaataacctagcacggaaacctcggccttcatactttttattctccagggtaactttttcgttttagcaaatcatgaaaccatggtacattgtttacctattatctcagtctcttacgttgtctaactcctaggtgaatttttgtcttctgttgaaatattgaaaactaactagatctactccttgtttctgaagtttaaagttcattcattttcttttatcagagtaattttatggctagataaagcactaaacgtgtctagacctgagattacctccagcattttttttgccactttttacgttcatgcatgtggtggctatataactagcatgataagatgcatctgaactccaggttgttacaactggaaaaattacaagacaggacagaatgtctgcttggagggagctgcaacaagctgcagttcaaaagaaaacacgtccatttttcagggcagtggataagcatggtcggatgtatgcaggtatgtattgttt

SEQ ID NO: 74736 - DNA, 6630 bp, Oryza sativa
cccttacatatgtaatttatatgaatttacaatgtaaatatatggtgactattttttggtaaaaaatatagcgccataaatatagctactactaaaaaaatagagatttcttagagttgttaagagggtaagtttgcttacatggaaaagagagaaagataatggcgacatcgactcatagcaatttataaaaggaaactatttgttgaaggaaacttagcattctccgtagccatattttaatcggctatttctcaatcctttaaagatgagttactcgtgaaggattgtggatgtctgaatctgtagtagcgactactactcatagctagcttgctgagtactgactagtataggcctgtttagttcccacataaaaacttttcatcctgccacattgaatgtttggacacatggagtattaaatataaaaaaaggtgtaaaatacaagacgaatcttttaagcctaattacgccataatttaacaatgtggtgctacagtaaacatttgctaatgatggattaattagtcttaataaattcatctcgcaatttatagacagaatttgtaatttgttttgttattagactacgtttaataatttaaatgtgtatgtgtccatatatatgatgtgatatgccaaaacttttcatctctggatgtaaaattgtaaacacagccatatacaatgtgtcgttgcctgcatgcacgcagatcctggatggtcgcggcaaggaggagaagaagaagcgcgtgggattcatcctcctcctgtccgacggagtggatcagttccaatactcgaggatcaattgggagaaggtggcgaagagcaccgacgtcgaccactccgaagttggcgccatgctccgcaagtacgcggtgcacacgttcggcttcagcgcgtcccacgaccccgtgccactgagacagatctccgcgctctcctacggcctctactccttcgtctgcaagaacctcgacaacatcacagaggccttcgcccgctgcctaggaggcctccgcacggtcgtcgccgccgaaatccgcgtcgatctcaagcccaaaagcagtgataagcagcagcagcagcagccggtgctcatcaagagcatcgattctgggggctatgagagtcaagtcatcggcggcggaacctccggcaagatcctcatcccggtactctacgtcgacgaggtgaagaagttcatcgtccacctgaaggtgcccaaggtgtcggccaccaccgtcaataaccagcaggagattctcacagccgacggcgacgccaactcggtggacgggaagacagtccgcattaaggaacacaaactggccatccggaggccgccagaggtcgtcgaccaggccgacctccggccagcaccacaggtcgtggagcaggtggtggtgttcaagctgctggacatggtacccaagacgttccagcagcgtagagaagatgatcacaagggcgtgaagaataccaaggtggccgtgcagctgctgcagcggaacatggacgagataaggcgctccgatgcctggacagacctggatgtgggcacgaggcgacgcatcgacgaacaggtgaaagagattgcggaccacgttgagaaaggagaagggccagcctatgtcaactcgtgggtgtcgagccaggagatgcagcgcgccaacaccatgggctcgcccaacaaggtggtggccggccgagttcgcgacgccggcgatgaagacaatagtggaggaggtgaaaaagccactggaggagaagatcgttgagggtgagcccagcacgcctaccagtaccaagactacaccttcttcagctgatccaaatccagctccggctcatccggctcccactcctatcaaacaatattctccacgtcctgatgaaaaaccagctgattatccgaaatctggtcagaatccacgtccggtggtcctgccttctgaagatctagctccgattcagcctccggtactttcttctaaacaagtcgtaccagctcatgtggtcgtccctccaagctgttcagaggaaattagcttgaggtgcccgcagtgcgtggagttggactttgtcgacgagcacctcgcttactggtccaacgtgaaacgcgacctgctgcgcgtgctagacgacgcggaagccgccgcagggctccgccacggcgtggcatgcttccatgacctgtcgctcggagccatcaaccaagccatgtatcagagcgtgtgccaggtaattcctccgtgtcccacggtacctgtctttctagcattaaaagataccattttcaattcaaatttcttcctatatattctactctcaaccaccatcccatatctaactatacattatttattaagagtactatagttcttttctttgaaccttaatgcatgctaaataatctagaaaaacaagtattctgaaatggatatagcatgtactctctctgtctaaaaaaaccaatctagtattaggatgtgacaatgaatctggacatagattagtatgtccatattcattgtatcgagatgtgtcatgtctaataataggttggctttcattttttaggaccgaggaagtactacgcaatccatagtagtagtatcttgcatatatagcttaacctgactttgtgtgtaggccgtcgagcaagcccggagcctgagcaagtactagcgagctgccatgccagccacatatatgcactcatgctgcaaggaagaatctcagcaaggacgactactaccatcatccatccacattaattatctagcctacttgctcccttccggttgataatatacgttgtggacaaggtctatttgtaaactttcactattaataacgactaaaatatatttgagttagaaatatgtatgtacgtacgtacgtatacagattactcttaaaaatacttcatccgttttacaatgcaagtcattctgtcataaatataaatgtgcattgtaaaacggagggagtactttaataaaattatatatttattggtgtttctataaactgtaaaaatgtttgtgctttgcacgcaaccgataacggtggagaatcataaaaatcgacataagcactaaggctacatccttttctgcgttttcgaaggagctaccttttcgttctctgtgaccatattttccaaactgttaaattgtatgttttgtgtaaaaaaatacatatgtttcttcaaaaagtcaaataaatatgtactttaattaatacttaattaattatatgctaatagtttttctcatttcacataaaattctcgctattctgctagcttgaacggaacctaagaatttggtgttggcgaaactacatgtttacatgtaactacatgtttacatgtttgggatcgtgacatcaccttgtttatgtgtagtatttgggtgtaatggatcttgtagcgttgactcgatcgtatagttagctatcacgtcgcactcactttatttcgcccctcgcctcgccactgctcgagcgaggtgccggcaaagctggaggctcatcaggactacggcggcggggctcgcagctcccacctctccagatctagacgggcggatctcaagttagaggtcgacggcgacacttcggcagtgggcagagaaggccgacgcttgggagcaaggcggcggctcgcggccgggtcacacggccagatccggtgaggggctgcgacgagaggggagaggctgcggctggacggcgggtggcgtcgaggaggacgcatgcgacgggtggccggcggcggcattgacggtgatggcttcatggcggtggtggtggaggacgcggatccgacacagtcgcgccagatctggctccaggtctggccccggcatggaactagtcgatgacggcgcgacagcatcggcgatgacataagcaatgggaggacggtgccgcagggtaggctggagcggtgatggatggcacaggcggcggggaaggggccgtgcaggcggtgtgcggccagtgtccctttggccagatccggtctctctctctctctccctctctctttctctctctctctctgccctggcctagtgtcggcccagcttcgtcattgtccttgagcgcggccgcaccgcgtgtaggacgggtgcgaaacaggagggtgaggcagcagccggtggtgtgcgaggtggcggccggcgaagcatgagcgtggctttgaccagagcgacgcatggacatggccagtggtggtctacatgaggaggacgctagcgtgactcgcgcttggtcactcgggtgctagcggtggtggtccaacgatggttgttgtgcatgatggttgtgtggggttttgattgggactcattggtaaaagccttgctaggccatgggccagcatgactacgacgacgccattaggtgtcgtttcccttcttggaggcgtcgttctggcattgacctctcgtagcagcaagaaccttccgcgtgcaacgatagcattggtggactcctgcaatgcctctgatcccctacaagcctagggtgtttgacgaggccttcgctgccttggttctgttccttgctctacggcgggtgttcatcattcttatttgtgtactgctgggtagagtcggagctgcttcgttgtaggggtgcgacaaaacttggcaacggtgacacactccaatctttttataggattgttgatgctagctgcgtgcaggaactggttccttggtagcttaggctgatgtccttcatcgatatcgtttatgtttgctccttttggagttggggtagcatcgtagtgaagtcgaaactgctgtgtcgcttgggtggcaagcttggcaacgataacatgtgtgggctattgtgtcacctatatgttaagcttggccagagtcttgtgtcgggctccatcgtggtaccttaggttaggttagctgttggtgtggtgttgtaattgtggttttcgcttagttttcccaaattaactaggcactgtaagatttggtctcatttacttcttaaaatgggacatgcgtcttcttctaaatataaaacgtcggcaatagcttgaccgtttaaaaaatattaatttaaggatcctaaaattaaggaggaagggaaaatactataacaccccttattaaattaaaggtctgttgagagtgggaaggtggttggagtatgattgggtaaaaaaataaataagagatagttggatgggataggtagtgctctaaaatccctgtttttttttataaaatttgaatactcagatttatgggatggaggaaatataagtaaatataagtttatctttcgttagatgaagtagtgctattaagcatatttttaatagaaaatatcaccaaccaatatatcctaaaatatagaaagacatatgtatacagtatataagaaaaagatgttacttaaagttagaaactccaaaaataagatatcctaaatattctaaaaaataaacaaatacaacacaaatgatatatagtttcgtagaaacaactctattagtgcgacactatattttctcatagatttaaaactgcgtgatttcgagtaattttagttcagaaaattatatttagaatagagtaaaaaataattcaataaaaatgcatccacacataaataggtatctgccaatgtgaacgggctaccttttaattttctctctacttgcatcgtgtgattacattgtatctatgtactagctagtatgcactggtggataaggggtttttactcccggttcgtaacccccatgtagtcctggttttccaaccgggactacgaatccgggactaaagatcgttatctttagtcccgggtaaaaaaaccgggagtaaaaatccatttttagtcccggttggtgttaccaaccgggactaaagattatctatcttaccaaccgggactaaaaagactagatccggttgctctttattattttcttttcttcattgtttttaatatatattgatttcaccccatcccatccccaaaatcccaaatcaatcatcctcaaattgcctccaaatccacaatcgatcatctcaaatactcaaatacatcacaaaatctcaaaaaaaaaaatacatcaagcataacaaaatacatccccaatacatccacatccacaatccacaaatcaatcacaatccacaaattaatcacaaaatcatccctaaatcaaccaacaaaatgctccaccaaaatatacaaatcattcaaaaaaattcgcagtcgccgccgcccggccgtgggccgccggccgccttgcgcctgactgccgcgcgggtcaccgccgcccggccgccacccaccgccttgcgcccggccaccaccgcccgccgccttgcggccagccctccgcgctggcctccgccgccgccgccgcgctagcctccgccgccgctgcttggggcggccctccgcatgcgacggccgccgccctctgccaccgccacccggccgcctcccctcccggatccgacgaaggggaggccaccgccgccgcctggccgcctcccgccgccggaggggagccggaggggaggggaggggggagagaatgagggggaggagagggttgagaggaga

SEQ ID NO: 74737 - DNA, 7841 bp, Oryza sativa
acgtgttgtcggagtcgtccgtcaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaagggaaccagcaggggcacgtggaaagggatgtggaggggaaccaggaggaggaggctagtgatagtcaaccctccgttggacagaagagggcacgcgggcaacgaggtgcagcgaagaagcttgagggtcggcacatcataacggaagtgcaagaagatggacgtcctagtgccccggccgaagcagccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcttataagacaggtgaacaagggcaggcgatgatggaaagaaacaaagaaaatgccgccaagaagaagtaccatcaccacttggggtcaggaggctatagcgtcgcgatgccaaagtgggaggagatggaggctagcttgattgagaggggtatcgaaacggcaacagccaattggccggaacgatcgaagttctggtactatgctcacggtggaacgctcaacccagctgatggctcactggtcttcggcgatcagatacgagaggctgcacgacgactaacagatgcagtggaagcctcctctcagggcacgttccgaccagacagagatagggacgagctgacactcgccctacagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtaagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttccagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctggtcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccattgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattgtactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgtggcaaatggagagaaagacttaggcggaagttcaaatttcctgttagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatataaaccatgcagcaacagggccatgaaaaaaaaaaaggtcagctcgatctttagtcccggttggtgttaccaaccgggactaaagatcgatctttactcccggttatttcaaccgggactaaagatagcgatctttagtcccagattggtactcccggtttggaaaccgggactaaaggggggttacgaaccgggactacaaagggtttctccaccagtgcttatagcttcatagtggtagtgctagggatttaaaatttaaaatatgtagttttgtgacaacctcaatattaaatatgtagttttataatgtttggccttaaatatgtaattttaggatgaatttatcgctaatatatagttttgtgataaatttaccattaaatctgtagttttatactggtaattttataaaatttactcttaaaaaacagtgggatccacgtgatactgtgaccggcggcgagagacggctgccgctgcccagatagcccatcttcaatcataccattgcactagaaattcaaacaaagattgaaaactctgtcggcttctttttttttttgaaaaaaaagaagaaaatatgtcatttgtctttctgacacaggattgtataatgtatagagaaacatagttgccgtcacttgtgtatcgataatccctggtggaccatgaatacgaacaggacgacgcgtacagggtacagcaataatcatcgatcatcaacccaacaagacaacatggttgctgtatcttgagacaccaatctgaataatagacaggacatcgcgccagctcttcggaagttgcctttatttaatttgcactaatccatcgctacaatgatacaatctcatgttactgttcatcctacacagataaggatgtactcatgtaggttgagaactatattgagatagtgcttgctcacttttgtcaatatgatgcatacaatttgcaagaagtacgtgagcactcactttattatgctacagaaccaattttgcaatgtacttacacaacagtaccaagacaatgccctgtgaatatgcagttttttttaagctaatgaaagttttaattgaactcagttcgtcaagttgatacaactgtactgagaatactcccaaccatattatctctgaaacttcaaggtgaatatgcagctgtaatggtaattatctccgaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgccgttcccttccaaattcgatcgatcctttccgtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttccttctcgtcgccggccgccgtgggccttcgccgccgcctcttagcccctttaaaaggacccccgagctcttctctaccagtcgcctccctcgccttcgcctctcgtcgtcggaaacgctctagcgccgtgtagcctcgagccgccgtcgccgccgttgctccagccgagcgccgccgccattccagacgtcgccgttgctcgggaagaccgccgtcgtggtcgccaagccgtcgccgtccttgtccgccccttcgccgtcgccgaagatcgccggagcaccatcgccgccgtcgacccgaagaccgccgccgttttaacctcgtcgccgtcgccgtccgttggtcttccgccgctcttttggtcaccggtgagttcgccgcgtcgcgctctacccgttggtgtcctccgttcgtgccgaagcgtcgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatcaagtctgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttctttgtgtaacaccttgcctgtaatgattaggatgaagcctggtataaatctaaccagggctaacgtgccatctctaagagataacacgctagctccggcttgagacgagttgccttga

SEQ ID NO: 74738 - DNA, 1755 bp, Oryza sativa
catccagttgatccgtcgaaaccgtgccgagtggttggaggatgacgccgacttccctgaagctaggcgaaatcggtgttgaagccgacttccgcctaggcctacgggatggagacgctgtcgtgatggagatggccgccaaatcgtcggggagcttcatcaggattggtgggtaagccccatcatcttgatctggtgtcgttggagaagatgcgatcttgcccgagtggtttgaagccgactcgattgagatggtcttgaagtaactttcagccgcgtttgggagtccaaacgggactgaaatccggttctctcccgactggtttgactccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatgtgcccctagaggcacccggaccccccttatatatgggaaagagtccgtgttacaaaagataatctatatccctaacggaatatgcaaatacagatcaaatacagtcgtagccgactaagtctcaaggtatttccttggtgtacaagttgagaaacaaacccgagacacaaataagatattctatctatattcggtatcctatattcagcccaaatatcatcgccgtgtagatatgggatatccataatctccacagtagcccccgagacctttgcagtcaaccatcatagccttctcaaagataataatctgagtgcttcaaacctttcatgccaagatctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcggcgcctaaagaggcattctagccgactgctttttagccataataaaagaaatccgagtggttaacactataaaaggttcacgaatgaacacacttgacaggcatccgaataaaaaactctaaagattacccaccaagtattataaaaattatggtaatgaataagtctaatagcctaggctatgactatttaccataatgaaaacaggcatataacataccaaggaaatgactatggtaaaaacaagtcattccaagttaacccagacagcttttgtagcctaataaagctgacaaaaacagtataacacctttctgtcgggcaccttttaatttgcattgcaataattccaaagaattatatgaccgcataaaaaggattttatcagcattgggcaacactattgtgcgcataaattgccaaagcaaaaaatgcctaagtccctaaggaacacaatgggccacgctgttaaaaatactgagctgaggtactgttcaggcctaagcccatttgcacctccgatacccttaacaagaaatcccgagatccaagcgtcactt

SEQ ID NO: 74739 - DNA, 1870 bp, Oryza sativa
tgataattcaaactccagtaagtccaaatcatattttggacaaaagcaagcaaacagcacatgtgcacatgtgcacctaaagacaaaggaaatgcatccatataaacatttggcaaaattttccaaacaaactctgccaaagagaaaatcagaatatatctcatttgttggcttaaaaccttatagtatgtagacaccgcatggccaaaaaatgatgatgtaaatatcttgataaaaataaaaatatagcaatcagtactttagatatatactttaattgactagaaatcaggtataattttattattaaggcccactgcagtaatggattccattactgttgtccttatcagcagattattaaagtttggtaggaaaggtatgtagaacaaagtagatcacctaaacctttaaaggaattttttttacaataaaaagcagagacactgagaaagcacaaggtaaaaccagtgataaatcaacccagtggattatctgaaattttcttcctatggcaataagtgatgtggaattgtggatagtctgagaattcactaaaacagcatgacttattctgtagatttaattacagctttccaatttactgaagtaggtccctaaccagttaaacaaaaatatctagagaaacgttttatggaaaggagttgaactatttggctggatacattaattagcagcaagaatatgtgcaatcaattactagtaaataagaatgctaagcatccttgacagcttgacctgtatcactcaacataagtatggtcaatgaacactcaataaaaatgaattgaagcccatgtggaagtgaacatgcatgatggttttcgaacacgtattagatggaggttacctaggggttcaggtgatataatgtagatattggaccacacagtattttttttattccaagtggaaattttgtttgtccctatgtgattaacatataattgagtgagagatgcactttctgtaaaagtacaccatatttttaccataggcatagttttaggcccatgaaattgtagcgggcccagtggctaaattggttgtgcagagaaaggaaatctagatctgaacagcaaattctatttaacagatcgattcattcagtttcaccagaagacacactgacacacaggtaataccagctgggttaattaagaacgtcaatactagaaatggtttcacagttgatagtctctctacctctcttaatcctgctacagcctatgaccacacaagaattcctgttctgttgtttatgctacttaaaaaaggtaaaactctttacgaaagagagctcagttgcataattagcgcaaacaaactaccctatatcatcggcaacaccgacaatccaaaggggaaacctgtcgattatcgatctagcattctagccaccgctgaaggctagatggaaactcatcagtagctgttggccacggaagacaattttctcgttggccttctcccccgtgtttgtcagattcacggccaaaatgttatatgatatttcctatcagctctgtcaggtcttgacaacacatcgaggggcttcatccggcaccccaatttcaatcgaaccccaaatcctccgacggctaaatggcagactcgtgctcaacccaagaaacagcctaaaatcaactgggtagaaagcaaagaagcgcacatacacgacacaattcgcagcgcaaaaagaagacggatacctttgaaggcaccacggatgattgcagccggctgccaagaaacccgaatccgactcccacgacccaagaatgacccgggggcagcaatgcaggtttgcagggtgggacggggggctgctccgatcgcttcgttcgtt

SEQ ID NO: 74740 - DNA, 5758 bp, Oryza sativa
ggatccccctttttaacatgtaaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatataagacataactacatttatttaagttgtttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacggaggagctgtgaaacccagcttcttagagtttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctccatggcaagcggaagcggcgagggcaagggccgccgccaccaggacaatatcccaagcgtcgtcctgctcgagctctggggccacgtcgccgacgatgaccaccggcctgacgccaccaccgccacttccacgacgagcaccggcctgccaatctcggtgaccttgtgcgccgccaccccgccaagcctctcgcacctctccgtcgactgccctggtctggtggatctggatcccaatcccttagataagtttgtggcgcccacggtgatcagcacggatgccgacctcgtcctccttcgtgtccctgtcgatcgctttgccagatttgatcactgtttcagcgactacttcgtctacaaggtgcactctcactctgaaagcgcaaagctgcaccgtctcccgagcccacgtggccgtggctttgcagacgacaacattgccatactgagctgcggcaacgacgacgacgactcctacgctgtggccgctcttcaacccttgcatcatgtccacttcaggcttcacctgtgtcgctctacccccgatggaaagccagggagttggacctcccatcagttgacagtggaggagccgctgaggggaacggtgtgccccgtccctgactcagcactgaggaggatcttccatgccaccaccaaggtgattacgcttggaggtgctaaaggtacagttggctgggttgatctctggcgaggcatccttctctgtgatgtgctcgacgagattgagagccccaagctccgcgatttgccgctgcccttgccctctacgggcaactggcctttgttcctcaatcgctgcccctactattgtcgtgacatcgtcgtcaaccagagcagagacactatcaagtacgtcgagatggaattcaccatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgttacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcatcctcgacggcacggacgaagcctactcctcagagaaaccttcatctgacccgaactcgaactctggggttgggaaaaatagagcaagactgagtactacccactgtactcagcaagtcataccggaatagaggtatgatgcagggaatcatcaaagaagagctaaagtggttcatttgcataaagcgagcatttataaacagagattgaaaaactccccagttgtagattaagcagtattatcatcaagaccacgacaccagtgcacaggcccaccaccacgaaccatccaaattcattagactaaactaatgtgattctaatcacggtgaatctggttgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattaccattagaactaacagtctaaacattaatatgattttccccattgtgatctagttgaactaagcaaggctaagcaattcctagtccaaactctaatcatgttataacccaagctaacaaaggagcatggtatccaaaaagcatggctgtaacaataggtaaccatcccatagtaatattataaaacaatgcaatatttgaaaggaaacaattgagcatttgcaatataggatcaacatgttcaagtgacaagcatgacttgccttgctctgctgctgggggaacctcggcgactatctcgaagtacaccggagcgtcggagggatcggaatctagcggcatacaaagcaaacattgcaaacaggctataagactactgaaacagagaacaaaaccatttttaatggattctacacatttttcttgatttactgagacttgagtgcttgcctccttattggtaaaggatgcaacggtacgagcctatagaacagctcccgcagcacctccagttccgcccgcagttcctgcagctccagttccagctcccgcgttcactctctccttcgctccagcatcagccgccaggggtccagccagtggcaccggaggttggttgtctgctactcccagtggcagcggcgagactgatctgtcaggctccaggagtcgctcagagggaccgggtgacgagcaggaggacgccttcgactccaccgaccgcaggagccgttccgagcattagtctcgttttccaattagtttatcgatggtctagcttctggttgttagtttgcgtgtttaggttgcttgtttggggtcagttgacggtcgatatcatgtgcctatgatatggctgtcttaataaggatttttgcttgctttttaagtgttttaatggagatcagaacaaaagcagtttta

SEQ ID NO: 74741 - DNA, 892 bp, Oryza sativa
atatctttccggactcggcatttccttttctcattttgattcctctgtcctggcactggagttaggctgaaactgtaatcttggcgaggatttgtgttgccttgatgcttctttccgttgaaactggcgggttggttggccatcttcttcgtcagcagaaaactgaattgaaaatcttttggtacatgatcagttccttcacaaaagaaacaattgatcctgctcgttggacaccggtcgggtggatggtcttcctcacaatgaacgcatgtagtggcacacgagctggcaacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcaatcactcgggagcttgaggtaccaatgtcctgacttctgaccttattgcctttctcattgtcag

SEQ ID NO: 74742 - DNA, 5482 bp, Oryza sativa
ccaagcccagaagaggagctccttgaagatgaaggttttggtgtctagctcgtgcctgccgtcaagcgcctgtggtcgtcgccctagtcttccgctggttctcgtttgtctttgtgtgtgctgggccttcgtcgcccatgtaataagttaactatttacgcttccgcttgttaaactctgaattgtatcaacttttggtgtaccttgcctcctgggacaaggattaatgcacgcacgtcaggaacgcccgttgggttatttccggacgtgacacaacgtcaccttcagccatatgagtgaggtgattgacggctacgacaagctgctcgccatgctccacaaggcgaccaagaggctcaacgatcagaagcttgtgaggatcgctgagttgcaggataagaacgctcgccccaagaaggaggttgccaggcttcagggacgtccaccgcctggaggagcccgcatccgcaccatgtcgaggaagtcgaccatagctctactgcgcatccagcttacacccaggaacccgccgctgcctccacctccagcacctcccgtagctccagctccagcccttgttccaatgccagctctagagtccgccctctcctttgtgccaaattcagcctacaagggtccagcaggtggcagtggaggatggttgccagcatctcccagtggtggtcgtgtgatcatcagcagttccagctcagaggcaggcagcggtgacacctatgagcaggagtactccaggagccgctcagagggatcggacgacgagcaggaggacgccttcgactccacctaccgcaggagccgttccgagcattaggctcgctttccctagtttatcgactgcttagtagttgtttgttagtttgtgtgtttagggttgttcgcttgtgggttagtcgatggtcgatatcatgtacctatgatatggctgtcctaataaggatttgcttgctgttttaagtgttttaattcatatcagaacaattgcagtctaaattcctatataataaagcttagttcctaagcatctgtttttcttcttttctatcccctccgtctgttcttccttcagatggtcaacaccaggaatggcggtcgtgcagctggtaacagaagcaacagcgaagaacgcatcgatggtgggcaccccaatagcgcctgcggcaatggtccgccaccgctccccgagaacccgatgctcgcacaagtgatggcccatcagacccagatgatgatggccatgatgcacagatgcagcagcagcccctccagatgcaccagaggatgcagcagcaggccgatcagcagcaacaacagtttggtccccctcccccttagtccaagctgcttgaatttatgcgcgtcaggccacccaccttctctagtactaccaaccccatggaggcaaatgactagctccatgccatagaaaagaagctcaaccttctacagtgcaatgatcaggagaaggttgccttcgccacacaccagctctagggtcctgctcagcttggtgggacaaccacatggctacccgtccgccaggcacagatgtcacttgggcggagttctatcgcagcttcaagaaggcgcaggtgccagacgggctcgtggcacagaagaagagagaattccgggcactcaaccagggcagcaagacagtgacttagtacctgcacgagttcaaccgcctagcgtgatacgcaccggaagatgtccgcactgacgcagagaaacaagagaagttcctggtaggcttggatgacgagctcaccaaccagctgatctccagggattacgcggactttgagaagctggtagacaaggcaatccgacaggaggatcagcgcaacaagatggatagaaagaggaaggccgctcagttcagggcccatcagggaggtcaccagaggccacgcttcactcccggacagcagggtggacctaccaccatgattgtccgacagcaccaccccaacccttccggcaacttccaccagggtgctagtggcagccaaaaccatcagggaggtcagcccaaccatagtgcagctccacgcccgccaatggcaccagcacagccagctccatcagctcaagccaagaaggagaccagagcaaagccagggccctgctacaactgtggcaagcacggccactttgctgacaagtgcccaaagccaaggcgtgccgggccaaggttttttcaagcccggcgtcaaccatgcgtccgcagaggaggcacaagcagcaccagaggtcgtactgggtacgtttcctgttaactcaatccctgctacagtaattttcgattctggtgcaacacattcgttcatttccaagaagtttgtggggacacatgggttgagaaaagaagagcttagcacacccatgagggttcataccccaggaaatagctcgacttctgtcagttatagccctttagtgctaatagaaatccaaagatcacaatttcttgccaacctcatccttcttgaatccaaagacctagatgtcattcttgggatggactgacttaccaagttcaagggtgtcattgattgtgcaaatcgtacgatcaccttgatcaatgagaagggagaaacagtggtgtacaagtctctcgcctcaccaaagcaaggagcctcactgaatcagattgaggtggaaaattcagtgaacgcaaaggagaagagttcgaggaaattggaagatattcctattgtctgcgagtatccagaagtgttccccgaggacctcactaccatgccacccaagagagagattgagttccggattgatttggcaccggtaaccgctccaatctacaagagaccgtatagaatggcggccaacgagctagcagaggtcaagaagtaggtagacgaacagctgcagaaaggatacatccgaccgagtacttcaccttggggtgctccggttatttattttgagaagaaggacaagacgaagaaaatgtgcgtcgcttatcgcgcactcaatgagttcacaatcaagaacaagtatcccttgctgagtattgatgatctgtttgatcaattgaaaggagctaaagtgttttccaagatagacctgcgatcaggccatcaccagttgagaattcgggaagaggatatttccaagacagccttcactactcggtatgggttgtttgagtgcactattgtcctttggactcaccaatgcaccggccttcttcatgaacctgatgaacaaagtgttcatggaatttttggacaagtttgttgtggtattcattgatgacatccttgtttattccaagtccgaagaagatcatgaacaacatcttcgtctggtactcgagaagttgcaagagcaccagctttatgccaagttcagcaagtgtgacttctggttgtcggaagtcaaattccttggtcacgtcattactgttcaaggtgtggcagtggacccgtcgaatgtggagttggttacaaagtggaccccacctaagacagtgacccagattcggagtttccatggacttgctggttattaccgtcagttcattgaaaatttctccaggattgccaggcctatgactcagttgcttaagaaagacgagaaattcaagtggacagctgtaacaccctgaaaattcgacaaataaaatgaaacccgaaattgagtactttcaaaaacttctaaataagtttgcatcatgccgatgttatttcttttgttgtgcatcatgatggatgttatggtcgttattgcttgccaaaccataaaacgtcacaattgaaaattaagctaaagctatacaactacataacaattataaaaataagatatttattatgaaccctgtaaatatttatgcacaacacaataaagccatacaaagagaaggttaattagtaatttaatttataggtcacattagaatattccaattaattttagaaatattaaagccaccgagttatataggatgaatttaggatgatataaagtaaagccaatttcatttgggaaatgatgaataatcaaataaacaaatatttaaataaaatatttgaattccccaaaccaaaaagtataggttacatctcaattcaaattccaatcccattcacttttgcagtttagcccctccctattctcgtttttcctgtttttccttctctctcttccactcggttactgttcatgggccaccaaccgttcgatctgggattagcccagaccgaactcttcccaacccagcgccgctcctcccggtcgctactaagccgcgcacgcaccttcccaacctgtgcgaagcattttgtgtgaccgtgcgccgcactgcgtcgcgccacgcccgcgtggtcccaccgcccgaccgagccaccgggttcccgcgaaagctgcgctgccttgagcaatggcatcatctcatcccatcgcgagtcgcatcgaagttgagggataatggccgccacgtcgcccggcgtcactgtagaaaataggcctgcacctccctatcggcggccgttaccactgcccgtcgccgccaatcatgttgccatcgcatcgccatctcgtcgcccctagctgagaccgctggataaagcggtgcccctttctccagctagcgatccctctcctgcgatactaccgcgtaggcaatcatgtcgcgcctgtacattgaactggaacctaggtgagatcgaacctaggccgagtcatcgattatgcttatccataagggatcgccttcctctcactggtataagctcacccctagctcgtcctcatccaaaatcaacccctcatttgcttcccttctccccaaagctcttgctccatctcagagaaacgaaatcatgctgccgccgggtgtcgaacacttggtgggcgagggctgccccgccgccacaaggcctctcagcctgagttggtgcggggtgtgaaggtaaggtgcttgcgcttctgatgccgccgtgaaggagccaggagccgctggacgaggaggaccgggagtcgagtacctacaagcgtcgtcgatcgccgtcgtcgatcgtcgtcggtgaggcctcccctcctccctttttctctctctcccgtgccgctaagccgttgcctagccgcctagccgcgccgccgccgcgtcgccgccatcggccgctcgccgttggtcgcgcctccggtcatcgcccctagcgccgagccgccgtgcgccatggctgccgggccggcttaagctgcccgcgcgtgtgcccttgctgtgcgccgcatctgccgtccgagggtagatcggggccgtccatcgccgccggcatggcagcccacgtgtccgccacgtcggcgccacgtggtgctcccttcccctctcctgtggactcggtccaatgtgggccgccttgtcgcgaccggaaaaattgccttttcccgaacgctagtgtattaatccccgtcccaggaaaagccggggtacacc

SEQ ID NO: 74743 - DNA, 4597 bp, Oryza sativa
ccgccaccgtgtccgccagctcgaagtgctcggcgatggtcttgggctccttggaggcaatcttctctagcatgcagttgtgtcgcacgccgttctagaacacataaacgaccgcgtgggccggtatgcagggaatagtgttgcggacctggcagaagcgctgtatgtatgagcggagggactcgtcgtccttccgttgtatagcgtgcaggtctgcctcctctcctgggcggggatacgtgccttgaaagttcgtaatgaactgctggcacaggtcctcccaggagtggatggagtcggggggctgagtcataagccagccgcgcacctgacctttaagagccatggggaagtaattcgccatgacctagtcgtcgccccccgcatcatgatgatcgtgctgccatcatatttctccgtgaggttggggcgaaacttcgggggccaccggactctggagactcgccttgaaggccctgcaactggtccctccaggggtaaatgtgaggggcgggccgcctcgcgtggaggagcggggcactccggatgaggaggcgccctccccatgcgggccgcccagtgctcgtccctgtgttgctcaatgttgattcgagcgtccctcctcgtagaggccaccatgacgtccccggcttcccgagatcctcgatgacgttggggccgtcgaccacctcgaagtcagggccgaccgacgggccctccttcttgctgacgaggaaagagcggtgggttacgcgaggtaccagaggcggcgggtcggccacccgcagcctgctaccgctgggcagtggtgaccaggttggtcatgttgtccaaccatcgctggacaggggtctccggctccgaatttatggggggatgccgtagaagggctcccgccgcctaaagtgcgcctcgggatgagccgccgttgccgtatgtcaggcggccccgtgccccgacactgcgcggtttctccccgcgcggcggcggggagaggttcctccctctgtgggggggtcgcggtgggcaggagtgggagagttgttgcgacggtggtgggggccgcggctcccgctagcatcgtcactcccggagggagtaggggtgtgcgccaccacttcttcctctaggacctcgaccatgatcgttgaggatggagggaaacttgtggtggaaggaaacgatttctctttcaaacgcgcgaattccccctacctggcgcgccagctgtcgaggaatgatcctctcttgcgggtgattgagggacccccttttgtgagttcggccgggggaaagggcgcactgatcaagaacgtatatctgcctagagtctttcgagaccgcgtgtgagagctgggattgtacaggttcgggccgctagggagcgtaataccctactcctgtgcgtgggatttagggttgagtgttacaaaggtttctaaactccagggagaactcttactcttcttcctctggggcttaggctaagtgagagtcatccccccttttcagtgggcaaggtcctccttttatagttcaaggggataccacatgcaccgcctctacctactccttcaagggagggggcccacgccgcttggagcggaccaccattcgtgccttcaccggaagctaagcagccgtccgtcctcgagtggggcccagcgccgtcccctgcctgacacgggggacgcccttgtcattcccctttaagtgaatggagacttttggcggttcacctcacgtggagggggctctagacgatgcattgatgggacggggcatacctgcccccactccgccgagcacagggcggaacgtgggggcaccgccgcccgtccgattggatgtgatcggccacagaccggtcacgcccgattgacgcgggtcaatcgggcagcgccgcacgtccgccctcaccgcattaaatgcggtgtgggacggttggggtgctattcattgatggcggctcagattcggccaccgccccactcactccccccgccacgtggcggccgggcgagggcctcggggcgaggcagcctgagggtcaaaggggcgtgacgtggcaccccgaggccccctggctgcctctgcgtcgtccgagatgtggggggagggccaggctgtatggccgcgtggctggacgggattgagacttccccatacttctcatatcctcaggcccatatcaccgacaattattctcacccctagttagctaatgtaactagttagttcaggtggtggtttgggcttgtctcaatgtggtgtagtgttgagcagtgattggttaatattgattaaatactacaactgtttttactgctttcaactactgcttttaaatgcaagcattatgcaaatgaaccgctagcctcctttggttatatcttgcatcatacctcctcttccggtatgacttgttgagtacagtgggaagtacttagtcttgctctctcttccccacaccagagttgaagttcttcttagttggagatgtctcgaagaaattggtttcgtcgctgccgtcaaggatgcatgtggagtcaagtcttcaggcttagctggctttcatcttttccgctgcatttgtaatcttttatatttttgtaaaacgtggatctgtatttcaacaattgtcgtttgtataccctggctggttctggacatgggtttaatgcacattcagcttagaaattctggttcgtgaatttctgggcgtgacagttgtccatcattcttgacaagatgtagtgtacaaggcattctttagttgagcctcgctcactttgcatcacagaagtataacctagacataactaattcagtatagaagcaaaatgtgcagcagcaacaataagggtgaaaactagaaagaaggatttatgatgcttcttagtttattcagtcacgaaagagtgactttaaataaatgtacacttcttccaaagtgaaaattatgagatgtcttacttatggaatgctcctacacactaaggttgtgtaatgccccgagtttcgaattagtatatttcggggaatattagaacaaatgcgcaaaagttcaatttttttaaaccgttgttcgaataggcgatcaggaaccatggatgtatagagctcgtcaagtagtgcaaaatatactaagtcccggggattgaaacaatgtgggacgttggatctcctttttgtctctttatgtaactaaaagaaaaaagaaacaacggttttgctaaaaaactggcgacagttttttctttagaaaactttcgattttctagccattagatgcactccaggattcgtgcaacatatacggccatatgggtagaataaaaaaaatctcgtgtgggctagacaagcattgaacgagctaggatctatccatcaaacttgccacacgttacgctgaggtacgggcactttctgattattaatagcatttgtagttatatatcacttacaccctaggtacataacacttatactctagttacatactctagttagttacatagcacttacaccaactagagtagttacagggtaattacatggtataaaattaggatttgtaatttttttcagggacatatatatgcatattacttttgaattgaaagttattatcaatttgggcactaagactcgtggtttgtactagtgcagactgttttcctgtaatcgttgatgacaaatcctatggttgaaaaatttgacagttctggacctaaaaaactgtcgacagcacactagctagtccctttcttgggactagctattctatgagaagttcattctaacatagcaagtcgatagtttactgcaaacaaaatggataataaacatgatgtttcaacaaaactagaggaactcacgcatgatgtacccaaaggaaaccggttcttgacacactacaaatctgtggtagttcttttctatctcgaaaacgaatcaaggctgtgtttggaatcagctgttcccaacatgcaaagtgcgcatggaaaacggagcggtccattagagcttgattagttaagtattagcttttttttttcaaaaaatggattaatatgattttttaagcaacttttgtatagaaactttttgcaaaaaaacacaccgtttagcagtttgaaaagcgtgcgcgtggaatataatggagatgggttgggtaccctggattccgaacacagtccaagtctatccaaaaagtttagacaagaaaacacgtaacaagttagtttacaagaatacgaattacgtcaatcctgcactacaagtagagcaaaatggtgatttcttgtaaatctctcgaatggtgatttaagaattcagtgcaaacctaattcttgctataaaatcaaatgttcggtaccgtatcaacggaacaataaaaagcacttggcgtaccataattttgtcattcttgttgaaattttgtaacataaaatgcatgaggccacacgaccttaatgttcaacgtgtcatgcattagtgaaataatagcttacaaaacataacaaatatagctagataacggttgcaatccttaccaaactaacgtataaagtgagcgatgagtcatatcatt

SEQ ID NO: 74744 - DNA, 25207 bp, Oryza sativa
ggggggagggggggagccgacggcctcccgtggggcaggagtttttgcgtatttggttgttctcatgttggtgtgctggtgctccttggtgtcaaattctactgcctccttgggttgccttggcgtcatgcagtagattcgtttgccgaagatatggtcggtaggtatgagatggagttgtgggattggtgcatacaaggagggtttttggatatgcttgctttgggggataatgtggtttgagtggggccggcagtattgatccgttacgccacgccaaggacttatgtttctggctgttcattagcttgtttggtcaaattgggtgttgagagtgatgagcattatgtagtttattatggaaaagagggtttggctgatcgacgaaagcaggaaagtaatgagtctttttgttggcccttttttttaattactctgaatgttttcctgtcaaataaccatctgcactcagaatcagaaaattttaacatataaatagttaccgtcacacttcgctttctctgaaactaattgaataggcacgtgcaacttttggtatgttctataaatgtacatctatatttcctaattatacaaccatttaatgtaaccatcaaagttgcttgataaatgaaaggtatttcttcgtttgattgctcatattgtgcatttattgggagcatgtcgcaattcttccatgtttacctattttttccttccgccaagaactatatatatttattgtgtctctgtgtaatgtgaatgtccagggcgatacgcattcacgtgaagacggattatcaaaaccaagagataaagatagagaaagagaaaaagacaaggacagggaacgccacagggaccgtgacagagatcgaggaagagaccgagatcgggacaaggacaaggaaaaagacagagacaaagaaagggacagggatagggacagggacaaggatcgggatcgccaccataggcatcaccgtgaaagaagagaacacagagatcgctctgatgatcatgatcgccacagaagccgtgattctgaaaggtattctttgttaagggagttctgttttatatgcaccttatttcttacaaaccatgcatccttgcaatgaatgcattttatcaaatgtgttaaatgcttttagatttagagctattcaactgtcttatacatgcctacatgattagtcaaatgcccacaccaatcttgtggtttatatttaatacaggagaagagaccatgaacgggatgggcgtcgcaggcatcggtctcgctcacgctctcgttctaggggcagggatcgcagatctaggtctcgctctcgttcaaaaaggtatgtaaaggaagctccttgcatagtcttccatttgcatcttctttagctgccgtgcacatactatgttttccgtcatggttagttaaattgtttattccatatagtagcaattttggacatactttatatatgctttctctgcatggattattttcctgatattttctttgtgtattatcaaattcagacatgtacaattcgtatttgaatatgtatggcagtatggtttactggcttagtcttcttaatctggttctcattgatgaccggtttataacttgttaaatatgctaattttatgtgttattcagctttactttttaagttttattttatcactaaccactaatatctactaaactatttttctaaagcagcaagcgagttagtggatttgatatggcgcctccagctcaagctgtggttccacaatttcctgctattccaaccccaagtatgctctcatcaactaagttaaacggctcaatttcatttttcttttcctcgtcaatttgtggcactttttctgaataataattttagtgggacatttgaacaatggagttaagaaaaataattttgctgggctggatgattgatgtacatgagtattttttttagaatgaattatatcttcggccgctataattcttcatccttatcactgtataatgccacactatcttattgccgttgccataaactaccggtgaattactagtccattaaggtcgattattgccgtagcaggatgatgcttggtgttatacctagtaaattggtggatatgtctggatgttatacctagtagaactccaatacagttaatatttgcttagtatgatcggccttgagcattctacacataatagtaagaggacaggagaacaagcaaattgttattttatagtagtctacatgatgcatttggagagacattggtgctttaattaaaggataaaaaagaataccaaccagtgggctccgtaagcacccctcaggcacctatctgctgcagatgcacttcatgtgatagttactaatatgaataagtgaataacttgtaagtttccattttattattacttggtaactggaaactgagcaaaacttttttgcttgtgttcttttgttgtttgtctgttttgtgtatgtgtatggtaagaaggcaatcttgggttacttgcccccactgctgccaatggaatgagctgcctactgtagctttaatgtacaaggaggaatcagtgctctggtttgataccatcttattcgtcttcaactagcaagtattactggttgctagcattatgtctattatatttgtccttgcacatattttgttcattcttaggcttggatactgaacagctagatctattttagacccagactgatggtgagaactagtcagttctaatggtggaatttttttccttgctaattgtttatgctctgtactagaaatttattgataaattgcaggtcagtttccgggcactgctattcctggaatgtttccaaacatgctcccgatgggtgttggacaggtaacctgtcagtattttaatgtattataagtgccaaaagaatcatttttttatttatgtttgtaaataatttttatttgcctgtaataataaattttgtttgaagcagttcaatccccttgttatccagccgcaagcaatgacgcaacaggtatgagttgttgtgacatctactgcatctattattgataaggatgtcaacaaaataatgtgttaacacctttttctctcaggctactcgacacgcgagacgtgtttatgttggtggacttcctccaactgctaatgaacaggtctgtgtatttaatcactcattctttcttactgcccatttcccatacccaaaccaaaagccgtatgggagtgcacgagtgtgtacccgcatgcaacatattactgtggaattgttacattagtttcctttactgcagtcagttgcaatatactttaatcaagtcatggctgctattggaggaaatactgctggtccaggtgacgctgttcttaatgtctacataaaccatgacaagaaatttgcttttgtggaaatgaggtctgtggaggaagcaagcaatgcaatggcactggatggcattttgtttgaaggggctccagtgaaggttaggagaccaacagactataacccttctctggcagctgccttgggccccagccagccaagccccaatctgaatcttgctgcagttggcttaacacctggttcagctggagggctagaaggcccagatcgtattttcgtgggtggccttccatattacttcactgaggctcaagtccgggagttgcttgaatcctttgggcctcttcgaggatttgaccttgtgaaggatagggaaactggtaactcaaagggctatgcattctgtgtctaccaagatctcaatgtcactgacatagcctgtgctgctctgaatggcatcaagatgggagacaaaaccctaactgttagaagggcaaaccagggagcggctcagcctagaccagaacaggaaagtatcctgttgcaggcacagcaacaagtgcaattacaggtataggtctcaactatttttcatccagtatcagataattttactttcttatgccaactattttgtagctgtattgtgattcttgcattttgactctgtgcttcttaacagaaacttgtatatcaagttggagcactccctacaaaggttgtgtgcctgacccaggtggtttcggctgatgaattaaaagatgacgaggagtatgaagacattatggaggacatgagattggaagcaggcaaatatggtaatttccaacttctcacccgcaatttcctcccttgcctctaaactccggtttagtttgatcatctgctgggctaaaaccccatatgtatcttcttgcgttgagagtttatgcatgttttcggattccttttgcctcgattgatactttttgtttatttagttggtcttcctaggtgttttctcccttttgtttactcacaagtatcttccttaggtaatctgattaaggttgtcatccctcgccctgatcctagtggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattcttattcaaacgcgtgatagttcatgatagtagtagtaaattaacaggagaaatgagggcaatggcatggatgattcatctgcacacccgtgcggtacatgctagacgtgcaaaactatttgcaccaatggttttaaaacaacaacaataataaatacaggtacagatggaacttgaaacagaatgatagcttacaattacatgcagtggatgctatgtttagctaatctggacgtcgccacaaatgctgtgccgtatgcagtatatcaagatgattaatcaacggattatttgctgatcgatatgcttaatccttcgccaatttggatgtccaggggtcagacaggtgtccgcaagagaagggtggcaaccagagattacaatgctcttgagcgattggggaagcttgggcagtgtcatcatgttgggacactcctggacgatcaattccctgagtgttttcaggcggcacaatttgacaggcaaatagttccagctgcagtctgtaactgacagtgtatgcaggcaggtgaagaattcaccaatctttgggggatcactcgatcccttgcaactccagaacataagattctgcaatgccgggcgatcttgttcctgttccttgtcgcaaccgtctcctgtcaaccagcttgggtatatcacaccaccgtaatccctgatgcaaagtactgtaatccccgacggtggacggagcccctcaagaacctcctcctgaagttctggaggttgatgttgcttgatctctgttacaggtggaaagaacagcttcttgtatgactccaacgctttcttcgagcagcgttcgtcagtgccaccccaccgtagcgtcagctcagtgagatataccttgtcagatagcctggctcgaacagcttcctccttgctctgaacattctcgatgcagtcgatgaacagcttgccacgaaggttgttcaggtgctccagctgctgtatctcgtatcctttctccttcctcacgtagaagtgatacagagctcggagagatgtcagcttcccaacatcaggaatgttcaggccataccatgtcagcatgtacctcaggttgatcaggttggcgatcttcagctgggatggacaatgcaagcgagtgttaggattgacagagagctcctgaagatggtaaagcttggaaaattcagccggcagaatcaggctgtggggaggaggtgacatgatgccaagataacgaagatgtttcagtccaccgatgcatggtggcaccctgctcaaatgtctcaaatccaagtgcaccaccctcaactttgttagcttcttcagcacacgctcaaaatcatcttggttcattccctctactgaatagcacatgataagagttctcaagtttttaagctccaaaatcttctctgggaacaatatttcactgtgactcgatgcaaagatgtcgaacgtgtttagtgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgcgttgtgttcgtctggtttcctgctagcgatcgctggggaaattcctaacaattggtatcagagcacggtttaggaagtggactcgtgaccgcgcattggaaggcgtcttcttgccgcgtcgtcgctcgtcgtcaccgatcgtgcacactcctcatgactccggcggccgcgccacgggcagcggcgggggtgaccgcgggctggtgatccaccgcgtggtgaaagaaggaggcggctcggtgaactacccgctgctgaccaagaccaactacaacgactgggcgctactgatgaagatcaagctgcaggctcgctgcctgtgggcggcgatcgagcccgacggcgtggacgtccctctgcatgaggaccggatggctcttgacgctatctgcagtgccgtgccgccggagatgattggcaccctggcgaccaaagcgtcggcccgggaagcctgggaatgcatcaagacaatgcgagtcggcaacgaccggattcgcaaggcgagtgcacagaaagtgcgcgctgagtatgaatcgcttgcgttccgcggtgatgagaccgtggaagatttcgctctacggctcacaaccatcgtcaaccagcttgcaaccctcggtgatcctgaacctgctgataaagtcgtcgaaaagtaccttcgggtagctcgtcccaggttcaatcaactcatcttgtctattgaaactcttctcgatatctctactctgtccatggaggaagttactggcagactgaaagccgctgaggattctgggcaatcctcgtcgcacaccgccggtgggaagctgtacctaactgaggaggagtgggctgaacgtcagaagaagaaggatcaagaggcaaagcggggtgactcgggcggctctggcggccgcggcaagcgccgtggcgggagagggcgcactggtggcggcgggactgcgagccccgagagcacgaactctggttcggcgcgcaagggagacaaatgccgaaattgcggcaaacttgggcactgggcgaaggactgcaggagcaagtccaagcgcgaagaacaggctcacgtcgcccaggaggatgaagaagagcacaccttgatgttgctcaccggcggttgcgttgacacggtcgacgcggcggcgccggagggcgacacgcccacaccgccccaccaagccgtggtggaactcgtggagatgaaagtatttgcagcgctcgacgacgcggctgaccatgatcccgggcgctggattatggattccggcgcgtcaaaccatatgacgggcagcaggatggcgttcgccgacctcgacacgaacatcacttggaacgtgcgactcggcgatggatccgtggtccggatcgcaggacggggcacaattctctttgcctgcaagaatggtgagcaccgcactctgtcgaacacctattttcttccccgtcttgctgccaatattatcagcattgggcaattggatgagaccggcttcaaagtgctggcggaggatggcatcatgcgggtctgggatgagcagcggcgtctgcttgcccggatccctcgcaccccagggcgactgtacatgcttgacatcaacctggcgcgcccggtctgtttggcggcacacgccgacgaagacgcgtggcgctggcatgctcgcctcgggcacataaacttcagggcgctctgcaagatgggcaaggaggagctggtacgtggtctaccatgtttgtcgcaggttgatcaggtctgtgaggcctgtctcgccgggaaacaccggaggtcgccgttcccgcggcaggcactttgccggtctgacgagccgctggcactgctgcatggagatctctgtggaccgatcacgccggcgacacccagtggcaaccgctatttccttctactcgtcgacgactacagccggtacatgtgggtcgccctcctctccaccaaagatgcggcgccggctgccatcaagcgtattcaggcggcggcagaaaggaagagtggacgcaagctccgcgcgttgcggacggatcgcgggggagaattcacgtctacacagttcgccgagtactgcgccgagctgggaatgcggcgcgagctcacggcgccctactctccgcaacagaacggcgttgtcgagcggcgaaaccaatccgtggtgggcacggcgcggagtatgctcaaggcgaaggggctgccaggtatgttttggggagaggcgataaataccgccgtgtatctgctcaacaggtcgtcgtccaagggtatcggcggcaagaccccgtacgcgctgtggaacggcgttccgccggccgtgcaccatctgcgcacgtttgggtgtgtggcacacgtgaagacgaccaccccgaacctgaagaaactggatgacaggagtcgtccaatgatctttgtcggctacgagccggggtccaaggcgtatcgcggctatgatccggctactcggcgtgttcacatctcccgtgacatcgtcttcgatgaagcggcccagtgggactgggatgctgaggcggccgctgatctcgacaccgacttcgtcgttgagtacaccacggtgtaccatcctggctcgctgtcaggaacacgccaagacgctggggagccgcctgctcgatcttcatcatcgccgcgaacgccatcagactcaccgacagccggccgaacaccttcggtgcatggcgatgcgccggcggttgaatttgtgtcgccaccaactggagcagctgctaatcttgatgcagaccacgacgacgcaccactccgtttccgcacgatggacaatgtgctggggctggccatgctgccaggtctcgctaatcgtgaggtccaggaagagctgatgatggtgagcggagaagaaccggcaacgttcgctcaagctgaacgcgacgaggattggcgtcgggcaatgctcgatgaaatctcttcgatagaggagaacaagacctggaggctcgtcgatctgccttcgggacatcggccaattgggctgaaatgggtgtataaactgaagaaagatgctcagggcgtcgtcgtcaaacacaaggcgagattggtggcaaagggctacgtgcagagggctggaattgactttgatgaggtattcgctcctgttgctcgtcttgattctgttcgtttgttgctcgctctcgctgcgcaggaaggttggatggtgcatcatatggacgttaaatcagcgttcctcaatggggaactgattgaggaggtgtatgttgttcagccaccggggtttgagatcgatggacaggagaacaaggtttacaggcttgataaggcgctgtatggacttcgccaagcacccagagcttggaacaccaagctagactgcacactgaagaaacttggcttcaagcagagcccgttggagcatgggctgtacgcgcgcggcgatggcagtgggcgactgctcgtcggtgtgtatgtggatgatctggtaattgtcgggggtgacagtggcatgatcaagggattcaaagagcagatgaaggctgaatttaagatgagtgatcttggtcctttgagtttttatcttgggatcgaggtacatcaagaagctggaatcatcactttaaagcaagcagcgtatgcgtcgcgtattgtggagaaggctgggctcaccggctgcaacccctgtgcaacaccgatggaaccacgtctaaagctgagcaaggaaagtgcaggatcgctagttgatgcgacagaatacagaagtctagtgggaagcttgcgctatctggtgaacacccgaccagaccttgcatattcggttggttatgtcagtcgtttcatggagaaacccacggacgaacacttggcggcagtgaagcgcatcataaggtatgttgctggtaccattcatcttgggtgccgctatgtgaaggaaggtgaaggaggactgcagggttacagtgacagtgatatggctggagacattgacactcgcaagagcaccacaggagtaattttctttctcggcaaaaatcctgttagctggcagtctcaaaaacagagagttgtagcactctcctcctgtgaatctgagtatattgcagctgcaacagctgcatgccagggcatttggcttgcccggctcctcggtgacctcaggaatgcagcaactgaagtcgtcgatctcagggtggacaaccaatccgctctggccctgatgaagaaccctgtttttcacgatcgaagtaagcacattcaaacaaaattacatttcattcgtgaagccgtggagaatggggaaatcacaccgagttacatcggcacagaagggcaacttgcagatatcctgacgaagccgctttctcgaatcaagtttcaggagctgtgggaacaaattggtatgtttcctgtataatcggcacatcaagcttagggagagttttgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgtgttgtgttcgtctggtttcctgctagtgatcgctggggaaattcctaacatttaggaagatgttccgtgatgcttttctcgatcttgacgcagtcgcttcccgcgatcgtcttcgctaattcatggaacatgtcatgaactgtgaagtactcaccggtgctaatgtcagagggactgaccaacatcttctacgtcctcattgtttccatcattgtccttcacaaattcttgcgctatccacatacgaacaagattgtcacgttcaagctcataccttctggggaagatgctacagtactggaagcatctcctgacatccacaacaagttgattatagctccaccaaagagctcccttggtcttattcagcacatcgaggttcgcggttgtttgccaaaatctgatatctgggtttctccagagctgacctgccactgtcactgctgcaataggtgatctgttcagcttcttagcgattttcctcccaatcggtatgtattctcgatcatcgaaaattgtactgtcaagtgcataatgcatgaacattgagaagtattgctcctcttccagatcagatattggaataagcctattagagcctagagctgcctctttactctgggctgtcaccaggattctgcttcctgacttcccaacattgagtggagaaagcagcttctcatgattctcatcattgacccacagatcatccagtaccaacaagaaccgtttgcctctcaaattctccaccaattttgcttccaaacctctgcagtcactaatttcagaatgccggctttgcgtgatctcctcgagcatatcacgaaatatatcttccagtctgtaagtcttagaaacataaattagcatgactgtgtcaaagtatctatctttatcctccttttcatactcacaaacatactgtgccagtgtagtctttccagaccctggaatgccatatatgcaaattacagaataacatttcctgctactggagcttggtaaagaatcatcctcacgaagcatacttcttatcatatcacgctcccggtctctaccgaataccttgcgtgtactactcgatgtaatgcttctcctgttcatgttgacaatatcattccaggcaccactgcttgtctgtgttaaatagggagagttctccacgtttgtgacagtgttttctagtttctctattcttttcctcaatttccatctagcaatagcaggcatgaaagaatatactgctgtaccatcctccagctggaagaataaagaacaaaaaaaatgattagaatggaatggtggaggaatgtgcatactttccaagctcctaaatggtgcattttttgcgaacactttctatatacgaatttattaggaaactcttttaaatccatttccactttatagtatcaattcaattcgtatgtacacttgaataattatctttaatcattgagctattcaaccaatttagccattcagcacaaaagaacaggaccatgtgagctacatactgaacttccttaaaaaatatatatatactgaactagttctactctctgacgactgttgtcccctgattaataatagatgttgttttcttctaaattagtgcttctgtttagaacatggaaattttttcttgttacttcaaaaattgaactattagatgtagtaacattagtggtgtctcaaacactaagaccctttaacacattccagcaactattgatttccgaataaaattgaggagcgcgacataaattttaccaagatcatagcccgtgcattgtaactccttttgcatagtgtattagtgttgatgcaaaataggaacattcccctagattgagagaagatgcattgctagattggggtggggtgtgtgtgtgttagggggcagagaagtggtaaccaacctggtaacctgtggctgtgatgccagttgcatcataaaaccaatctcgataagagcgagcaacctcaaaccagttgactgaccagatgaacagggattggcagcatctgatgaaatcaaattgcctggacaagcaactaagccgctccagcaaggagtcagaagctgacccgcagcatctgctacaagaaatcggtagcagcgcagctgatctgctgcgtagcgatcgatacaaaccctgtgcccactccagtagagtggttatgcatctcccaatccagctcgtcttgcaagcgtggatggcatcgtcgatgtgcggatgccatttgctgctgcttccctgtggctcgtcatcgccgatgacatccttctcgatctggtgataagcaatgagatcgaggacgtcttctgcttcgtacaaggcagacttgaccagcttcgccagcgtgtcgagattttgcacggctgatctctccttcttcgctttcctgtgcatcctctcttcctctatctttcgcagcatctgctccagcttcgggacagtctgaatctccagctcttggatctttggcgaagcgtcgaagaggtaggagatgaacctgttcacgagcaagctgatgataggcgacagcaaccaacctagcacggttatgacagagcccatggctgcaatcctccatggatttgccatggaatgcaagcttttcgatctccttcacaaaggggacaaagttaaggagcagtgggaagaagaatggagctctactactgtcttggtagcaatctatctatcagcaaactatgcaaagcatctgtcttctagcgagctcagtacagtgcaaaacttaattaagcagaaatttcacccgaaatttcttgcgaatcatcatttttttttcctgcaagtgtcattactgaaaatgacttgaccacatagcatgtggctaaccgactaataacatagtcagacttgttttcgaactaatgcatatggttagtacattgcattacatagcttccccgagtttgcagctggctgtctgatatgatgtagtgtaacctgcacgtgagtccatgtgacatgacaatcacaacactatattatgactattattaacacaaggatcagtaatacgaagagtgacagcagtaattggccaatgattcctctctgggttgtcaaactaatgttggcctgattccactctcttcaatttgttgtaatgattcgttcaaaaaaaatgttgtagcaatgaataaagaagagccaggctcttgtttcgaattagagaaatatatataaaaaaacagctcgttaaggagtcacattagatcgttccttttggaatcaataataatcattgactattaaatcatagtcatgaggtacagaatattaatttagcctaaataagtactgttggatttgtctattggtaccaagttttttctggcagtctgcatctatttatttactagcaaaatacccgtgcttcgctacggtgtattaaaactaaaaatatttattttcatctaaagttattttcacactgttttggtactttcgctcactagaaaaggtctcaaataatagagagaaatataatagctcataataaattattattgcaacggaataattttaactaaaatcacaataaatattttaacatgttgaaaacaatatatttcttgtttaccagatttaacattaactaaggttttatagcaattaaaaaaaagactaactttctcttggtggctaatttttatttttagttttttttctatgaattagattggagagaaaaggaaaagggaaaagaacagtagatgataaccagaaaaaagaaagctaaccaaagtgatcaaggaatcggacccatgacctgtcggcacaggttttctaggctaaccaattgagaatcatggacgttttgacatgcactgcattatatagatattcacctgaacagcaaagaaaaatatcaccccacctcctctcgaaccttatctcttctctaggagaaattagacattctgccactcctaagagtgggtttcgccacaatgccattctgcggaatggcatcgtaaaataccactttcaaccgatgccaaaccgttgctttgccatattcgccatttcataagattttcaccttttttgcacttcaaccgaccaaaatacccctctctggtttctttctcttctccggtaaacatgtgggatgaggagaagaccacgacggcaggggtggcactaacctcaggctcggcgccgccaccgccggagctctcctcctcgtcgtccttatcttgctctacaaattcaagaacgcaatcttttagctcaaaccacacacaatccggagagctagcgagggcgagcgcgagggttccggctcacctcccgccgccttggtcgccagcgagggcttcggctcacctcccgccgccttggtcgccggctcgtcggtctccatccccgccgcagtcaccgtgccaaccaagcccgagacggcgacgcaggtctcgtcctgccatgagctcctcctggagctagccttcttgggccatggtggcgggcagcctgcgacgcgcggcggagacgacggcggaggagatggtggcgagcggcgcacggtggtcaacgggagaggagcagcgtggtgaccggcgggcgagacgatgcaggagattgtggctcatgacgcggtggccggcttagggtttccttctctttctccgatgtgctggcagcgggcttcgaccatgggggcgggacgtcgctggcggtgagcttgggcgtcggcggcgcgccggcggcacgaacgactcggttgtgacgaccggaggggtattttagtcagcctgggtggaaaaataggtggaaatggagagaattggcctaaatggcaaaacaaatgtttggcatctcttgtgagtggcattttaacgacgctattccggggaatggcattgtggcgaaacccactattggcagtggcataatgtccaatttctccatctctagaatcctccgccttcgcttctctctcgtcgctctctctgtctcccagtttctcctccccagcgacagcgacaaggcgcccgctccctccgtctcgcctccctggccccctcctctcccatctccccctcttcctcccgtctcctggcaaggcgcggcgacgggaaggggacccaccgccagcgccgtttccccacagctattccctccccttcctccaccctcatccctcccgcggcaggcagatctggcggtggcggtggcctcgcgacagctgcgggtggtggcagcagtggctccctccgcccccagcagccgcgggtggcgtcagcggcggctccctccgtcccctgttgcctcccccctcggttgaaatgacggcggtagcgggcgccggcggcgcagctcggcaagccactgccagcggccactcgcgggatgtggccataggaggaggcggcggcagcagcaaactccactcgatttttcattgatttggtttttttatctccgtttgctgttcttctattcttgtatttgggatctaacacggattaaaactttttgtgttatttgacgcggactcatgtgtatatgcttctatttgtgtgattgaattccgattaggattttttttggttgggggatgatagaattccgactgagattttgggtggggggttggatgaacgaaaaatttgggtaccgatgatgtgacgaacagaaaattacgaatttaagattttaccctcgttgccggagcgtgctaggcgaggcagccgccgccttcgtcttcgacgtcctctttagacgagtgatttggaatggccttcggcccagcccaactccctacgtaatgggcccttcttttatgaacgggattgggctgtgttttacaggccgagccaaatgcagtttggaataagttcatataaggtccgttaactttacaccgaatacgattttcgtccttaacctaaaacaagatacaaccggtccatgaactgttaaaaccggtgcaaacgaggttcctcggtggtttggaagacggttttggctgacgctgcgcctaagtgctgatctgactcggtcttcgtcccacgtggcattgacgtgacgcttacgtgactattttatcctagaaaaataataaaaacggtggtcccacatattagctacaccaatttttttaaaggtggagcccacatgggccccacataatcattcacaccccctcttcttcctcctctccccagctcccctttctagtttcttctctgtgtcctattcctccccagagccggcggcattcatcgtagcaccacggcaccctctctccctgctctacctcttcggcttctcctctccccgagattccctgacttggtgccaccgacgaccacatcgagccaccatctgagccccatgggagcactgcatcccaaggcgtcaacgacctgcataatcccgatctataccagcaaggatcctcggatccatacaagcagtgcctcatatttttatccatctctccttccaactattttttctctctatttttcttccgatctcttctcaagatttgttatatttcttctaatctgatctgacatgtgggtctcattattttttaatctgacatgtgggccaaaatattttgttttattttttaaaatattaaattttgcttcgtgtgtcacgttaatgccacgtcagatgaagaccgaatcaaattagccatgtaggcgccatgttagctaataccgccatctaaacggacctatattgcacagttgaaggaccagttgtatctgattttcggttgattgacgaaaatcggattcgttaataagttaaggaactcaaatgaacttattccaatggaatttctgcaagtcgtccgagggaaaagttcgataattttatgggccgatatagatcgacgtggaccaactttgtcaactttgtgggccgatatagatcgatatacatgggctagttagttagccgtggtaatgggctgggcttgggttatactaactgagaatcctttttatctcttaaatatctgtctcttctctacttatctctactattataaaaatttaaaatgctttaactggtactttagtgtgttattcgtgtatgagtcggtttttaagtttgttcgcttttataaatacagatccgtatttgagtcgggttttaagttcgttcgtttttagaaatatagaaggagacgtataagaaatcctttttaaaaaaaaaactcgcatgctaactttaaatgatcataatcctaattacagctcatgattttttagaaaaatatatatctaagtgaattatcatagtgaatttcactttaactaaaccatataataataataaaattaaaattagccttcaactgttgaaacgcacgggcatttttctagtattataaaaattaaagatgtttccgctgatattttggtacatcgttcgtatttaagttggtttttaagttctttcacttttaggaatgtataaggagttgtataagaaatccttttaaaaaacatgcatgttaacttaggacgagagtcggagtcctagttgcttcagaattcttaccaaactataagaaatcaacgtatatgatatgaccatcatcccaataaaaattccaaattagatatcaatactatcaaaataaatatcccatatactttttagaaaaagaaaatataacaacaatatgattaaaaatagtctttatccgttacaacacacgaatattttttctactaaacgaaaacaaagaaatctacgtaacgggagggatcccctcccgtgcaagtacgtatccatgttcccttgcttcccataggcaactgctccttctccctcttacttttagtggaagctactcccgctactaaccatgggtataaaaaataaagattaaataaagaattatcgtaaaattataggtttagtgtcaatttaatcacaaaactataacgcttcactggtggagtaaccatctttcgtcggtcggccgatttccacaatagtcccggttgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggccccctgggatctttagtcccggttggtaacaccaaccgggactaaaaatcgtaactttagtcccggttggtaataccaaccggaactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttacaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaaatagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacaggatgctgagacaccccgccgatggttcgcagtggcgaaacatcgagagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtaccccacgcaatcgacgtgatgcacctcactaagaacctttgcgtaaaccttcttggcttcctaggtatatatggaaagtcgaaagatacactggaagcacgtaatgatctgaagcatatggaacagcgcagcgaccttcacccggaaccaaaggagaaaggcagccattacttaagtccagccagctacactcttagcaaggcagagaagtaaagtatgtttcaatgcttggagagcatcaaggtaccatctggatactccacgaatattaagccaataataagcacgaagaagaagaagttcacaaacctaaagtctcatgactgtcacgtgttgatgacacagcttctaccaattataataaggggtatcctcccagtcaatgtccgggcaacaataacaaagctatgttctttcatgaacgcaatttcgcagaaggtcatcgatccggataggttagaagcccttcagaatgatgtggtgcaatgtcttgtcagctatgagttgatatttccaccttcatttttcaatataataatgcatctgctttgtcacctagtgaaagagatcggtattctcgggcctgtgttcctacacaacatgtttcctttcgagaggtacatgggcgttctgaagaagtatgttcgtaaccgtactcgtccagaggcaagcatcgccaaggggtatggaacagaggaggtcattgaattctgcgtagaatttattgaagaccttcgcccaatcagggtacctgaatcacaccatgaagggagactatggagaaaggggactctcggaaggaaagcaataatgacggtagacaacaatttattccgtaaagcccatttcactgttttacaacaatcttcattggtggctccttacatcgaggagcacttggctctagttcgcgccagaaacatcggtaagtccgatgcatggattacacgacatcacattgatactttccccgcatggctgcgacaacatctcatgggtaacgagacgattaaccagcaactggccttcctggcgaggggtccatctggctcgatcgcgacattccagggatatgagatcaatgggtacacattctacacacgagcccaagacataaagagcacgaaccagaacagtgatgttcgtatcgatgccatgggacacgatggtacaactggcacatattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaattgtcggagtagaggacaagactgacgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggacaatcgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgttaattagaatttttaacaatttaatatcatgcatatgctaataatatatgcttattagaatttttattaattttaaatcatgcatgtggtatttacataggttaattagaatttttaacaatttaatatgcatatgctaattatatatgattattagaatttttaacaattttaaatcattcacgtgcttattatatattatccacttaatttactacagacaacaataatttttcgaaggttttgtcattaatttttcgactttaaataattttaatgcattatttactattttagaaacacatatgcaatgaaattcaatattcagtgctattatctttagtccggttcttaaccctaaccgggtttaaaaagaatttggaaatagcgggaaaatatctttactcccggttggtgagaacaaccgggagtaaagatatctttactcccggttcgtaacaacaactgggagtaaagatcatctttactcccggatgttgttaaagataagatctttactcgcggttgttgatacgaaccgggagtaaagataactctcaccaaccgggagtaaagatctgggggtatatatattcccagtgcgccctcgtcttctctaccaacattagacgtttttcctccgatcggcttctagctccttcgccgccactgcctaggcatccccgtaccgacaccgccgtcgtttttcgccatcgtctcgaggtcctcgccgcctccgccgccgacgccgccgccgccgcatctctcgggtgagagccgccgctgcctccctctcttttgatctcgatctcgatctctctctctctccaaaccgccaccgtctagctcgttgccgacgccgccgacgacgtagacgcgccgatgccgacccctactccgcctgccgccgatgccaaccccgacttccacgcaaccgtcaccgacgacgcc

SEQ ID NO: 74745 - DNA, 33481 bp, Oryza sativa
  unsure (1)..(33481): unsure at all n locations
taactcacacaggtggcaatttcatatgtatgttaattagagtttttaacatttaatttactagcattcatatgctaattataattgactagaggatttttaaaagttttaaatcacgcaagtggcaattttaaatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatatgactattcgaatttttaaaaggtttaaatcatgcatgtagcatttacatatgttaattagagtttttatcatttaatataatataattcctacgctaagtatatatgatgattacaatttttattaattttaaatcatgcagtatgtacatacatatcttaattagagtttttaccaacataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatccttagtcccggttgttctcaacaaccgagagtaaagatcttttctttactcccggttgttctaaacaaccgggactaaagatatctttagtcccggttgttgagaacaaccgggagtaaagatccggggtatatatattctcggtgcgccctcgtcttcttcaccagcacttagacgttttcggccgatcgatctctctcggcctctctccttcgccgccacgagacgctcaatttcatcatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcatttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccacttgttcttcaagaccccaaatgacctctcaatgacattccgacacgaagaatggcagtaattaaagtgctccctttttccccttggcaatgtgctttcgttgtactcttggaaatgatatgttatacccttgtatggtgctagataacccggcctatttgggtatcccgagtctacgagataaaactttcctggaggtggctttggaaacttggcactaaatctagtatgtgcatcattgaataccctcatgtcatgaaccgaaccaggccacccagcaagcacgaaagtaaatctcatatcgaagtcacagacacacataacattctgactcttctccttatgtctattcctatgttgaacagcagctgaatttggcaccacaacttggatgtgagtaccatctattgctccaatgcaattatccaaatatggtgtgtactgaggagaaagcaatttcttatggaatgttgtgaataagggatcttttggcctaatgatatcttgtgcaagtttcagtagagcggtcaaaactgctttgaacttactatgtactgttttaagagacctaacaaatctgtcttgggcttgcctaactgattggggagcacctactatccataaaaaaagacccaaacactccatggaatccatgttgtttgtggacttcaactcatatgattccacaagcacagaatgtaacctctcaaaaactggcctgtgcatcctaaacatgttgtaacaagcagttctattagctaatgttctcataacccaatcatgtccagactcaggtgctacccttcttggagccttattagagtaaagttccaagtaatacgtaccaatcatggcggcaagcatacatgctcttctcctgtccatttctcttttcttcaaaatataaatgataagatcaatctcatcatcactgctatcttcatcagagatatcttcatcaccactgccttcaccatcctgcaggtgtgacatatgcatagaaagaaagcacatcataaatataatatgaacaaacttcaagaagaaaagaagggaaggtttaaataggtccacacatcacatgttcattacgtcacatcacatcaaacaagttgatagttcaacacaaaagtagatcataactaatgcagctaagacacaactaatgcagaccagacccatgatatgcagctaaagaaagggatcatctaatacaaattcttctgctggcaccatctcctcagccacataaatcttgcttctttagtgctaatgttcttaaacataactctgttatgtttggaagcaaacaactgtgtggcacaaaagtattccacactgtcttctgctgcaccacactctactgccaacctctgacagtttgtcaatgactcagcaattgattctttcttctgctcctttaacttcttgctgttaacaagttcagtaattagggtatttgacttatcacaatcagagttgaaagaattgagcagccccttcatgagctgcaccactgggctcttgctttttttcccaggactagaagctgtggacacatcacagctgctactccctctcttcctgctgttattgctcatggggctgttctcataaccatcccctacagctctttcccctctagctgcctcccctgcatcccctgcttcttcttctccttcctcttcatcttcatcttcaaaaccagggatgtatgctgtggaaccatcaactgcaactccttgaaatatctctataagaaaatctaagtactcagggttgccatggcgaaatttcttggcgtcccccttctcctgtattgacactaaatcaatatcacagaaaactctaaaatcatgtaaactagctatatttttgacaactgcataccttaattttttttcccaccaagcatttgatgcaattatttctccactagcacttctaccagctccagtttgttggttcagccacacccaagcactgtaataattctttagatgggtgaatctattctttatctgtttggttgaatgccttaggttagccctttggaaatatttggccttcaaattctggtaccctctagttgtccatgctccattaggacaatgcccatccattatttcctcacatgctatttcacacaatgtgtaagttttttcttctgtccaatttgccttgtcatacgtattctaggaaagacaaacatgatttaaccctaaattaaacaatgaacaacatatactgtaatacaaatgcttagatcacggcatccatagcagtatcaatatcatgagcaacaattggcatatttcgcaatagcacaaaagagacataacagaaagtaaccatggggggtttaccatgtgctgaccatcaggaccaaagtcctcttcgtcttcttcgttgccgtcgtcctcggacacatttgtcccttgggacgacgaggcaccggctcgccgtcctcctccgaagactccaaagttgaaggcgggtggcccgctgtgcgacatggatgccccatgacctcggacgcctccttgaccagacgatgagccaggaggaacaaatcctcgcattcccctgccagatccagcgccattggtcaacgacctgccacggcctcgtcctcctcctctccctccacgactgctgccacgtccccctcccgccgctggaggaggacgtgacggggggactgtggatctgctccctgcccgaatcggaggtaacacaaggctacccggttcaaggatctgttggtaggaggcgaaatcggggaaggcgtcggcctgggagttcagatcgaggccccccgatccccctcccccaaaatggatgccggtgccatatccaccatatcctgaagacccctgcgagaagccgtagtcggagccgtccatgtggcccgttggagcttcatttaacgactgggagaagaaatcgtgaggatttccacccgccattgctgatgcgcgattcgtgaggcttgcgcgagcggcgtcggcttgcacgacaccggcgaaccaagcggcgggcagaggactagctagcgcgtagctgcggtgggggctaacgcaggacggcggcgagggcgcggggttgtgagtagcgagagagagacgacgcgaggaaatggatagggatggctggcgtgaaggggcagtggctggaatagagccacattttcccaatagagccactttagtcccggttcttaaccctaaccgggtttaaaaagaatttcgaaatagcgggaaaagatctttactcccggttgttctcaacaaccgggactaaagatatctttagtccaggttgttctcaacaaccgggagtaaagatccgggggtatatatattcccggtgcgccctcgtcttcttcaccaacacttagacggtttaggccgatcgatctctctcggcctctctccttcgccgccactgcctagggcaaatccccgcgccgacgccgccgtcgccgtcgtctcgagctacgtcctcgccgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgacgatgacgcgccacgccgccgccttcgccgccgccgcatgccaacgccacgccgccgccgccgccgatgccttcgccgtcgcgcgcgcaatgccgtcggcgccacgccacgccgccgccgtcacgccacgccgtcgccgccacggccccgcaacgccacgccgccgccgccgccgcgacgccgccgcgccaaccgccgccccgatgccgccacaccgccgttaacgaacgagagcgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacggacgtgaatgagaacaaacgaacgaacgtgaatataatgagaacgagcgaacgaacatgaacgagctagggaacgtgaacgaacgttaacgtgaaatgcaatatatatatatatatatatgttacttcgcatttatcctaatacatctttttgtatcttgcagaaaagacgtgttgtcggagtcgtccgtcaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaagggaaccagcaggggcacgtggaaagggatgtggaggggaaccaggaggaggaggctagtgatagtcaaccctccgttggacagaagagggcacgcgggcaacgaggtgcagcgaagaagcttgagggtcggcacatcataacggaagtgcaagaagatggacgtcctagtgccccggccgaagcagccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcttataagacaggtgaacaagggcaggcgatgatggaaagaaacaaagaaaatgccgccaagaagaagtaccatcaccacttggggtcaggaggctatagcgtcgcgatgccaaagtgggaggagatggaggctagcttgattgagaggggtatcgaaacggcaacagccaattggccggaacgatcgaagttctggtactatgctcacggtggaacgctcaacccagctgatggctcactggtcttcggcgatcagatacgagaggctgcacgacgactaacagatgcagtggaagcctcctctcagggcacgttccgaccagacagagatagggacgagctgacactcgccctacagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtaagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttccagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaggcgcgtacgaggacctcgagctggattaccctggaggagacggtgagacgcatctacgagacacaagccatgccattattctatggcgcaggcggtacatcatcctccctggtcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccattgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattgtactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgtggcaaatggagagaaagacttaggcggaagttcaaatttcctgttagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatataaaccatgcagcaacagggccatgaaaaaaaaaaaggtcagctcgatctttactcccggttatttcaaccgggactaaagatagcgatctttagtcccagattggtactcccggtttggaaaccgggactaaaggggggttacgaaccgggactacaaagggtttctccaccagtgcttatagcttcatagtggtagtgctagggatttaaaatttaaaatatgtagttttgtgacaacctcaatattaaatatgtagttttataatgtttggccttaaatatgtaattttaggatgaatttatcgctaatatatagttttgtgataaatttaccattaaatctgtagttttatactggtaattttataaaatttactcttaaaaaacagtgggatccacgtgatactgtgaccggcggcgagagacggctgccgctgcccagatagcccatcttcaatcataccattgcactagaaattcaaacaaagattgaaaactctgtcggcttctttttttttttgaaaaaaaagaagaaaatatgtcatttgtctttctgacacaggattgtataatgtatagagaaacatagttgccgtcacttgtgtatcgataatccctggtggaccatgaatacgaacaggacgacgcgtacagggtacagcaataatcatcgatcatcaacccaacaagacaacatggttgctgtatcttgagacaccaatctgaataatagacaggacatcgcgccagctcttcggaagttgcctttatttaatttgcactaatccatcgctacaatgatacaatctcatgttactgttcatcctacacagataaggatgtactcatgtaggttgagaactatattgagatagtgcttgctcacttttgtcaatatgatgcatacaatttgcaagaagtacgtgagcactcactttattatgctacagaaccaattttgcaatgtacttacacaacagtaccaagacaatgccctgtgaatatgcagttttttttaagctaatgaaagttttaattgaactcagttcgtcaagttgatacaactgtactgagaatactcccaaccatattatctctgaaacttcaaggtgaatatgcagctgtaatggtaattatctccgaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgccgttcccttccaaattcgatcgatcctttccgtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttccttctcgtcgccggccgccgtgggccttcgccgccgcctcttagcccctttaaaaggacccccgagctcttctctaccagtcgcctccctcgccttcgcctctcgtcgtcggaaacgctctagcgccgtgtagcctcgagccgccgtcgccgccgttgctccagccgagcgccgccgccattccagacgtcgccgttgctcgggaagaccgccgtcgtggtcgccaagccgtcgccgtccttgtccgccccttcgccgtcgccgaagatcgccggagcaccatcgccgccgtcgacccgaagaccgccgccgttttaacctcgtcgccgtcgccgtccgttggtcttccgccgctcttttggtcaccggtgagttcgccgcgtcgcgctctacccgttggtgtcctccgttcgtgccgaagcgtcgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatcaagtctgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctccgggccngngcaagcacaaccccaccccccctcaggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcctttcccaagggaagcggtcaagtgtgacgccacccctaaagcctggtgacaggtgggaccggtctccgtagttgggcaaaatgcccaacggtctcaatccatgcacattggtattgataactttgtttgtccataatgggcggtctattcaagactgccacaccacttgagcagcgcgcgaatctgggtgagcagatttgtctcgcctggagatacggtaacgccgcttcggacggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaagtagtgggcgcgagaaacgaggagccaggcccagcgattgcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccgaggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacctcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgtcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatagatcccgaccgcgtctccattctaaccattatgttgggggtcggggcctcagaggagagagcccctaagggccacgacggcgcgggcgagcgacgccggagggaacaacctgccccaggagggggtcgtgcttctgggccccgcgtcgggggctcggggagcagccgccctgccgacgcccaggggaagaggaagctgggaggtacacctcccccatctcctccccgagggggcggggcggcgcgtgccagcagtcggcgcccggagggggccgcgccgacgtcgcagcccgagggggtgcgcaagaagaagcggctccgcaagacgggggagacggaaccgtgccggggaaacctgatttcccctccaaggtggtcattcaaccgaccccctcgcaggttcgtctcactctcattgcaaccatctttctccaaaaagaagttttttttcttgctcactttgttcgtcttctggctttttttttctgtttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgtcagccgctgctggcgcgtcacttgggcccactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgcgcagaacgagcggagctcgaggccgcatgggcgcgtgttgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggtgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgccagcggtgaggatgacggtggcgacgaggccggctacccgggcgcatcggaatgagcccccgagcccccgccaatctttactttttttctttttctttcttctaaggccttcatgcctcttttttgtataaattaactcaatctgcaatcagaaacgaaatgatgaaaaaatttttgtgttagttttattttgctatacatatgcgatgaggatgatctgtgccatggtccttttgcgccttagcttgaaataagggctcgtgcccaagtcccagtcctcgaatggctcgggtcggggccagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggtggggttgagcacgagtgacattatttcaagtcaagattcctcaaaaggaaaaaacggctcagacacaacctttagaaaattgaaactgcttctattgaaatgctgaaataaaggaaaaaggaatatatgtgcatgtgtggtagcccccggctaacccggcacacccgaggggggtgcggggttagcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgttttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaatcacattatcccgtctgggcacatgccgaagctctatcccgtcaaaatggcgctccatacgccgtacttggcgcacgtaggcgtccatctgcgggtcggagcaccggtactccttacagacttggttaacaaccagctgagagtcgcctaacaccaggaggcggcggatccccagcccggctgccaccctgagcccggcaaggagtccctcgtactctgccatattattagtcgctcgaaagtcgagacggaccaagtatctgaggacgtctccgtttggagaggtcaacgtgacccctgcaccggcgccctgaagagacagagaaccgtcgaattgcatcacccagtgggcggcatgaggcagctgtgaggggttcgcgctggcctcgggcattgagacggtctctggagccggggtccactctgccacaaaatcggcgagggcctggctcttgatagcgtggcgtggttcaaagtgcagatcgaactcagaaagctcgattgcccattttaccactcgccctgtaccctctcgattatgcaagatttgaccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtagacaggccgctgcacccttcggtggggccgatcctctttgctaggggccgtacccccggggcgttcttcgtccaagtggccccttggggcgcactcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccctgctctttcccgggtcggctcagcacagggttagcctcggggtcaaagggcgttaagtgtggccttcccgcagtggcctcggggccttcctgagggtcggggacacccagcaccgtttgacaagcgggcagagggccgtctccggtcgtcaggggccttaggccaccgtttgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacatccctaagtttgctaggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagattctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggtattgatgtataacaataggttcctacgggggtaatgaacgcagttttttcctcatcctccctagccatgcgaatctgatgataaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcgatccgctgcctcggggcggtgggggcagaggtgccaagcctctcgtcaccaccctcgggcttggtcgcggcagcgaggtggtccgcgcgctgctccatgcaagcaagcgcgactttaaggtcgccacggacagagatggggccaccagggcccggcatcttcatctggaggtaggcatagtggaccgccgccatgaacttcaccaacgcgggcctcccgaggaccgcgttgtagggcagactgaggtccgccacatcgaagcttacccgctccgtgcggaagttggcgggtccaccaaaggtgaccggtaggtcgatgtgacctaatggccacgtgtgccccggcgtcacaccgatgatcggttgagacggctggagcaccatccccggggccttgatagcatcaaaggccgcgggggaaagaatgttgagagccgctcctccatctatgaggacacgtcccaacttcacgttgcagatggtgggggaaaccaccatcgcaacctgccctccccgggcaatgcacggtgggtggtcggtctggtcgaaagtgagagcgacctccgaccaccgcgctcgacgcatcgcctcatgagtaggggccatggtcagaagctctcgtttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttatggacggagcaccacctgccggcgggacgctccctgctgggagtaccagcctctttctttttgtcgctcgcaggcctcccctttcgggtggcccgcggagtgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagttccgcggtagtctggggctctttggaggcaatcttttcgagcatgcggttgtgccgcacaccccccctgaacgcgtaaatcaccgcgtgtgcagggatgcatggtatagtattgcggacttggcaaaaccgctgaatgtacgagcgaagcgactcattatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggcgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacagggggtacgccggctattacgccggcgctcgatgttgaggcgggcatccggctccccatgctgatcctcccgagtcgaaggcgtcgacgagggagtagcagccgaatgacgtgcagccgccgccgctcgccgcgccctccgccttgacgacatggagccggtggtagcggcgccggaggtcttggtggtggcggaccgtccaccagcacccaagcgctgctgagccgtcatgaccaagttggccacgtcttccagccatcgttgggctggagactccgggtcatggacgacaggcgggtgtcgtaggagcgcgccagcagcctgaagcgcgccctgaggcgtgctgccgtcgccgtagacgaggaggcgacgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctcggggccgngcaagcgccncccgaccccccctcaggggaaatcacgaggagggcggacacctcaccctcgggcccgacgtccccgaaggtgccaggccacgtgggcgattgcgtctgcctcaagcctctggtcatgatactcccggtcccatatcaccgacaaagtcgatctcagccgtccgttcgcgtgaaccgccgccgtgcacccggtctaccgaaaccctagccgctgacgcaataatcctcttttccttttcaaaaataattcattattgcgccataattcaattaaaatcaatataagtattttaatccgatttaatcttgaaaattcataactaattcatcttagctcggatttagttggttcaagtctctaaatttttctaaaattgagatctacatgttaaaaatatccacatgtactgttcatgcttgtttatgtgctgtttggtgattttgcttctttctgtttagattccgtcgtttccggagagtccgttttcgcagcagaagagtttgaagagttccaaggccagcaaggcaagtcacacagatcccaaacaaccctttgagcatgttgatcatattttaagctattgtttctattcaactattgcatttattttcgaatgtcattgggtggaattaacctattctttgttatagcccttttgttctttattactttattccttgataccttgggttattataatttgactagttgagctttatttatattggttcaactagatattagatataattgcttagccctgcttagaaacattagcacattattgggataacttatgactcactattacttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccagccacaagccagcgtgggcaacggctttatcttttgtatagcatggttcattgcagagcaccagactgagaagtggcggagataagcccacggggggtcgctggggagtccatgccttgtttataagggggtgattatgatccagaaaaggtgcgctgtaatggattgtgttgtgcaaggagtattgtcacaactcctttccgaggtaccgtggtggtattgaggcacatggtgacatgatgtggggttgtgtcttgtgggtacagtggtacacctctgatcagagtaaaactattcgaatagccgtgcccgcagttatgggcgggtctaacaatgtctttcgtgattagtctcacacttctcatcttaataaaaggtgctttaattggtaataatttgatttgctcctggtttggaatggtacattcctggtttggagatagaactgtgcagccgggatggttgttcagaatggttgggcctgtacaacagggtatgttgtgtagcgttggattaatattgtttaatacttaactgttttattaaattctcaaatgtttgttaaatgctgtttatgcaaatgaaaactctactatgccatcctttggtatccttgtgcacttgcatatttgctgcgtgacttgctgagtatgtcatatactcaccttgcaatcattcatcagaggaagagttctacaatgatgctgctggtgtggaggattaggtgtagccttggtcaagctacctatggagtggagtcatccgcaccgtttatcttattttccgctgcttagatttttattgattgagaggaactatctacctctgtaatgaccttttattcgcctattaattagagtaataattgtactctattatcaatttgttattgtgtgcctcggctgattcctggacgagggttcacacacatgtaagcgtttggaattttggatagaaattccgggcgtgacacaccacaatgtaatgggttagccgatcgagttcaaatatcacgtaagttatgcaatttgcaagaagcactcactttattatgccacagaaccaattttgcaatgtacttacacaacagtaccaagacaatgccctctgaatatgcagctttttttaagctaatgaaagttttaattgaactcagttaattcgtcaagttgatacaactgtactgagaatagtcgtgggtatgaataaacatgggcagatgaccgtcagtcctcaacatgacacatgatgggtattaataacccccacaatgcatgatctgcccttcttgtttgcatttatcagtagatgccaaactagcaatcctcttccatcaccacatgaactatgcaattgcagtacaaccgaagaattaatctcacagttactactatgctcaaacaggcttctccactggtcagttgctatcgccgttttggacggaaacgtagttttcccaagattcgcacgctcagtcacaaatcatatctagtcctgatccattgtgagtttgacacatgattgtgaaatcatggacaagagtacggtgttaaagaagtctctcctgctctgagattcttgggcccagcaagagtacagtgctgccttaacaagagcaccagtaaaaattactaaatcacatttgaatgaataatgctaaaatcttgcaaatttctaaacttaaaaatctgcttcatgattcaaaaacatcaaatacgtactgagggagaaaaagaaacatcagtgcaacactaacaagtacggtattctgagtcctaaatgattcctccgtgtaccttaaaatggtaatactaaatataacatgtttacagaacataaatagcaaacacacactggatcgcatgatacagaaatgtgtagttttttccctactaatatatgctctatgtgtttttgagtcacatgattgctacttaaaaaaagggccatgtacaaaatacacaaagtagaacacttgtactacaactacgtacaggagcacataaaaacaatgtggaccagtaccatcaaactatacatatttcaagacaaatttagttctaaaaaaagaggacagatttgtagccatctgcttaattagctcaagtttattaggacagacacaataaatgcaagttaaagaaaattgtatttcattctaggctgaggtgggaagggcaagtttgctttagttcttttcatgcgattaataaattattaaccaagtattaattagtataaatttgaaaagaatgatttatttgatcttctttaaaaaatacatataattttcttttaatgaaacacaccatttagtagtttgggaagcgtggtcacaatgaacgatagatttttcatgccgaactcactaacaaacttagcgtttaaagaagctgcttaacgaacaaaatgagttccaaacatataaaataaatgattgaccccgaataatctgctcgtgtaaacatattttttagacgaaaacttgatatatttgtctttgtagatatatttttacaggcggttctttcatgcgccagcacaaacttgatttctgtataccataggctagaggtgaatcgagaaaaatgcccgtgaaaatgggttattagccacctagacaaacacattatctgtactagtgtcagcgcatttcctaagtttgtgtatcctgtcatgctattatcaccgacaaagaatatatgcacaaatataatactgattatttacattccttagatgtaccaataagagctgatttttattacttcctccgtccaagattgttgcaacctaagattgtaataggatgggtctaatctcattataatctagattgcaacattttaggacgaatgaggagtaattattttgtggcaatgctgtgtgaacaaatctaaggtatacaagaatgaaaattgtgcctctctttagccgtttccatgcagcaatgcatattttaaggaaagtcggcatatatattcgatataatcttgcatactctctccgtactcgtaaagtaagtcggtttggacagcgacacggtctccaaaacacaactttgatttcttgttctataaaatatttattgaaaagtgatatatgtatactttatgaaagtatgtttcaagacacatctattcatataatttttacattttcaaactcacaactttatgagttattcatgatttatattcgcaaggtttgacttaaatattgtcctaaacgatttcctttacgagtacggagggagtatatagctataaaaatcatcggtcaaattcatagtagttgtatagttacataaatgagagctggagagagggcagcatctccatgaaagagcatttatctaggcacatggatggtgtacttagcctatgttcttcccacatgcatctgatcctgtgagaatggatgtgctgcgaaccaaaaaagaagttaataatagattaaattcagactttgcttcaatagaagttacaaccacttattataaaatttaaaatttagttccaaaactaaggataatagtatctttgttaaagagacgacgcataaaaaaggcgccaacaatgaggaagagatacaatttattcaaattgcagtcttataagtaatctatatctaaaattgatgaaaatttgtataacctaccggtatgcaacatgaataatggaacccttgttcagctgccggcatatgcaactggtgcaggaagacagtaagcgcgtatactcattatggagttcatagctcaagcagccatataagttcccacttgatgcagcatgggtgcctgagaaaatgcacagtagctagtacatgaatgtaggacatatatgctgtgttactcaaggaaaaaaagaccaagcacatccagaccatgatgacaataataatgccttgccaaatgaccccatctatgagaggacactattaagttatgtactactaacattagacgcgttatcttaggttgctttttaaacggattttgggctaggctacttgttcatcgtgattcgtgaacatgttttctaaattgttaaacatgtgtttcacgcaaaaacaactttttatataaaaatttcttaaaaaaatcaaataaaaatatagtatttttaagtttataataattaatactcaattaatcatgcgctgttgacttgtctcgccccaccaaaaatctaagccaaggagctgattcgatctaaagccttgcaaaagaggaaatgacctttctcagttggaaaaagaacatttagatcaaaccatgattatgcacacatacttaataccagtcttaagatatatccactggtggagaaaccatctttggtcggtcgaccagattttacattaaaaaccgggattaaaaatatctttagtcccggtttaaaagctacagggtacttttcaatctttagtaccggttggtgttaccaaccgagactaaagatttatttatagtcccggttaataacaccaaccggaaaaaaagatcgccatacactttactcccggttggtaacatttatagtcccgttggtaaaaccgaccggaaaaaaagatcgacgcggagatcggagaggtggcgcgatcggatcgaggtatctcctctcctttaactcctctctcctcctctactcaaccttatctcctctcatttttaactcctctcctcaaccttatctattcttcttgtctctattcctctccttctcctctctactgccaggcagacgcgagggcggcggggcgcggagggccggccagcgtggcggcggctagcggccgcacggcggcagggctcggtgggccggccggccagccggcgcgacggcgacgcgcggcgaggcagcggctttctttttttgtattattttttttgagaatctgggattgttgtgtgatgtatttgattggatctgagattgttgtgtgatgtatttgatttgtgtgtgatgtgaatatgtgatgaattttgtagaagttgtgatgtaatttttttaaagattttgtgatgtatttgagtatttgagatgatcgatttgtggatttggaggcaatttgaggacgattgatttgggattttggggacgggatggggtgaaatcaatatatttaaaaaataatgaagaaaagaaaagaataaagaggaaccggaaagagcaaccgaattagcctctttagcccggttggtaacaccaactgggactaaagatgctttatctgttaccaaccaggactaaaaatgaatttttactcccggttttttcgtagtcccggttatagggggttacgaaccgggagtaataaccatttctccaccagtgatcctccatatctgagaccaaaatttaaaagtgtacaaggggataacagtcaattaaactattttataacaataaacagtttcacttcctaccttatttagcctataaataattaagtactagtacaagataatgctccgaaatcgcactgctggaaactgtctctaccgtaaagttaggttagaaaactaaatgcgccagccacttaacagattcatcagattatccatgaatacattgaaggtcaatctcaagcttacatgttacaatattgaatacctccatgtgctgttccagggacaccgagtatggcgaatctgtcaggtgttgggtagtggaggaagaacttgaatagtgttagttggttggcagcttacaggatgacagtttaagtgcagttaagccccaatggcaagataaaccggccggtatattacataaacttggatcataatatttgggatcacaagcatccattcaatgaaggtaaaaaactatacgcgctctctagactctagtgctcttaaagaagaaaaggcacacagaaggacgaggggagctttggttgggaggtacagagaaggttagaatgacaagtaatttaaaacagatagagtacctattttctgctaattctaaaaattgcatgagcttatatatgaaaaagtttataatttgtatagttacttgcaattctcatcaaatacagttatctaagagtatataaattatttctgttgtaaaggaagtaaaaggtaataatcatatacgtacacgagatcgagcgcatcaacaggctttctagtacaatcaagggacgaatggaccaaaagacttgagatggatttcctatttcttatttttactttttttatctgtcatttaaaacaacaaccggtaattactccctcggtccctcaacatttgacgttgttgactttttaaaatttgtttgaccattcatcttatttaaaaattttgtgaaatatataaaactatatgtatacataaaagtatatttaacaatgaatcaaatgatatgaaaagaattaataattacttaaattttttgaataagacgaacggtcaaacatatttaaaaaagttaacgacgtcaaatggaacggaacggagggagtacatttttccaattatatataagtgaaatattgacaactaatggtaccgaagtgcttgtttttgacaaataaattacaatatcaattcgggatgccaactccaaataccattaattatttcaattacactcctatttttagcaccgttgtctttgatccacgtttgaactatatattcacataatacaaggtcatattacagtttattggatgatatttttgcatcactgcaaaagtactctcagccagaggaccctacagcttttatatgagcatgatatattgtccatccttaactgacaatggcaagatggaaaatcctatgcatgttaaggcacaatttgacaaggcatttcctatataaaggtagccaagtttcactatgaacaacacaaccataataccatacaaagccaagcctccaaaaactgcctcagagctgaaaaaaagaagagatacatagaagatggctcttgttattgctgatgaaatcaaggccaaggcggaggtctactatgatgatgagatctgtcaacaatgcacaaggctcttgctcaaggaagcaggcct

SEQ ID NO: 74746 - DNA, 5446 bp, Oryza sativa
aacattcgatcggcggtccggccccttagagcaagtttaatagtatagtctctaaatagctaatataatagtcaatttatacaatagttgcttactatactattaataactggtctcacctgtcataaacacattacgttttggagtccatgctgcagccggctacagatatgtagtccgctgctcttctctttctttatttatctttttaaaatatgtttatagttagcttatagcttggagttagtaattggctacactattaaacttgctcttatacgccagcttcgcactgcaatgatcgaccggtccacgatttgtcgatctgttgttaccgaacattgaccggacctcgcgcgatgttccggccaccgcgacacgggaaggcacacgtaaccgagcagatcgatcagcaggggaaatcacgcaccaaacccgcgcagccccggcacgttgacgcgctacgcgctcccgcggaaacccagcgctgatccgggcgggtctcgcgtgcacgcgtgcccttggagcaggaggacacctctctgcctccgcggggcgggaggcggccgggtgtgagtgcgacacggcgagacggcgagtctcgcacgtacgcgcagcgcctggccacgagtttccgaggggatagagataccacgcgcgcgcgcggacgggcaactcttggatgagaacgccgtacagcgacgttacgcttacggcgtggcagcgcgcgtatctggatcgcttggcggagtgacgaatctctagggccggtcgcgctcagttttcaccgcgcccgcgaggggatgcactcgcgcgccggttcgagcgtgacagaccgacgttcgtccgacgaaacggagcggagcaggcaagtactccgggactgtgcactggcgtggacgcgtggctactggcatgtgtggtgcagtcgtggagccgttttcttctcgtctcatcgggaggttcggttccgacctgtcctcggagtcgcggaaacaaataattcgatcgaccatagtgacgatgctgaattgatcgctgatcagcagcagctcagcatgcttcccgtcgtcccgtaggtcggaaaagaaaactccagcacttgacaaggagcaaccggataagtgtcttgacttgttttatatcagcatctcaccatcatcctcacccatgttcgggcatgtactccaacatttaagaattggccttctctctatgtattcttcacgtagtagaaattagaatagagtttataattggaaatcttctgaacaagtggagtaaagactaaacagtatgaggtggctcttaattcaccttgggtagtgcagttctattaataaaaataggtaactagaatctatgtggtttaatgttagtcaacaatgaaaaagaattagaggtttaccctatcacctatatctattttttatttgttgaacaaccaaccgttgtgtgctttatggagaagccatggatataaatcatttctattattaaaaagagtgaggtgttaaataattgtctattatattattatactataaaaataatttgaaaataaggcaccatattcactctggagactaaaaattttcaccaagctcgacatttaattcatctcctaggatgaaactctagcgccgtcaccccacgaaagatatccaaaccgctacaccatgctcttcatcctcattggtttctgacaaacacaatggcgatggccgatggcagtaggactctattatatgtttcatcctacttcccctccccctcgactgcctagggagccaaccatggatcggacgtctccagcattgatctggcactttggcacacacatggtagatgatcttctccccgtcttatgttgtgtcgtcatccgaggtgcaacagcgatagggtacagagatatcatcgggcgtcttgtgtgccaagaagttgatataggagcgtccaaatctagctagatacaagcagcatgacatcaccaaccgctgttgtgccactggcagcgtgctagttgacgacatcggcaacggggcctggcttggggcatcacgcctacatccgaccttgactgctgccacctaacgtgtacttctaaataatgttttcatcgatattcaaggtcttccacaccaacctatagattggtgctatcttggttttgattgacaatatcgcttatgtccacatcttactcgttctctagatggacactatggatttgtgagtgtgtgcctatatattggtttgctcgcagcgcgattattgtagggtatcacgtctaaacaaggttataggttatggtgtttatggtcgattggattgtgctaatactgggaggcattatggcactagctcggaacaagagaataacaatactatgagacttcgcttaggtggtgctcgtcgagtaccgtttcctcaactcctaggttatgaatatccagatatcacctagtgtttttccctttgcaggttggctttttggctgaccctgtacatatttctcttgtatttctgctcctctattaatatacgaggcaaagcttttaccctcctttcaaaaaaatgaatatctggatttagccttagctagttataccgggcaaatagcagtttcctcttccttgttgggggtgttgtctagacttttaagaattgctctctacagtgaaaacctatggtttagtctttgttgatcggatcatgacaacatatgaacatacctgtgttcttatcttaggtgctattttaggggaaccttagtcgtagtccagtgttactttggtccacgacgaggaaccttttaaaaatctgttgtatataaattacaaatatatttgcataattatagaagtcaaaagttgtatgaaaaatccaattccaattatatataacccttcctatatagccccgttcacttctcagctgggccttttttacaggtacctttcagttgggccgagcctgatacagctccaggctgaactggccgaaattttccgggacgtcagatgcgaaacgaaaggacaggatcagaactcagaagctgactccaccgaccttccctgccaatgccggtgcgtccccctctcaaaaaggttccggcccaaactcgagcagatttgggtcctccctcctccgcctcctccgccgccgccccctgtatcccaccggctcgccggagagtccgcctcgccgccgcggcctcacgggcgcgtatccagcctcgcggagagcgtgcggaaccgcgacccgtactagggcagcgcgagagagaagctgctgcgccctgcgctgcaaaggtatggctgttactgttcttccgaggggtctctaaatttccggcgattcgaagctttctaaagcatcccggatactgtatcctgtaggctgtaggtagattccgacagtggaagcgttagccgtccccttgcgctccgctgccaattggtagtctcagaatgtgtagatgcagcgtctgcttggggaatagggatgctccctatttgcgctagcctgataggacggcacttcagttgcaatctgatatcctgcttagtgcagaaaagccaaacatggcatgtgaagcgtagaaaatcagaagtaattttgtaacttctcttgctaggtctacagttggagctcttgctgctgcttggaagacttcggacaagaacctaagatcatggtgagttcataaattcacttcaggtcctgttaagtaaccatgtgcaagtttgtttactttgacattcggttctgttcaggtatgtttcttctgttctgtggtcatgtgtgatgtgttccatttttataaacagtgccattttacaggcaagccttgctgattctttcttagcggatcttgatgaactttcagacaatgaagcctatcctgtgagttggtttcagttactatgataatacagattttacaatgatttatttattgagaatttgttaactaatcatcaaatttcaggaggaagaaaatgctgaggcagtgggcacggaagagattggtgatgatgatatgcctgacctcgagtctcttaattatgatgaccttgatagtgtttcaaagcttcagaaaacacaacgttacaatgacattatgcaagtatgtgatcaagctcaaaatctcctttttcttgaagatggttttgtcctcttgttttaattggattgttgtttgacttctttcttctagttttctgattttgaagccctgtactgtcctattgtcacaagaaggctatttgcagtcaaacattaatgggtgtgttttagagtccaagacatgtttaactatatactcaatgttacaaatgctttgcgcaaaaagtacaatccttctaaatttgattctaaaggggactgtcatttgtatttttaggtaacaaagccttttgtttccatacatggcaacttacagaatcactctttgtttgcagaaagttgaaaatgcacttcagaaaggtacagatttttccaatcaaaggtcgatcctggaggaagatccagaataccagctgattgttgattgcaatgctctatcagtagatattgagaatgagatcattataatccataatttcatacgtgacaagtataggctgaagtttcctgaactagaatcccttgttcatcatccgatcgattatgctcgtgttgtccagaagattggaaatgagatggatttaacgcttgtagatctggaagggcttttaccttctgcaattataatggtaatttcagtgacagcatcaacgacaagtgggaagccgctttccgaggagaacttggtaaaaactattgaagcatgtgagagagcccttactcttgatgctgcaaagaagaaggtacttgaatttgtagagagcagaatgggttacattgcaccaaacctgtctgccattgttggcagcgctgttgcctcgaagttgatgggaactgctggtggtttgggagcacttgcaaaaatgcctgcttgtaacgttcagttacttggtgctaagaggaaaaatcttgctgggttttctactgccacatctcagtttcgtgttggctatcttgaacaaaccgatgtattccagagtaccccaccagctctgaggactcgtgcttgcagacttatagctgcaaagtcaactctagcagcaaggattgattcgatcagaggtgatccaacaggaaaagctgggcgtaacttgttagaagaaatccgtaagaagattgagaagtggcaagaaccgcctcctgcaaagcttccaaaaccacttcctgttccagactttgagcctaaaaagaagagagggggtcggcggcttcgaaaaatgaaagaaaggcaggccatctttaacctcctctttttttttctcaagcgaaaaacaaacaataaacattctcttatttaattgtgtgttctactaat

SEQ ID NO: 74747 - DNA, 13505 bp, Oryza sativa
cgctcttcttttcctagagtccaggcttgctgagagtcgtcccttttctcggtgggcaaggtcctccttttatagctcaaggggataccacatgcaccgcctctacctaacttttcatgggagggggacccacttcaccttgtccgggccacgatccgtgccttcgcccggaagctaagcagcagcccgtccttgagcgcgacccagcgccgccccccgcctgacacgggggacaaccctgtcatccccttataaatgggtgaagacttgtggtggtcctcctctcgtggagggagctccgaatgacgctccgatgggacgggtcatacctatctccactccgccggatacagaggcgacgtgggggcacggccgcttgtccaatcggtcttgaccggcgatgggccggtcacagacttggtcagtcctgactaacgtgcgtcagtcgggcggcaccgcacgtctgcccctaccgcattaaatgcggtgaggggcagttggggcgcctcccattgatagcaggttagcctgagtcccctctccgctcgctccccctgccacatgcacttgggctaggcctcagggcaaggcagcacgagggccctaggggcatgacatggcaccccgagccccccccccccccccccgccgtttctgcgatttgcaaggtgcgggggtagggccaggatgtagggccacgtggctggatgggaaggtaaattcccctcactttgcatacccccaggcccatatctccgacagtccctaaatatttgacgccattgactttttttaaacatgtttgactgttcgtcttattaaaaaatttaggtaattattaattcttttcctatcatttgattcattattaaatatatttttatgtatacatatagttttacatatttcacaaaagtttttgaataagacgaacagtcaaacatgtttaaaaaagtcaatgacgtaaaatatttagggacggagggagtatcttttttttcacaaaattttatatatcttgtgaacggtgctatacttttgaaatccataaccaaatatctcttctattttactatgggtagcgtataaatgctgactgaatctatgcggtttaacactaattaataataagacagagttagggtttgtcacatcactttatatttattttttatttgttaaacaaacttatggttgtgtatcttatagcagaagataaagatgtgaattatttttcattatctaaaaaatattatcttggactttcatttcttaagtgatacaataataacacaagctctctcaatggaaaaacaaaaagtacagttaaagggatagagctaaaaaaaaaagggcaagatgcatgtatgtactatatagttgaagtggtatatattatgagtgatttactgtttttaggaggtaatacgaggtatcagaaattttctggtgtaattttataattctcagtactggtgcatccctataacaataaaatttcccgtaatatggtccatatatgcatgcatacgggattatagagatcaggcatgaagctactacacatgtatatgtatctctcttcgagcctaagctacgtatctcctagctaggagaacaggattccgaataagactaaagttacactgaacaatgctgatcgatcgatccactggacacgatcatcatgatgagcagacattcaccggccagtacatcctttttcctgatcaatcggtgagaaaaggaggaaaaggaggaagaaaaagaataaaggaaacgtgatcatgggctacaatattgtactgcaggtctcagatatttgcatatagcagtgttgtagtactgtgtttagtgtgtagtgatgcacacatgaatatgcttttggaggtggcaagcgctagcgtgcggcagtcaacaagccgagctcgagcgagtttggttacgtaggtttgagcttgatatgaacttgagctaagctcgagccgagcctggatactgatcgagcttgggagtgagctcgagttcgagctcgatcgagcttcgaacctactcgagcttgacagcttgatttgttgaaactctaaagaacttacactcttgtataagagatattaatgtaaattatcagtagtcaaaattaatgggtgctacttgtcttgaatgaaacctctgcagcttttctcatgaattcatggctttgaaacgttgcaattaacaaaagctagccactatatctaatagaaatagtagtactattactagcagccgaataattgctttattgagaagcattgatgaggtcttgagacttgaacaagtcaagcacggtgacaagtatacattgacccatcaaaaatatctttctacatgtaatacatcttatgctaatcaagccatgccgagctattcgagctcgagcttgcgacttgcgagcctcagcctaggcttgagcttggcttgtctagtattcgagccgagcttgaatcaaacctgtaacgaatcaagctggagcagcttgcgagctccgagcttttttgacagccctagtatatatacacaactacacacactcccggtcctgaagatattgggcctgggcctgttttctggtccgcgacggtggcacaactggcaccagcagtaccacgcgcacgcagcgcagccgcctccgtcgcatcaggcttgtcgaactagcccattagctaatattattaggccactgtataagtatattttagtaaaagcaattttacagtatttgaagagataaggtaagatgcaatattttttaatgtaaaatttgttaactttcaatatcttaagtaccatggcgtatgagaagcatggcgaaggatcctctcctctcatttactcctcttggtatctcttaatggctgttggaataaaatccaacaagcatggcaataactctccctctatgggagggaactagcttgaacatatggagaaccaaatgagataagttgaggagtggatgagagtgagatagcagtgaagatggagataaatgaatggaattgaacgagatcgccatctttgccctttaagaatccttttaatttatatggaatgggaaattacaatactatctttccttttaacacaggagtagcattccaggtgtggggtctattccccaacaatgaccgtgaaatttcttacaataatgtgtgtgaatttcatcactcatatatgcatgcttgcagcttgaggattgctgcatcaatgacgagtgccacaaataaaacagcagagaaaattagcatgttacgctgaacgtaatctatatgcatcacataggccacaaataaatgggccttagaatatgagggctaaagactagtgcatgtctctgtgggcaacaaagatttgctaaccagcttgcatctccgttctaaaagcgttttggacttgctttcagaggcaagtgctaaaaccccaatgtcatacatgtgtttcgttgtatgtggaagttcacaagcaaaagaggctaagtgatgttgacaaaagaatgggaagaaaaggatcgaaaaataaaagtagaatgaacttggaatggtcgaccttggattagataagcaggggaaaagcctacctggtgccaaaaggaaattaaagaaaggggaaaactttgcatgggttgtaatcacacatagtacttttgagatgcttctctgaaaacgaactacaccctgttctgcgttgttttttccccagcttttcaaacttcagaaaccatacaaggtacttcctccgtcccataatatttgtctttctaggattcaaaagttatcttaaaatagttgtcactttagagtactatttatcacatcaaccactttcaattcaaatttcttcccattctacccctaaccaccatcttatatccaaccatacattatttttaaggggtattatagtatttttctcctgaccttaatatacatgcttaatatacatgctaaataacctggaacgacaagtttgatgagacggaggaagtagaaacaaaacagatcacacaatcagtacatcattgtacgtgatcaacggccgcacataatgtactaagtacaaatccatgaattgaatctaaggaattattttatgattagacagccacgatgcaatcgatcggatgcaagcacaatctatctagctcagctaaaataatttcttcgcgtgattgtgcgcgtacaaccgacgcttcctcttctttttttttcagaaaatctttcacgtagcacaatccaaaaagaatgcactgatgctcatcggaaagatatatataataacgtgcaggagagcgaggagggggggggggggggggcagtgcaacctccctatctgtcactctgcacttgtatgaaacatagcgcgccgggcgcctctctcgatcaactcctgtcacactcgcctcatgtggtcctcttgcaatcagttgtttatttgtagccaagtgcagcagtattgactagaaattagcgcaggtagaaaagctagtaggagaattttgtatcagtgagatgtataaactaaaggatgccccgtacgttgctgcgggacttgattaacattaatttgttagatagtaggtacaatcattaatttgttagataggaggtacaacctcaagaagaaacaaatatgtttcttggagaaattctttttagcagccctatctaaaatttgtagataatttaggtagcaaattctttttagcagccctatccagaatttgtagataatttaggtagcacatatcaactgaaggtcctatccaaaatttgtagataatttatatagcacatatcaactgaatgggcgttcagccataaagcgctggatacatgtagatgtgtgtggagatcacagtagaaaaaatcggaccggaccggcggttcaactcaactgaaggggcgttcagccataaagcgctggatacatgtagatgtgtgtggagatcacagggaccggaccggcggttcaactcaactaaaggggcgttcagccataaagcgttggatacatgtagatgtgtgtggagatcacagtagaaaaaaccagaccggaccggcggttcaaccggaaaaaacctaaactagggacctcgccggttcggtgtgtttcaaggactgttcatgcagtgacccagtgtgaaccgactgaaccggacggttttcaggaaaaaccactgaagcggggactcctaaaaccggctggcccagttttcaggaaaaaccactaaagcggggactcctaaaaccgaccggctcatacgagctgggccaccgtacagcatcttccttaatgggaagcccaagtcctaaggcccagttttattttattgttcaaaaatcgggtgaagcatgggaatcgaacccaggtttgctagatggagcgttaagttccccaccactacaccacactgaccattgtggtgtgcaataaacaataaattttaacaccgcggttgaaccggtgaaccgaggcctcaccaattcgacgtccggtccgagtttttatactatggtgcagatgggtcaatatattcatgtgggctacatttgacactgagaaggcgaagagactgactcggtgactaatgggttgggctctatgctgtattccatccaacgtctgaaaagcgatctaatgcattcatccaacggttaacaatttgatgatgatgtggaagcacgaggtttgagcttttggccttaactttatagaaagaatggataacacatcttagtgtcgatttcaccgcgtacacgcataaagaagatatctgctatatatatacacacacatacacacacagacacaagtaaaatatactgttatagtagagcgaggctccaagaaactaacgtactgaaaataagcgtttagtatatactgcataaataataaacgagtcaaccttggcctaacgtttataatgtaatggcaaattattcaattaagcactatctctacttcacagaagcagctttcatgcatggcgcttttgcttgcgatggctactactgttgttctgcttgtgccacaatcaaccggtccgagtcatgcatgtacatgtcttacctttcttcaggtcaaaacaatgaaacaatgcatgcaatgcacaccgctcagccctcaattcggccagctcaaaatcagtcataaatcgtcgagaaaccatggacatctacagcgactcccacgtgcgtggacttgctgcgtcgtcttcagttaataatctgttgctagggctcattgcccttgtgatccgtgcttagccgctcatccttttcggtgccttgcatccatcgatcgattttgctctcgccatcgatggatcgatcgatctcagcttttgccatgggcggtttggattacgtatgggataagggcgtctgcaagtggcgcggcttgctagctatacctgccgcgtcttgagatctgtggagccacgtaagtcttcagttagccacgacttggagatgagatgaggatcgaggagctgatgatgaaggagcgtgatggcgagagacagggagctcagggccccttaattaatttggatgtatagcactatacgatgtagtactagattaatctttaagagtggcttgatttcttcccatgtttagtcatcgtctcatcgatcatccagtgcaaacgaagacgatgtagagtactaagttacaaatatacatatgtgcatgcaggggccactgaggctgtagacggtagttatctgttactacaatcctactatactaccttagtacgggcgttcatgttcttatacgggagtagcaatcagcaataatctgcgtggcaacaaaacgaaggtttgctggatagaagttgaacctgcttcttatcaacaatgcagatgcatgttggcagttttgtttgcatccgtggtggcagtgaagacataagactgctaaatttgcagtccctattcaaactgcataggatcccaattcatttctaggactagcagggcgaattgagatccagtgcaatttctaacaatctcagccctctatttattgatccaatggttcaaattgtgagctacaataaaactagagctgtactttttccaagtaaaaaacgctaccgtactttgctacagtactgaggcatctgggccatccgttttaaatccaatgatagctcttgtgactgcttaacttacagtcacagtggccactgcactggaaccgaatcctagcagggcacgcgctcccaatgcttttgctctgcaaggctgcaactgcgaaagctataatccgagttgtttggacaagtagcagcggcaggtcggtaggcacgcccctgcagcgacgactagctgatgtgtgtccctgtgtggcagcctggcaatggcagggcgaggccgacggccgacctgcatctgcatggccggcaccgttttcggcccatctcagtctttccctctgccggccggcgagccctgatctgtttaaagggagaaaaatactgaagtttttgtttggaaaaacaaaattcaggacctcgtgcattgcaatagtgaattgcattcagaatgattagccatagacaaaatagtttcagggtagcttcagaaacgtcgtcagagattaggcaaaccgacaggcgacagagaaactacacactggtcatcatgtacagaaaacgggaggccgtttcgagcactggcaccggaaaacgcagcctatttctgaacactgaacaattaacgtagtattaccaacacgcgcgacagctaatctcgatcggtagctttcgctggcattaagataagattcacgcgaaccgcaaccggtggtcaagggaagaggagatcaaatagcacgccaacacgcagaaaagatgatacgctaatgcgtatccagctagattataacgtgctttgccgatggcaaatcaggaggggaagggatcggattcttgcatccttcattaacaaggctgctggtttgtcttggcttccaaaaaaaaaaaaatctccgagtccaacaagacgccaaggtcgattccttgtttgggctagataaacaatatgggcttacttgtgaccaaagtattaggcccactatatgcttgaatgcggcagaacggcccacttaaaactccaaagcccagagcacctatgggcctcagccgacgtgatcacggtgcatctctcagaaggttcccatttccacgttggtttatcaggtgattttagatctatcctacggaaatttgatgttttcccatcgaaacctgattctagtggaccgtctagtaccacgtgtgcttcaaattgcaggtcaaaaggagattgtcccctcttcgaattacacctccagtctcctctccagctgtttcaccggtgaatcagcaagattacattagcatctgataggaaccaacacttctgctgcattctcgcacaagctttaagagcccgattataactcgctatacagaaatccggaaaacctcccgcattccacacgcgcgcctttgtcaacagctagagttgacaatcatcacttcatacggtaggagttccatatacacatcacaagcaacagaaatcgctcatagccaagatgcaatcctggggctggagagagcaccttgctcctcaggtgtaaaaaaaaaagggaatttgtgaggggtttgctcttcctgccacacctctcaagtctccattttcaggctttttcgcttgtaaaatttctcagcatttcaccagggacacaatttccaaagtgtctaatggagcctaagattgttccatggaggacactggcagatcactagcagcagcgtcaggcctccgggactccatcttcgcggagatctccgccatgaccagcctcgacaggagcagccccgcgacgaaagcggacgccatgagcatcgtgaacacgccgctccagctcttggcagagatgtaccccgtcagcagcgggccgaccgcggcgccgatcgaccccgtcccgtcgatgatcgccgtgacggtggcgagcgccctggagttgccgttcagggagctgtgcgtgccgaggtcggcggagacggcggtggtgatgagggcgtacggcccgttgacgagcatcccggtgacgaacatgagggcgatgttcgagtacagcgagaagctgccgtatatgcggtagaagaagagcgccgggatcgccgagaacgtgaagctcgccgccgtcagcgcccgtgcgtcgaggcggtcggagatgtggccggcaaggatgccgccgacaacgccacccacgtcgaacagagttgacagtacaccggctgcggtgtctgacaagtacactccaccgattgctgaaaaatggaaacatattggcattgtcaggtacattatcattcttagtgctaatacacatcagattacaccaaaaacaaagtgcagttcatactagtacatgacagaatggtttggttcaaaatcatgaggtaaaagattaatttggtatgaggaaaaaaaatcagtatgatattgaaattgcacacaagactaggggaaccttttctcggaaaaaggagggacgaacctgtgtggctgatataaaacggaagccaatacaggaatgtgtaagccacaagcttgcagaagaaaaggcagagagcaaatggcgctacaccaggaattctccaagcctgaatgaacccgactgccttttcttttgatgccgatcgttcttccaacagaggtgcactcatgtcatccttctcagcatccttctcatggatatcctcctcgattccaatcatctccggaccgacaggcaagaacagaaacactgcaagcccaacgactgcgatcatcactccagggactgcaaacgaccatgaccatccaaacttcaacattgcagctgcaattaaggaaccagatatgtttcccacagatgtatgagcattccagattcccattatcagccctcttttgctctttccaaaccaattaccaacaactgcaaccacagatggccagccggatgactgaaacaggccagccatcatctgaacacccagaaagtagtagaagttgtgtatgttgagccagttgccggcaccaaaggcagcagtgaaaaatccagtgcctatcattccgatggtcagaagtatcctgagatccacccgatcacccaaatggccagcgaagaacatgccgattgcatatactccgagaaatgccaagtcgatctccccgagcaatgcagtaccatcgtcggcattaaacggagcccagccgctatagagagccgtcatgttgccctgtgcatctcttaaatcctgaagatacagatggctcggccaatgcaacatacctaggttttctgtcttaggatcaagaacactcttgacaatgcttgtagtcttcctagtggcatgatagctagcataggataagaacgtcagtatcaatacaagagcctggcatgatctgaaggagataggactcccccgggcacactcatatagctgaatccccaatggcttcatccgacgtgttttgcttggggaacccatgaatgaagctgaatttggtttttccgctgaggcggctgcaaccaggaagaagtattatactgtctgcaaaaggccaaaagagaaatcatcaggagttgtccacaggaccacaaaatttaacagcttgacacaaatggaatagggaacttctggttcacaattgttcggcagcaaatggacacggtgaaagctatagagcttattctgcaaggaacacgcaagcatctgacgaaatgaacaatattttgccaaattattggggcgacgactgcacgtagtttaatgtggacgataagttaagttggtcataatttaaaaattgtataaagacgaattgcataaactaccttgcacttcgctattcgtgcgattaggtaggatgttacgatattcagaaccgacactttcttttcttgcccaagtgggatttcccgtttcatcacgagcaaaaggaaaatacaggagttgacgaccagttccgattagttgatatgcgttgaacgagcaaaaggccctatgaattgacaatacacagcgacctgaagtttaactgtgaaggccctatgttttaatgctacaaaatcaagaaccgccgtttggtcaggttcctatcttggcaagaagttctgaaggcatcattccattgtctaaatcttttttactacccattgtctaaaattacaaataatcaagttcaaggaccaagaggaaaacggaagaagagaactataattcaatcaactcaacaattggagggacaagaaacaaaaatctccttcaaccatagcatcatcttacttccgattcagaaaccgaaagaagaatcgattcagaaacgggaagaacagaaggcaactggagagaaaacaaatactccacactaatacctgtgccctatggatcccttgttaactcaacagcaagaatgcaaggagaaagcaagacgggtcctgctcttgcaagcaagcgaataaaacagacgcaaccagaggatcgcactctctggaagcaagcagaagaacaggggtccatagaaagagagttaaatcaggcccctcaaatttgcaaggcaaataaataaggcagacgaggcgatcccgtttggccgaccagaatctagtttttttctagacggatggaagatcaataaaaagagaggagatttatcctagaaaatgggaaatttaagccaggagaggaggcgaagagatttgatcagatggagcatgcaaattacctgcagtcttgcagatagaggttcagaagttggctgttccaggaatcgtcctagaaacagcgtggttcttcttcttcctggctgctttggcgccgtgaggaggcgagcggaccgcggaggggaagctttctggagtcgcctcgaccgtggcttccgaggaattactggtcttatagatgtttacgcgagtctttttggcttttgtcgtggtgaccgttccacgggccacgggcgctgttgggtcaggtctttctccggtgaggttacactaccccgtggttttcctgtggcgttcaagtcgcaacgattacagccttacagaatattacagggtcatagtagctgctgtttaacaacttcgatattcgctgcttctattccttttctcatctctgaactttcctctcgttttgaacctgaaatttacaagttagcctataaacagatttctatatgatatgatggcatacttggactaaagagttcaaaacttcaaatcatgtaataccgatctattaattagaagtacacacgcatatacatacggtaaatgtgcatgtttctgcacttctagaccgtttatttctccaatattatcaagtgtttggaaacctatacacgtgtagtgtataagtatgataaatgctcattcaaacgtactcagttaaaagtaacagaagaatttcgctggttgatgatcaaattagaatgctgcttgttcataccgggaggtgaaggcatacacctacctttgccggttaggtggattttgctaatggccagttcaaatgccagggacagagaatggggagatatagatataggatattcttctgaacaaggatattccctgtgctctaatattatgctctctaccggatcttcttttgagccccacaactgtagggccatggcaaagactacaatcttgtggctcatgttctgcccattattttcttaatatgcaaattcgctgttgagtgcgacaagtgataaagctaaacatatgacccaattagcctaagttgtatactgttttttatggtgtaggtaagccaattaacgtcaggcgatcactaacaagcaaggacctagaagcagtcaagcagacacacctaggaatcactggatcaatgagcaaagaagagagagaacggaccttcaacctccgatcgattctccccggtctgcgatggtggttgaataagtgatgcgtgaaagtcaggtgatccggcgaggcgtggctgcacgtacggcacatgagacgaacataatctatcttggtgaaagacacagagcattatgattgcaagcttccaaaagggtgtcggtgtatatgatgcacctcgatccgtcgagggagtccaggacgtgcaggttcgccatagccatagccctagcaattccgcttagttgaattaggatgtctaaatatttacgttgtgtgttactattatccaaaactaactctatttctatccccgaaaatcgagaaatacgaggaactgccacgtcagggcttcatattttatggacttgttcactttgatgtcattttcaatcttaccaaattttagtaaagttgccaaaaatttctatatttagtttgctgtcaaattttagtaactatataaattaccaaaattttgttaactatgccaaaattttggccgatcgaatg

SEQ ID NO: 74748 - DNA, 1646 bp, Oryza sativa
gcgaattcgagctcggtacccacatttttggaattagtttttttgtgacttattatccaaagtactttaagcacaacttttcgttttttatatttgcacaaatttttttgaataagatgagtggtcaaacagtgcaagcaaaatgtcaaaatcccttatattatgggacggagggagtatttaagtagcaaatgattatcactatggaaaaaccttttgatctggtcatctttgtggtccattgctcttgtggcaattgtttaagataatgctgcttggttgcaaaaactgcacttttcagattatgtaataagttataagttatttatgttaatgagcttgatatgcattttaacgatggccgctcctattcttttccatagttgcctatcaggttaactataaaccttctcttttcagatggtacttgtgcacccatagagagggacactcttagaagtcttgtggaatctggtgcaactgaaagttcaggttgtttgcctggttgccacttgggaagtgatgcccctccattacatctatccacagctaatgctcttggggatatcttttttccatcaagtgatcttttgcaagcaaatgaggagtgtgctttggctgctctcactaaattaccagaaaatggttcgtcttctagttcatatattctgttaactagtactcccttcgacccataaaaaaccaacctagttttggatgtgacatatcctagtacaacgaatttggacatatctctgtctagatttgttgtactagaatgtgtcacatccagtctagattcgttttttgttggacggagagagtatagctttcagttgtactaatacaaaagaagtactaatttcatccatgttctgtagaccgcagtaagcaactacagagtactagtagcaacctgttgtccagcctcaataatgtcgtacaagcattaagtaatcttcagttgaagcacaagcagttagcagaggattatcaaaatcaaagagattccagtgcccgaaaaagagctgaacatagacgtctaaaaggtatcttgtttagagattgtgctgatgtttctttacagttgttttaactttcaaataagcatccatgccatttaaaggaacatgtttcgcaacatttgagacctgctatacatcttgaattatcaaacatgttgccatcaactcctatctatcctccctacgcattaaccagcaatcttctggagagcattcttgcgataataggctgtactgttgcagtactcttatatttactgcgccagcgcttcagacttgtaccatattttccctatacatttttttacctagatacgttgtcctaatacattgggtaaaactaaccagatgttttggtttactttgtcaagaggagttggccagtgctgcttctgagttggaagaaactaactacaaactggcagcacttaaagctcaaagagataatacacaaggagctcgaatcccatatcctacattaggaaacaaaaatatgcctgaagataaggtcagagataaacaaagagagatgcaggatcttgaagctactcacaaggaattatcggtaactgccatcgttcatttttaaagttccaaattactacttcctccgtttcacaa

SEQ ID NO: 74749 - DNA, 1355 bp, Oryza sativa
cgataagcatttttgcgtgcttccatatcctagatcaagtgcaagacacaagtataataaaattatccggttgcatcatctgtatctcagactacagagagtagagtttcataaagagtgtaccccaaaatcaaaaaagaaatttgacctatctaccataaacaattccaaagcacttcgccgcaacaaatatctgcaagaagtcattgaaaataaccaagtaagtgaatagaaataaaaattatgtggttaatgtcattgatgctgcatgcatttgcttcacaagtattgaatgcctatttttaatctcagcagacaagaatatccgcattgcgacttgataagagtacatcagaaaacaaattctaaacatggcatctgatcagaaaataatctttaccgtctgctatatatctgatgcagagaggagatcaaccaactcctatctttatcctgttgatcacattggccgctagtggacgcatgatcatccatgttactctcgcttgcactctcatcaattataaagttaatcctcttagatgttacctacaaaaaaaaaaaaacagggcgaaatgatatcaattaacagctaaagtgggagttgaagaagcagaataggatcatgagtagcaactaaatctttgtaattccaactgtgtagctttatatagcagaaaaatatagtaaagtgcatatagaattgaaataatacagattttgaacagatccaggactataacataatataaacacgatagaaggatagatgattctttaaagaaaatatattggatcaaagaaataggatgcatagtcattactaactaaattaggtaacacggtttttttagtattatccatctcaaacaaggtgtcaatggtttagccacaaggaaaaataactgtctatgtatttgcagcaaattggacgccctatgttttacttaggggtttagccagaaaacaaattatagtgctaatcttagcatcccctagaatttgatgaacataaggtacttcattgcaatagtttagatcaaacctttcagtatataagcaaataaaataaaatgctgcagtacagatagcatattatgacaaaaaaaaaactaacactgcatatatccgagtacgtacttgacttattttgcattttcagctaaaagaaatgtttttagttaatttggaaccatcagaacattctgttcgatctacgcagcaccccattaataataattaacatgtgcacactgaaatataacgcaagttgtagtggctaaaatccaattccaccatagtaactgagaagtgttataactaatacaccacacatcggtccacaattgcaactt

SEQ ID NO: 74750 - DNA, 3592 bp, Oryza sativa
tctgatgtttcaacaaaactacaggaactcacgcatgatgtacctaaaggaaactggttctagacacactataaatctgcggtagtccttttccatctcgaagacgaatcaacgatgtgtttagaatcagctgttcccaacatgcgaattgcgcacagaaaacggagcgctccattagagcgtgattaattaagtattagcttttttttttcaaaaatgggtccatatgaatttttgaagcaacttttgtacagaaaccttttgcaaaaaacacaccgtttagcagtttgagaagcttgcgcgcgtaatacgatggagaagggttgggaaccctggattccaaacacagcccaagtctatccaaaatgtttagacaagaaaacacgtaacaagttggtttacagaaatacgaattagatcaatcctgcactacaagtagagtaaagtggtgatttctcttaaatctctcgaatggtgatttaagaattcagtgcaaacctaatccttgctataatcaaatgttcggtaccgcatcaacggaacaataaaaagcacctggcataccataattttttcattcttgttgaaatttgtaatttaagatgcatgagaccacacgaccttaatgttcaacgtgtcatgcattagtgaaataatagctcacaaaacgcaacaaatatagcaagataacggttgcaatccataccaaactaacgtataaagtgagcgatgagtcatatcattatctcctgcctgctaaccatcatgtacaccatccgatcccaaaaatgacaacttctagggatgaacctggacaaggcttagggtttagggatgaatctggacaaatgattgttcacgttcatccttagatgttggtttctccttacgggacggagggagtatatgtgatggacacaaaagttactttcatgatgaaaccaaaggggatttgttagggcacctaatagaacatctgtccaaatggcatgacttacttatatcctaataggatatccaagaaaaactaacactctaaagcaaccgatgaggaattgaaagaaaatacgtgccaacgcatctataaatggacaagcgcaatggaaaccctccttatcgttcacacagttcaagcattatacagcaaaatagaaagatctagtgttccgcagcaatgaagatcattttcgtctttgctctccttgctattgctgcatgcagcgcctctgcgcagtttgatgttttgggtcaaagttataggcaatatcagctgcagtcgcctgtcctactacagcaacatgtgcttagcccatataatgagttcgtaaggcagcagtatggcatagcggcaagccccttcttgcaatcagctgcgtttcaactgaaaaacaaccaagtctggcaacagctcgggctggtggcgcaacagtctcactatcaagatattaacattgttcaggccatagcgcagcagctacaactccagcagtttgatgatctctactttgatcggaatctgggtcaagctcaagctcaagctctgttggctttgaacttgccatctagatatggtatctaccctaggtactatagtgcacctagtagcattaccacccttggcggtgtattgtactgagttttaacattacagtggttcggaagttaaaaataaactcagatatcatcatatttgacatgtgaaactcagggtgatatatcctagtacatcatcgtaactaattaccatcattggtactctacaattttactgtgtgcttacattcgatccgaagctactttgtctttaagatataaatggagtgtataaaagatgtccatcctttaattccaataagaacaaacacgaagcacatatggcaaatactaaatccactacaacaaaatcatagaccataaaacgcacgtaaagatgtagcaatgcacattgattcttcatccactactaaaataagcgcatatgaaaggccgcatatgcatgatcattgtgaatatgacatgcgcttatcgaccaaacgtgtcacttcatgcaaatatgttgtttcaagcgacatcaagatatgatttcaaagttttaaacaatggtatattaatgactttcatatatgcatattagtttcaattgaaagccatcttgttgtccatccttcctgacaagatgtagtgtacaaggcattctttagttgagcctcgctcactttgtatcatagaagcataacctagacgtaactaatttagtatagaagcaaaaagtgtagcagaaacaacgagggtggaaactagaaagaaggatttatgatgtttcttagtttattcagtcatgaaagagtgactttaaaaaaactagtaatcatgcacgtgcaaggcacgtttttcatattacatatggcatcaacgtaatattttgctgtcgcaatatgtatataagacgatttatttcaatgtggtgataaaataaataaaccaagcttcatgttaatccccattcaagctaaaaaatgcaaaaaaaaaaagagagctcattgttgcatacgatcggaatacaatagcgcatgaaatctatgttggtaaaaaaataaatcactgaaacagagaaggaattaaagtttttatatagtcaagtcaaatttgaaagagagtaatgggttttgaaactaataagaatgtattattataaagatgttgttattccatatatttccaaattgaagttggatcatccattaagatttctttgagttgattatatactacgggccttcagatcgaaaaaaaaactcttctcgaagttgaactccatttaacatacatggaacttccttagtattttgcgaacatcaatttcaaatattcattaataagaaacatacgtagtatttttctgatttttcaagtttacgacttattgtttaactgtcattcatttgttttgaaaaaaaaagcaattttcaattgatatagcacagccgcacaccccttctgagatgagttctgattagcatctcctgataacatggcatctcttctttacaagcatacaaaaggacatacatcagaactatttatgttaacaccaaataaatggcagagaaataactaattttgatttaattagattaagacagtcacaatatccagcttgcgcttgttgccggcgttgttgattgactgcttgctcatgctgaagtagcctaggaagatctgcacccaatgtccctacatcaggagcagactttcttgtgttaagttcatgagagcttgccaggcttgtgttaagttcatggcatctcctgaagtttatgcattcatcatctagctttatctcacattagatggagcaagctggggtcttccgatagcatcataggttgttgaccctccgcaccgccgctgctatggaaccatgaagaagtgtctgtgtcacctattcatattggaactaaatttggtaaaggttagtcagatatctgaacctaaaaccagcattgcacatattgaaatttgatgctgaaacttattacctgagcagcagcacattgtagtcatatgcttctttgcaaagttctcctataca

SEQ ID NO: 74751 - DNA, 1022 bp, Oryza sativa
acaaggtttagggtttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaatgaagatcattttcgcctttgctcttcttgctattgctgcatgcagcgcctctgcgcagtttgatgttttaggtcaaagttataggcaatatcagctgcagtcgcctctcctgctacagcaacaggtgcttagcccatataatgagttcgtaaggcagcagtatggcataacggcaagccccttattgcaatcagttgcgtttcaactgagaaacaaccaagtctggcaacagctttggctggtggcgcaacagtctcactatgaggatattaacatttttcaggtcatagcgcagcagctacaactccagcagtttgatgatctctactttgatcggaatctggctcaagctccagcccaagctctgttggctttgaacttgccatctagatatggtatctaccctaggtactatagtgcacctagtagcattaccacccttggcggtttattgtactgagttttaacaatatagtggtttggaagttaaaaataggctcagatatcatcatatttgacatgtgaaactcggggtgatatatcctagtacatcgtcgtaactaattaccatcgttggtactctacaattttactgtgtgcttatattcgatccgaagctactttgtctttaagatataaatggagcgtataaaggatgtc

SEQ ID NO: 74752 - DNA, 2945 bp, Oryza sativa
cttttccgttggtcgtgtagacgctgcagcttcggaagatccgctcttcgtggaagttgaagccgacgcttgggaaagcgagcaaggcaagacacatcatcttgatcatattgaatcctagtttataaaattatgttgatttaaattattgcattatcgctttatttaaattcccgcgttatcactgttttatttagccatgcctatttatctttgttatgaccatatcattattgttattgttatgattattaccttgttcaccctagacaaacaaaacctcaactagtggacactctactcatgacaccactagtttaattttaggtagatgcttcgcaatttaattaagtaacattaggtggttttacaactttagactttggggatactcatatcacctggacactttggaattgttggtttattgtggaattggcttcacaccgctccttctattcaaaattccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatggcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatactgtgtagctctaggatcgtctttataaaatggctttgggcaactaagtgacttttcgatgctgtttactgcaaaacttaacccctatattattatccccttgtactcccttgcattaattatgcatctccggtgtggcttgctgagtactgtggttgtactcattcttgctcaatctttccccccttcagtaagagaagctttggagatgatgtcttgggtggagtcctggcttataccccagttgagcgcctgtgaagatggagccgtaggcccgctagtccgctgctgtttatttttgattgtcaggccttaagcgcctttgtaataatgtaaatattatcgatataataaagatgtgtcttttatatcatgtttgtttggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctttttgcaaaaggtttactcccttcttccttcttcggatttcaactagtactagatggtcaggtcagtgaagaagaagacatcgtcagttgtttgccgaagctccggaagactgcaggatctgcgagcgaagtggaggaagcagtgaagccagctgtgaagcaggagtgaagatcttgagaacccgtcgcagaacctaagccaccctctagggtagagtcattagtcgtgtgtttccttgcttgtgtgtgtagcgcgtggtttgcatcagtgggtggtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcaggagtcaggacattggtacctcaagctcccgagtgaatgaagcacaagacaccagttgtgcggcagtggtccaacacctgattaaccagaacaaattgcttatagagatactacagcagcatcggatgccaattttgaacccgagtcagatgcaacctcaggtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaaggtgaagttcgtaagatgatcattaccagcacagaatggcctccaccaggaatgacaagacgtcagagaagaaacaccttccgaggtgcaccacagttgacagagcatcttttagctaatggaggtagagtgtctgatagtgaagattcagatcaagtctcctcagaagatgaagatgagaaatctccccaaggtttcaaccaggataaaatggaacgtaaggcatgctctcgttgtggagaaatcggacatgttgccagctcgtgtgcctctacatgcgttcattgtgaggaagaccatccacccgacaggtgtccaacgagcaggatcacttgtttattttgtgaaggaactgatcatgtaccaaaagatgtcaattc

SEQ ID NO: 74753 - DNA, 2613 bp, Oryza sativa
tggttgatatagaagttgaattcaaatggatgaatgggaggatcaagtactggatgaaccgatcgaaactagggatctgaattgtattcctcatgaagttatcatttaatttcttcagaagtttaggacggtttttggaaccttgaggttgagacatcatttttagagacatcatactctaaggctgataatgtatcactttaatatggagataaatctcgtaagggtaaaaattggacatatatgaaatttgtaaaagtaaaaaagttgattatataccaaatctccatgcgtttcccctctttctacacattttgataaagatacctaatctagacttatcacttgctactcttttcccttctcgtcactactgaaaaacgatttttctgtacagcgacccatttagattgtagatggaccataactggtcgcgtctaggaaaataagctcattttcacgtgtggtccatttaagaggaccgcaagaaaaaatcgatttttctgtgcagtcctcttaaatggaccgcacgcgaaaatatgcatttttgcgtgtggacctattaagagtgccgcatgcaaaaatacccactccctcttttccctcttacccactttaaattttcccctctatctctcctctcctctctatctctttttcttctatcagtcaacaatagtggcctcactcatctgtgccctctcctctccttccgatggcagcggcaggcgtaggtgacggcggcggcacggcggcggtggaggcgtgggatccggcgggcggcggccaacccccgcatggatccggcggcaggccgccctcgccccccccctgcgggatccgcctcccctcccctccccttccttccctccccagattcggcgaaggggaggggcgttagtggtggtgcaaccagaagggagcacagatccggcggagcgcagcgcggaggccgctgccaacgagggcatgagcggtgtcctcgagcgacgacggcaatgacaaggaggaggaggaggccgcaccgctgccggaggattatggggttttcatttttttttgaaattttgtttttttcagatttttgtttttccgtgtaggcgacataagcacccgcacgcgaaaatctgattttcgcgtgctggtgcgccacccgcacgccaaaatcgcgattttttgcagaccctgggtgctggtgggctgctcacccgcacgcgaaaaccggttttgaccgcacacgaaaatctttctcgtagtagtgcgttttcgaacagtttttacatagatctagtgcaacaaggaacaatttcacccattaatatccaaaaggaaatgcctttgcagtaacaaatgggaatatttacgttgcctggggtctctataatatatgtgtcgatcaggatattgcctttacaaaggtttcattctgccgcgaaaacacttttattgcaacataaactccattgtgtgaagtcaaacaagaaattaaactataatcccagaaattctctatgaagtaggcaagagaataattgaattgatcttgggtgccttaaagtggacacaagatttgctgtaaatcttttaagtggcttcaataagttaaattactcaatcgtggttacaccactatgtagtggtggcacaaactatatgtacagtgcaagcggtactatctcaaaagtttcagtacaaagtatttggagcttatttaaaggggttaaaaggtaaagtgagaacattttcttgttactaattcctttggattaacctttaactactgtaccgacaaatccaacttttgaactacacgaacctataaaagaggacatggatttttaccgtcgtctgccatttgactattcaaaatattgagacttagagtattgagatcaagacaataaaggagtatccaaatttgattgtgtgcctcttatttctattgaaggataaatgaattgtccgtcttttctcattacctcaaaagcttatatggtcagcctatattgtcaaatatgaaacagtaggttggacttgcaatactccgtattaaggaggcataagcaaggtgatggaaaaggcagcctacctacgaaagaaatgtctcgatcgaaagcaagtcagaagccaaaaactgaagccaatctcttttatcggttcaataattgcttggaccacatgaaattccccggatacttacacaagtcgaactattttccacgaaattcttgcaagcacttacttgagcaagcaaaaaagactagctattagcccatatcggcgatagtgaactccactgctcaaaacaaatgatccaaacaagccctgaaagctccttttccccaaggcaacagctaactgaaccagcaaaatctgtctgcctctgaaagaaacaaaacaaagagaaaaaaaaaaaccctttccctcccttctcacggcactggccaacttgcaagttgcaactgatgtgaagcactcactgagactccaagcacctatatgcaggtagctctcagcacgcttgagttggtgatgccttgattcccactgttttgtccgtcaaatactactgcgacgacgacgacgatgacgatgacgatgacgatgacgatg

SEQ ID NO: 74754 - DNA, 7849 bp, Oryza sativa
aggaaaggggggggaaagaagactttttaggatttttctttttataaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaaacctaccccccttaaacggaatctcgaccccgagattcggaggaactggcgaagagatcgggatgggctgccttcagctcgtcttcacgctcccaagtagcttcttcttcggcgtggttgctccactggaccttgcaaaaacggatcactcggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttacccaaggaggcgggcaactccagctggtaggcgacttctccgcgtcgagcaatgatacggaagggacccacataccgaggtgcgagcttcccttttgtctgaaacctgtgtacacctcgcaatggcgtgacccgaagatatacaaaatcacccactgcgaattccaggtcacggcgacggttatctgcataacttttctgccgggactgtgccacctttaaattatcccgaatgattctgactttagcttcagcttctctcaggatgtcagtcccgaacacttggctttctccaacttggtcccacaatagcggtgtccggcatttgcgcccgtacaacgcttcataaggtgccatttgtatgctggcttgatagctgttgttgtaggaaaactcggcataggggaggctcttatcccaggtcttcccgaaatctagtacacatgcgcggagcatatcttctaggatctggtttagacgctcggtctgtccatctgtctgcgggtgatacgcggtgctgaaattcaatcgagtgcccagctcttcttggagcttcttccagaagtgagaggtgaattggcttcccctatcagatacgattttcttgggaatgccatggagactcacgatcctagcgaaatagagttccgctagtttgttccctccataggtggtcttcacaggaataaatcgagctacctttgttagtcgatccacaattacccatatagaatcatatccaccttgggtttttggaagtccagtgatgaaatccatcccaatttcatcccatttccattctggcacttggagaggttggagaagtccggccggtcgctggtgttctgccttgacacgctggcacacatcacatagggccacaaactctgcaatttcccgcttcatgctgacccaccagtatttctccttcaaatctaagtacagctttgtactgcccgggtggattgaataaggactttcgtgagcttcctgaagtatcagctgtttaagttctctgttatcgggaacgcacacccgctttccgttccatagagttccgtgttcatcctctgtgaaaccagcggctttaccctgtttcatattcttgaggagtccatgcatgtccggatcattcttctgagcctcgcggatttggtcgagcaaggtaggcttggcttctaacgcagccaagaatccacgaccaactatgcttaggttcagggcttccatctgttgattaagttcgggtggaatgcctcggacgttaagagtattgcaatggcttttccgacttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccactgcggctaactccaaatcatgtgtagggtagttgccttcatgaggccgtagctgacgtgaggcataggctaccacatgaccatcctgcatgagcacgcaccccaatccttggcgcgaagcatcacaatacaccatgaaatccttgcgagtatccggcaagattaacactggcgaggaaaccagctttttcttgagagtttggaacgccttctcgcattgcgggctccacacaaatttctcttctttcttcaacaactgtgtcatgggtcgagcgattttggagaagttctcgatgaatctccggtagtatcccgccaaacctaagaaactgcggacttgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggttagaccgaacgacatcaccgtgaattcatacagcccgtatcgcgtggtgaatgcggtcttcggaatatcttcttcacggatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttgaattccgccaggttctgatttgctgccatacggtagggtcgcttgtgcagaggagtggttcctggagcaagatctatccggaactcaatctctcgcttgggcggcataccaggtagttcttccggaaacacgtctccgaactctctgacaatggggatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaagaatcacatccaagttcttggtatctagcagaatcagatccgaggaaaaaggaatcccctgaatttctatagggacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggatgaggaacgtaccaacgatgacgtccggagttgtcagcacgtcctcggccgtcacgtggttcacacgaccccgaatgacgtccttcccaccgttgttggggcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggtgcacgagtcccttgttgattctgctgctgctgcggctgtgggacgcgcaccacgaattgaggtcggggcgcggagcgagattgctgctgctgttgttgctgctgtgaggaggatccccctggatagggattggtgtagcggaccctttggttagcaccctgttgattgcggaagttcgccaagcggcgcttgtgcgactccagttccttgtgcttggcttccaagcggatgctcttgtccaccagacgttggaaatctggatagtccccggagactagacggacggacagctcagggtccatacctgccaagaacttctcttgcttcttctcatcttcccgcacatcctccggggcgtaccgggccaggttgttgaactcatgcaaatactccatcacggagcggttgccttgcttcaactctcggaattcccttttctttagagccatgactccggcgggcacatgggttctccggaaggcggcggtgaagtgggcccaagtaataggctgtccctctggctgcgtagcctggaagtggtcccaccatagagatgcgggcccctgcagctggtgggcggcgaagatgactttctcctcatcgctgcactgcacagtgtctagctttttccccacggcatgcaaccaatccaacgcatccacagggttgttggagctagagaaggtaggtgggcggatacggaggaactcggcgagtttagagtgttgtggaggtggtggtggagcattctgctgtggcggattttggaggtggtggaggaaagcagtcatcatgttggcctgctgggcgaggatttgggtgagaatggcgttggtgtctggtggtggtggtggaggtggattgccttgggggttggggttgctgccttcgggttggttgccttcaccggtgctaacatttctcctggtcgtcaccatctgaaaaccccacacagaaccagcagacagggagagctaacgattaaaactaaccacccacgactactataaatcttgaatttattactgacattaaattggttcattaagttcaagttgcttaggcaaataaaaacaagacaggctccgacatagttatgccacacaccggcataaccatgccccacacaactcaagaagacaaacgaggaaaaacacacgcgcaagcctactaactactcgactaccgctgcgacgggccaggacggaaggcgagcaacagcgcatcctccgtgctaccaacgccggaggcttccccctcctgaggaaccacgggcgcaggctcggcacgaggggtctcgacgaagcaggtccacgccaaggactgacgaacaagctcgggcctggaggtgctcttgcgggcggtgatcttctggctgcggcagacgcggcggcgcttggggcggctgtcctctccttgggcgagcttgagctggtgcagctgcgactccaacgcgtcgaggtccttcttgagctgcaggttctcctgacgcagctccagaatcttcatgttgttctccaccatgccacgacgcaccatctgatggaagtcgatacgagccgcgtcgtatgcctccaccatgcgtgccagatgcacgacggtagcgtcatcctccgagctagcatctcagaaggtggcgtagtcacgggctcctccgcgacgagggtggtagcgatagggcgagtgctgcaactcgtccgggtagcgctggtgaagggtgccgatggcgaggaaagcggcgttctggcaagcggcgggaaaggaatctccacccgcggtgactgccagcgaagtccgctcgggagagccggagaggatcactgcggtgacctcccaaccagcgtggggctctgcatcctcaccctcctgctccgggagcggcctggcctggtagtccactccatgtggatatcccaagaccacgcacatgccccgcagctccaaaacgaagccagtcatgtccaaaccacgacgggtgacgctgccggccatctacaaacaaaaacaaagagaaaagcaacattttgaaggtcaggttttgatgataaatgaagcagcaagacagagagagactagacaattttcacaaataatcaaagatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataatcattacacgggcagcgaaggcccagcacacaaagacaacgaaaaacagcggaagactagggcgacgaccacaggcgcttgacggcaggcacgagctagacaccaaagccttcatcttcaaggagctcctcatctgtgcttgggaaaaattgagcaagactgagtacaaccaccgtactcaacaagacacacccacaaatgcagagtaaatgcaagggagtacaaagggaattataatataaggggttaaggttgcggtaaacagcatttaagggcatttagttactcaaagctattttgccaacgcgatcctagaactaaacagtgttattaatcaaggccgtgaacccacacgaacctgccttaacccaaggcctacgatgatccggaccgaactggcaacccgaccctgggtcccagctcgtcccaagccaacccaggccaaccattccacattttagttgtttaagcaggttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacagacgaaagacgtgacatagtttccaacccatcctagccatagacaagagtaccgacccaatcccgcctacggccggaacccccgggacaggcaggcaggactgagcccctagcagcagggcaccaaccctctgccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggtagtacggtagtgctttgcaacagaggcccgaagaccggtccttatacggccgaggagctactgtcaaaaccatgctccccgagcccagcctaaaaccattttggggaattttgaatagggggagcggggtgaatccaattccacaattaaccaacaattccagagtgtccaggtgatatgagagtttcccaagtctaaagttataaaaccacctaatgttgcctaattaaattgcgaagcatctacctaaagttaaactagtggtgtcatgagtagagtccactagttgaggttttgtttgtctagggtgaacaaggtagtagtaataacaataacaataataaaatggtcataacaaaggtaaataggcatggctaaataaaacagtggtaacgcgggaatttaaacaaagcgataatgcaataatttaaatcaacatagttttataaactgggattcaatatgatcaagatgatgtgtcttgccttgctcgtcttcccaaacgtcggcttcaacttccacgaagagcggatcttccgaagctgcagcgtctacacgaccaacggaaaagaaaaggcttaaccactaaataactccacataacagcagaaacaaagcacaaaaatgggttctttacatcttaaggaaaaattagggacttgaacggtccaattccgagttcaaatggccaaggtatggccatttgaagcttatctgctctttaaatggatatttagaatttcttcatttaatttttaattaaaaacc

SEQ ID NO: 74755 - DNA, 516 bp, Oryza sativa
atagccaggcaaatatattatccaaaccagagtaatccaagaggtcgaatgtactgatgcagccttgaacgatgccgacgtagacgatacaattgcctgggccgacggaacattggactgatcccttcgccggagatcgaagacgatgcagccccatgtcgggtgccaagttccgccggaacgtaaaaacaaaagtagaagtaaaagggtggcgatgcgccgaattgtattgatcgtgaagatagtttacaatgaccccgggtgtacatatttatacctatgggtagatactagtccttgtaggacaagaaagaaactttcctaaagataaaaggaaacttacaaactattcctaattaatagataacttgccatgccgcattcttttgaactcggtctcttctggataaacttcatttagtagatcaatttccttaaccgaatatagcaagaatccgacaactgacgacttgacaactctcatcggctaatctcagacttcaaagccgatgctga

SEQ ID NO: 74756 - DNA, 1687 bp, Oryza sativa
gaacagtccttgaaacacaccgaaccggcgaggtccctagtttaggttttttccggttgaaccgccggtccggtctggttttttctactgtgatctccacacacatctacatgtatccaacgctttatggctgaacgcccctttagttgagttgaaccgccggtccggtccctgtgatctccacacacatctacatgtatccagcgctttatggctgaacgccccttcagttgagttgaaccgccggtccggtccgattttttctactgtgatctccacacacatctacatgtatccagtgctttatggctgaacgccccttcagttgatatgtgctatataaattatctacaaattttggataggaccttcagttgatatgtgctacctaaattatctacaaattctggatagggctgctaaaaagaatttgctacctaaattatctacaaattttggatagggcagctaaaaagaatttctccaagaaacatatttgtttcttcttgaggttgtagctcctatctaacaaattgatgattgtacctactatctaacaaattgatgttaatcaagtcccgtcatcatcaaattgttaaccattggatgaatgcattagatcgcttttcagacgttggatggaatacaacatagagcccaacccattagtcaccgagtgagtctcttcgccttctcagtgtcaaatgtagcccacatgaatatattgacccatctgcaccatagtataaaaactcggaccggacgtcgaactggtgaggcctcggttcaccggtccaaccgcggtgttaaaatttattgtttattgcacaccacaatggtcagtgtggtgtagtggtggggaacttaacgctccatccaacaatcctgggttcgatccccatgcttcacccgatttttgaacaataaaataaaactgggccttaggacttgggcttcccattagggaagatgctgtccggtggcccagctcgtttgagccggccggttttaggagtccccgcttcagaggtttttcctgaaaaccgtcggttcacaccgggtcaactgcacgaacagtccttgaaacacaccgaaccggcgaggtccctagtttaggttttttccggttgaaccgccggtccggtccggttttttctactgtaatctccacacacatctacatgtatccagcgctttatggatgaacgccccttcggttgagttgaaccgccggtccggtccctgtgatctccacacacatctacatgtatccagcgctttatggctgaacgccccttcagttgagttgaaccgccggtccggtccgattttttctactgtgatctccacacacatctacatgtatccagcgctttatggctgaacgcccattcagttgatatgtgctatataaattatctacaaattttggataggaccttcagttgatatgtgctacctaaattatctaccaattctggatagggctgctaaaaagaatttgctacctaaattatctacaaattttagataaggctgctaaaaagaatttctccaagaaacatatttgtttcttcttgagggtgtacctcctatctaacacaataatgattgtacctactatctaaccaattaatgtaaatcaagtcccgcagcaacgtacggggcatcctttagttatacatct

SEQ ID NO: 74757 - DNA, 5372 bp, Oryza sativa
tcttctgtaaaccataagtacatgaactccacatcttcaggtccaacagcaaagtactgaaaagctgcactttaagctcatggttgtttctttgagattggcacaaggatacaattgcatcaactagctcctcatcagtcactgcctccccctctccaccttccatctttggaaatgcttgtaattggtaatgtaaaacacgtgacaaaatctccggtgaacatgtccgacataattcttcattatttccaggatgctgaatagccagggaaataatcctgaaaattggggcagaaagagaagcagtggcaatcgacaattcaccaagcataggttcaagactatccatctgcacattgcttatagtcaacggaagtaaagccattggacccccataggctaaggcccataaagactccgcaggccgcacacgagatgaaacatgaaccaacccaagaacttctgcaggccttcggtgagtgcctacagttcaaaagaagatactatcaataaaatcatgtacatgaccgaacgtgtcaaagtgccactatgaggaagcttgggaattttttgacattcggttagcccagtacatatcaaaaatcaataatctgacatcatttcagcaacaaggaacatgatatatcaattactttgcacactgaaaagggtatagatgactcaagagagtgtcatcacaaagatttatcaacaattgacagaaactactggcattgaagatatgattcacctgtgagtaaatacaatttcttggtagaaactacagttagcagcttgctctcaagagctcccacctcatttttgagaactcttatgttttgctatgggaaaagccctattttggtcattcgactttaggatacagtttgtgttcagactgaattttttttcaaggatgctattatggaaacaaattgagaaaattgctggacaaccaaaactttttaaagatactatttacagaccattaaatgaaagtttctgaaccaaagcgggccattgaaaagttaaaggtcctaagagaaatcagagccctttttttattggtcaaaggcacattagttatatgactttgagcataacaatttgttttgtccagagcaagaatttaaataatgtgttcaggagtttgagtaacataacatttctgtatctatacctatttcactaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcagagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtggaggcggttcaccccggccgccgccgcggccccgcctccgaccatgatcgcgtcgtcgaccgcccgcacaacctcctgcggggcgtccggcggcacgcccagcggccgaggccttctcctcctcggcggcggcggcgacggctccgaccgcgccggcgtgaccgccaccgacgtgcccgcgctcgtatccggatccagctcgctcccctctgcacgcacctcgtcggcgagcgggaccgccgagaactgctcgtcggagtcctgccccgggggcggcggctccggcgaggaatccaacgactcgcggggttcctccgccattgctagggctttacgacatcaacaccaaacaccgaacaaggtctcgggaataaaaatgcgggcggaatcggtcaacgacagtgaaaaccgcgagcgattcgagagagagagcgggggtggagtggaagggggcaggtgagcagcgcgcaatgcggaggcgcgcagatctggtggcgttcgggggtgggattggccttgcggcgcaccggcggagaggttggggatcagcggcggtgcatggcgagatccgcgaggcggagaggatgggtggggatatcagatggacgaactggacgagaagaagagcaggaagggggagaggtagtagacgacgtggcgcggccggcgggttcacggtcacgggtcgcggccgctttccagtgtcgcagcctcgcacccagtcgcaggcgtttggactttggtgccgcggtttgggccttcgcggcgcattgcgcccgttaaggaagctgactaacaagttgggcctggtggcccatgtgacagagacagacaacgaacaccaattcaacgagcaggaatatacacttgttgtacgtgatgaaatttttttatgaatctggcaaatacagttttggagttttgatctaagcacaaccctagatggaagttgaatccaacatgatttcatttcaagagaagttcaactcattcaagatcaacagcacatgcagggccaggcatgatggaggagctgctgagctgcatcgatgcaggaccaacaataaaaaggagcaacgtactactcctattgcttcaatgcttgcagacaaaggaaaggtatggcacaaccgatggtcgttcacacgattgcgatttgcaaactgaatgttacggagtacttacgatcgaagtaggatgcggcctactcccatggacgtaaacacgtttaagacagtatacatgcatgaactgaatagcagaaaggggcattttctcgtccatgtactattactgctagttattccaatctcgcaatgctcgattagtgacctatatgtgcaagtgattacaatttaattacaaagaactttgacgagtaccacatggactgattaaaaaatctcagttaattctctccgcgaactactgtgacgttcaaaaagtgattagtaggtgagctcgcctgacagtctgacacgactcagaaagattgattagtccagatcttcgcgaggtcatgtgcaaagttgaaagcagcagtgcagcattatactcgttgagtcggtgcaactttgaagacacgctacacagccaagcatctagttagtgttttagactttcagtcacgcagtgctgcagaagccggacgcgatgaacttgtatcccttctggcttgaggcaatgccatacacagctaaatgcttgcctgaattgtgcaggctgacttttgcaatcttgctggaactgtggttattgtcttttcttattctggattttgaatttccatttgcatgctttccaagctctccgtgcatttcgtgcaaagaaaacaaatattatacaaaattcctgaaacatttttaaagaaactttccaacttcatattagtttaactcattcatttatatcctcagacaactacataaaaaccagattatgcataatttaatcaatttcaattatcttaaacgggatgtgtgtgttagttttgcagggtgtaggagcactgctatgcatacaactcatgcatatgactagcgtgcgactcaccttatgagactaatcagtttgctcggattcttttcatgctcaagtctttcacagcttagtcatagtcgtacatgggtcgtatgcaaagtgattcggagggcgtagtacgagtacaagtacaagtaccccaagggaaatctttttcggatttccgtagactacctaaatcgctaccatgacttatgaccaaaatgtactgagggagttcacagtggacttgtgtagcgttcagcatcgtcctcccatgtctgcaaaggagaaagtcacatgccacgttttcttccagacccaccaaaataaagttcttgtgtccaaagtttaccaccgggttcttggagagaaactactcgtttgggtggataaaagctaagagtactagtactcatttggatgggaagaaaaaggagagagatgaaaagtaaaaagtttgtcactggtgggaccccctactagtacttgcactgtggagtatgaagcttataaggttcttcgtctacgtggcatacgaggaacagcaaaaatcggcgatgcactgtgaacgccctgaagatgcctcacttcaggcggagcctctccgcttggatgatagaccgattatttgagcctctccacttggatgatagaccgactattt

SEQ ID NO: 74758 - DNA, 2503 bp, Oryza sativa
aagcctaagttcaaaacagctcaaaatcctaagagcatgtttggatcacttgtcaatctctccatggcctatgtgcaaaacaaattgtgcccaatatttatggatggaatactagatcatttgtcaatctctcattggtctatgtgcaaaacaaaatgtgcccaatatttatggatgaagtactagtacttaacaaataacaaatcactttataaggatttttcactgaaaataaatgcatgccatattcataccctattgaccaaaagaaatattgtgtggatttatcttcaattcttcataatcttcacaaaaccacaaaacaacaaggcaaagattggtgttttttctgtaacaaatactactccacaattatcacaaggtaaaaaaagccaaaccacgcatagcatataccataagaaactaccatcgacatgacagcacaaatcctggaaagtttatggcaagaagatgaaaaccaacctgtatagcacgagattggaatgaccttgatgcatatggaagcgaacggagcaagactagcaacagttgaatatgttcaaaacggtggccacaatcatataggtttagattttcatcaactgaagaaacattgatctgcattcaagatcataacaacatcaaaagtagaaacttcgaattgtaaacagttgggtaataattaaatggaagaaacagtaatctgcattcaagataatattagagtctagagcctataatactaatcaaacttgaaacactgtggtgcttatgccattccaaatggaatggacaaaaaaaaactaagtaaaggatataactgcaaagtccgccaaaactgacatggactcggacactcgactgggcagagaaaatctagcgttcatgcttatttttacttgaaataccataaagcacaatccaagagattttgttgatagaaacttagatatcagtttttcatgtggcctgagttgagaaaaaggtcaggtgataaggtaaccaacaggcaactaagtaatttactcttaagttaattaatcataggaaatcgatttcgtggaagtcaaaaacatatacaattatctagacagcacataaacaacataccgcagcagaaattaaagccatatagacatttacagtcataagcctccttggggctgcttgaaatgctttctgcagagcaaacagtaacagtgacactctatcttctgacatggtatttccttcttcatgaactgtcgtcagaaggccaccaggtaaatttggatttgcagcccttgaggcaaactttaggtgacctgatgcaactagagcacccaaaatgtgaatgattccaacaacaatgccatcacctttgtcaacattgtaaacattattccggacattgtcagcagtaattgagaagttgatgccacccaaattctttagcagctgattttcagaactggacaacttccttcctatacttgatcccaaaatctcacaaggcacatcatttgtgcttgtagatcccagctcagtatgttcttcatgaaggatggattcgtgctgttcaagttcaactgattgaatttgatcatcctggctctttgcttcaccactagcagcttttgtgtctgaatcatcattccttaaaaaatcattttcacttaaaagtgcatcagaattgtccaaaatactgttgttaccagctttagcttccctctgtaaaagaacgagaagtgcatccacaccaccacaagatatgaatgactgagcaaacatgttggctctagaaatgttaggctgcacaatcaacctatagatgaggtgcaacacccttgcaacctgttaacaaggacattgttaagatcacaagaaacagcttagactatattgtcagatgagctatatagataagatggccctagactgctacacatttgtattgtctttcaaatgatcaaggcaagtataaatatatcccaacagaaaaatagcacgtactccctccagttccataattcttgtcgttttggacaacaacatgatctccaaaatctttggctatgattttctattataatatatacaaaaaataagtaaatatttagcttttaaaaaatatttttaaactaatatatgcatcatgttctagtgtcttcaaattaaatattttaaaagttagtgatagtcaaggttctaattgtttgacctcaacctcatccaaaacgtcaagaattatggaactggaaggagtaaccacagacaagctttaagagcaaagagctgatgcaccatcaaatttgttgtgactcacggttaaaataatacccacttatccttatgatatgatgtatggaaataaatacatcaaattgtaactttacagttttcagtgtatatgctcactagatattaggtagtagtagtaccattatgatctttagttcaagaacatctgcgtataaaatatgtagaaggttgggtatttccattcaaacaatggctcaggagg

SEQ ID NO: 74759 - DNA, 24741 bp, Oryza sativa
tactttgtctcttagtgcattgtcatattgctccacaaattgcttaagtgtggttctagcattaacataaccatcaaagaaggcattcacactctcactcctttgcgacgaagacattccagcccaaaatgtgtctttcacataagccggcacccataattccctgttatcatataacccagcaagccattcattatcctgtaagctaaattcatcaatcattttcatccatcccttatcaaaatcatctctgtttaatgaatcatacaccacattagacaatgtagagctaataacttcatattctaagtacccaccaagtttttcaggaatcttcttcatgatatgccacaaacaccatctgtgtcgagcttcaggaaatacttccataatagcattttgcattgctctgcactgatcggtaattatggcgtttggtgctttatttgacatacatgataaccatgatctgaataaccaaacaaaagtctcagtttcttcatttgatagcagagcacatcctaatagaactgattccccgtgatgatttacaccgacaaaaggagcaaatggcatatggtacttgttagtcaagtacgtagtgtcaaatgtcacaacatctgaaaaagattcataggtagccctacttcttgcatccacccataaaacattttttagtcgagagtcctcatccacgtccatgacatagaaaaagtttggatctttggacgtcatacgcaggaaatactgataaactgcatgtgcatctccagcaccaagcttaagctttcgtacatcttgcaaataatttctgcactccttttcaccaaattgaagattctcatagcctccagcttgcataactagagaactaaaattcttgtttatacgaattcttgcttggtcattcaactctagccttctcttagcttgcaaatcaagtttcttgtgacatctgagatgtcttgctttgctaggacttacaacatgattatggtcaagagtaagcgtactaatgcagaatttctcatcatgaagataaaagttaactttagctgggcactgctgccttgtggaggggttaggcttgaatttatttgttgatgtgtactgtgccttaccttgtctgctacaagcaagtgtgaaatatctcaccttgccatcctcagttttcttagatcctctttttatcacaccgaatcctaactttcgagcataacttaatgtaaaagcaagtggcactatcctcactatcaaatagcatacctttggttggctccaacagtttggttttatctgctaccagagcatttgaatcactctcaacctcctcaattgcaaagccatcttcatctgatatgatatgatcttcttgctcatcatcagaacatagattggtgtccattaccttaatttggcaaggaaaattaaatcgattttaaaagcaaatcaaatatggtcatgtatgtgtttgcaagcatggaaaaacaagagatgttgaaaaacgaattgagaaaattaatagaattgctcatcgggcctagaaaaccagagcctaaaatgtcaggcaaaaataaatcaacaactttctcatacctttctgttagcttcaacgtggatactctgttgtggttgccgcaaaaaaattttccgattaatcttaactgattgttatggataggagacaaaggggattagaatgagggtttacggtgagaaagaaaatgcagaagatgaaaagtcacgactgtgtatagagtaatatcgagaagaggaatcgacgccggaatacggagcttcggctggagttgggcttttaaaaggcccaacaatcacagcccactaagtaaacagctcacgctcacagatgacgctgtcgactagtcgtacgatagtcgcacaaattcgtcgtgtgtatagcattttcgattttcaatagcacatatttgcacggattatatgggaattacaagaacgacctcgcgatacttcggaaacgtatagtccggctgtgagaaaagcttcagtcgtcgcagattttgttttgaagtgaactttaaccacaattattagaacccgctaattaacctgttgggcctggccaaaatcaccacctcctaatgggcccatatatatctggcccattcacatgcataggccttcggtgtgatcagtttgtgcccggcccactaaattcacgtgaatgtatttcttcactccgcctcgttttaatgagtcgagataatggcccattcatattttaagggcctatattttagtggaccggggactaattagagtgaggcattgaggacagaaggcgagagaggacatagactcaaaagtcaaaaccgtctcgagggtaagtggatcctcttaccttgtgtagtcactgaacatatgcacctcacttcattatggcttacatatcagtggtgcaactataaactgcacaaattcagaggagcatcgtccatctcgaggaggagaagcgagcgagcagccaaacttgtctatttcgtgagctgggcacatctagagagatgcgtcgagaaccatcggatcgtaaaagataaaaattacaccttctaggtgcgacaaaaataaagacatatggctatatagagaggatgatgagctcatgcaggcgcttcacctcacaaacatccacgtactagattcttctttgttttttccaaaaggatcgatcgttaaattctccttctgttcaaaggctctctaatttctttctttaattttcatattttccaaatgactagggatctgatcaacagcgctaactgccgatcagcggctgaaactaaggcagttcaaaacagttgcagccggtagctctttacaaccaccatagctacaacagttgtggcagtaagaccaatcgaacatacacatagaaggacaatggcatgtacaggcgaatccagcgtggatgctagggagacttaccgattgaatcccccctaccccgctagatctctattgatagaaggagagggaaagggggagaagaggtagaggaggaagataatgaatggttgaaggagaaaggagatgagtgtccctctaatcttattcaggattcgtccctaagtgcatgtgcgaagtcctttctccttggttacgcattgacaagtagagagcatctcccaccactcatatagacaatcaagctcttcattggatggggcaagttgctaataggtggtccagtttgtcactagcccctggattgttagagtatctgtgagtgaaatgaatgttctattaccacatagtggctagtgaataatgtaaattcttttagaatttttttaggagaacgacggtaggagatctgccggaatttaaattagggaaaaggccgaaacccagcaaagagtttacagagtttacatggactataacaaagaggaaatacagcttaagaagaaaataaaatcagggggggcttaaaagctattttgcacaaatccatatcttgtttgataaggtatgctacttcatttactgagaggcaagaattttgaaaaattcttctgtttctttctagccaaatattccaccaaagtagttagtagtgtgcctctgataccctgcatttgaactttgcttcccacatggttggttccattccaccaagtttcaacatcatggggatggggtgtagttataggggttagattttggaaatggcagattagactccaagtttgtctggtaaaaatacattcaaattcttttagataatagtgatgaataatgtaattgaacagtctgtccaattactttgttacagtttcatggcggtggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggccatgcatgtagctatagagaagactctggacgaaagacttgtggagttaacggcacgtacggtgccgcacagggttatccttgacacttctgctttctatcactgctgctgctgatgatgataatgatatatatatacacaaacactccaacatatggacaatcttgcaatacagacttgagtacaccaccgagtcatttggcgcacgatcgatgataataattaatttaataggaggacttgaagacttgctctcatccctgcagctagcgagcgtgattacatatatagagacgaaaagagttgtgttctatggtaatttgccaatgaattcataatttttagcggtagacatttgccggtaattttgtgtcatggtgaagtgtactggtgccaatttttctataaactggcacacatgatgatcctaggtgttggttcttagtttgctagtgatgttggtgcattattcgtgcagttgtgtttgcctacacacgacacacgcctaacattgccattgtattgttcttatatactacccctgccctataataagttaatctagtacggcatgtatcacatatcccgtactaaattaacttattctgggatgatgggagtatattgatttataattttagaaatgaaaagaaagctcttgaatggaaaaatgtacaaatacaaaacattctcacatgacctcgagcaagagaattgaacactatctgccatctatagcagataatgtgataccgttaacactagatgccgcaataacagttgacgcctcttcgttcgtcagcctcatgttgaaaaatgcagggtgcttaggctcaggtagggtcatagtctcgttgcttagcattgcaacaacctctgacgtggtgggccgatcggccgcattctcttgcacacaaagcaaagcaatgttaatacatctcattatctctattgtatgagaatcggtgggtaacaatgggtctacgagttgaagccatgtttcatctttccacatctgccatgcctgcaaggtgtatgatcgcaaaaaacatgaaaacaatctacatgacattagtatttcttctatcgaagaagtacgaaaaaagactttaattttatatactactgaaatcttttcgctttgcattttaggaagattagaaactcaagtcattattatatgatgaaaacttacatggccaagaagattaataaattcaccatatcgatgaaaacttgatgtctttttcccactgacaatctcaagaattagcacaccgaaactgaatacgtcggatttgattgaaaaaaggccctcagaagcatactcaggagccatataaccactgaaaagatgcacatacaaaacattgaagtgaggtaacagtattggcagttttgtgtacagctaatgaattttataataaaatcttactatgttccaacgatcctttttgtattcccttcattatcattcacgctaaatatttttgcaagcccaaaatctgcaattttagggttcatttcacggtccaagagaatattgcctgctttgagatctctgtgtatgacacgcaaccgagaatgcttatgcaaatacagaagtccttgtgctatcccatctattatcgctaggcgtttatgccaatctatcaaagctcttcttgtttcatctgcaaatcaattcaacatagatataacaaagaatatacatttcgcagttagagttagtgaaccaaatcttttatttgcggtacggtacagcaagaagtaataccaaaaatgaagaaatccaagcttttatttggcaaatattcatatattagtattttctcctgtccctggtaacagcatcccaagagcctaacaagatttgtgtgctggagcttagctatgagttggatttcatttttgaactctgtcaagccttgccctgaatgagaagcaagtctcttaactgctatctccaccccatcaggaaatcggccctagagacaagtgcaaaagagatggatgagtgacacgagttaatttgcagtttcaattgacttttgacacttgacaaatattatgatcaagatataatcggccaaagcagagagtgaattgcataatactccatgtaaattaacgaataatatatgtgtataacttttgtcagatttttcgtcttatgtaccttgtatacaggaccaaagcctccttgcccaagtttattttcttctgagaaattatctgtggcctctaatacttgcgaaaagtcataaatagtgaattctgaacttcttccttgtagcccccaaattagtgcttcatcttcatccgcgttcgtcttacctgataaatgtagaattggtttgataatatcagttgatttagctctttatgcattcatgcatgtatgtaactttttttatgtagatatatatctgaccttttatgtgccttctcaatatgatggaagcgatgatacagagaaacaatgcaagtagtggagctaccaaagcagggaccaaaacttttgctacgggctctatagattcagagcaaatggttagtttgttttgttggaagcttggtaaggagataatgaaagtaatttttatctttaattactactactctcaaatatagcaaaattagaactgaatgtgacacaacctagtactacaacgattatgaatctggataaagggattgtccagattcaatgtaagtaataggatatatgtgtgtgtctcctatctaatactaaattgttatattttgtgatggaggtgcttaagtaaagatagtctctacgcaaagatgtcaaagaagggcgtgttttgcttactcttttgttttggccatgttggcagtaatggggcgggctgtggcgctggacttggaactagtgcattcgacgacgacccggagctccacgtcggctcaccggcgaagaacttatccgtgtcatacctcagattacaccggagagcaagaatacgtcccccttgccgaccggcgaagttggccgtcgccagatcgctgaaattctgaagacagttgtagcagatatcttcaaccaaatctggagcacactgtgccaagcagaagagcctccttggaagggtaacggtgttgcttgcatcggcatcatccatgtccacgcggattgcagcgtagtgcttcgtcgtggagagagcttgtgctactatgtaattcatcgtcttgatgaagaattgggtgaagttttttgtcccctggatgttggtgttccagccggataacatgggctccgacgtgatgttcatcaggacgagcggcgcgacgccaactgcggccgaggtgttgacacggccgaaggcgtccatgttgaggatgtcctcgtcggagaagcggagggcgcactcgtcgtagaagacggcggcgtccttgctgagcgggcagagccgcgccgtcgcggccgcgtacgcggcgtcgacgcagccgctgcaggcagaggcgttcgcgtcgccgcggcagagcgcgacggcgtagacggtgtccggggcggcgccgcgggagcccttggcgaatagggcgccgctgctggagtcgccgcttacgacaaggaatgatgaggagagaaggctgtcgaggttggattggtagatgctgttcgccgtgtatttgctgctgccgcagatcatccagggctgggcggcgaccataggcatcggcaagaagaagaagcagcagccaaggatgagcaggacggtgagaatcatggctagctatgctgcctcacgcgtaagcgtaaggtttctctgaatctcttgcattccaaagacagggtcgcatgttaagcagatcgaggcagcgacgacctgtgtggacaagtcactgctatcactttcatggagcgggtgcaatgtatagtacaaggccagactgaacgtaaatgcatgggcccacacgttgaaattaatttagaaggtggttgacatgttaaatcatgctttctaatgtcccattctgaacatgatatattttaataccataaatctaaatataattatttgaattcgtaatattagaatgtttcgtattcaatactatatatactacttttacgagatgacgaaggaagcaagtatataactccgtctccaccatcatggctgtgaccatagatagtttcaccataaccgtggaaccccgtgtgttttggtttcattttgcttttcttactccgaaagcctatacaatatgtgtccttttctggataaggtgttggattttttttccgctgttgttagtactcttttcaaaatattaaaacggtgtgtttcgtgtaaaaaaactttaaatatataagttgctttaaattatcaagtaaatccaaaattttaaatttagagcaattaaaacttgattagttatgtgctaataacgagctcgttttgtgtgcactaatttttaaccttcatctacagcccacaaggcactgaacatctctacagccttcatctacaaccttcaaacagggccaaggtatgaaaactatgctcccaaatctctacagcccacaaggtactgaacatcgaagtcaaattaaccgcccacaaaacatacaagtcatttattcgtgtgctgcacaaagtaatacactcagtgtttagggtggaaaataacgtctaagatctcgtttgtttagagatacatatatgtgcgggcgtgccagtgtacctaaatacacaatgtaaacaaaacatagagaacatgctctttattaatcttaaaagatcataaatacaaattcccaatgtaatatatatgtatgcgcgctccataatctgtcattggacagatctgacttgtgcgatgtggtctcctggttcctggggcctcgaaaagctcccagttaattacctccgcaagtctaggcctgcaagagaacctccgattaagctgcttgtggtcgtctcgtcgtcttcgcttcgcgttctccatgcatggttgggatgatgatgtagatgtgtgtgtgcgagcgccggcagcgatccacagcctcgtcggtccgtgcgccggtgttggtagcgtggccttcgtatcgacttcgcccgccctccgtcgtctagcctcgtcggtcttgaacaacatgcatggagttgcgtagctcgaacgacttgacgtcacagcagttgcgtcgagattagattaggaaagggagaaattattaaagatggttgatgtagacggtaaccggatttaatcaaagctcggcatctcatttgggacgaataagaaaaaccaataggacttcttcagcccacgcattggtttgtgcatggcactgtagcagtgatgacatgtcgtcctccgattggttggccacgttgccacaataattaacttaatcaacatgcattagctagcttgttgccatccaacagcactggctcgccgtcctcccgtcgtccttccttcgtactgcagccatacttgtctccatcgtcatccgctggtttcgacgccatgcgtgatacttgacctccggcatgggaatggatagaaatcttggcagtcggtggcagctccggcgatcctcggcgcgctccggcagggcggcttcccgatgacctcctccatggttagcccgctccagtgcggtgaagcttgcaaatcaaggacgtccggcatctcggcgaggtcgcagcttcgggtagatgcatcaccagcagcttgaattagcagcgtcgagtccagggacaagtagcacagcgtcagctcgaacagacgccggcatcgatgaggcttctgtgacgcgtagatgaatcggccaccgcgacttccccggcgacgacgatacgtgcagatggatccctatgcatggatgtgtgcgtgctgtagatgaaagaaaacgaaacaatcttgctagcttttaccttgactagccatcaagctcctctcctgcgcttgctaatgatcggatcaccgcgcgcgccctctcctgccagacgtcgggactccggccgaagtcgctcgccgccgccggtgcgtgtcttcgatggatggatcgccgatgagagttgatggatggatgtgttgatgctggatgggcagatgcgttgatgatgggtggcttgtggatactggatgcgttggtggatcaatttgtggataagttcgtcaatgccccaggctgccgaggggtcgacgccttatataggggcctaaggtcggtgctcgccgcgtccgcgcgccgtttcgtccgcgtcaagttcgttgcagataaggctcgatcgatcagtttgttatttgttcatatccttcttttattttatctcttagcctctcccggtgtcaaatatctgagctctgttaacttctggagcatcggggagatggaggcccagccgcccgcgcgtgcgcagctgggtggcgattccttcatcattatttctgtagataagaaacaatcaatagagataaacttgatttgtaatttgctttgtttctctgctgctgggccacagtccggtgataagcgcctcgccagcgctcgcgcgaagtaactaactcgatcaagtttgttacaaagatagaatcaattggtttgttggttatctcttaattcatctggttttatctcttccgcacgcgtgagcagaagttgttcagataaattgaaaccccagcttatctctctaatttgatcgataagtaaactcatctagccgataaatcaaaactgtggatatgtataatacgccgtgattgtgtcattcattgatatgggctaagcccaggggcaggcgcattaaatttcttaattaagcccattaatcacctcacccttaatcaagcaccatatatttgtgtactgccatgcatgcatgcatgcatgcatgtacgtagttgcttcaccggccgactgacatagctagcttgctcttgattcagtatacacacgcatatatatactaattaacaagtatagattgggcacagtgtgtatttctatatttgcatggcgcatgcacacatgaaatggagagctagctggcctcacatatacctaatgatcatggctatcaggttcatcgttctagccgctgcaaaaatgccatcaaacactcagtccggtctaagaggattaacaaagacaattaattagagtattggaactactgtttgatacacgtgccttctaagcacaaacttttatatataaaagatgaatgattttagaacaaaattttccagataaaagttttgtaatgaaaatttcagaaaaaaaatgcactggggacacactaaatatagcgatctctagaggctactactgacgtgcagtgtcactagtattttttgttcttcctaaacccaaacataatatgtgggttcctggtgatgacatcactgcaatgcagactctgttcacgcccatcaacagtactatgggccttaatgggccagctgttgggcctagcctccctaagcccataatagcttttggtcacctattgttcgaatagttctcgagatattgttgtattttttgtttcctgtgttctttcatctcatacataacaatatagcagatattttgtaaactatatatgcgtacttcctagttaaatgaatgagcagtgtcctgcttaatgtctaaagtctaaactcgaatacatggtgccacacggccgaaagtgatcccacgacctactcttcatcgttttctaaaaaatgattcaatatttcaaactgatcctcaaaagacaaatgaaagtatgataaattggtcttataaaacacgttaactacaaaatgacgtacccatatgcatgcatataaatttattagttcaaatggacctaatttaaatacaagaataaacacatattagtttaaatgaagcatctctcctttaaccgtggcaaccatactgtgctagcatcattgtagttgttgcgtctgtagatcatctatgcacctttgcgtatcatgtcgacgctgatcgacttgagcctctcaatcccatacctatgagccgcgacgagcagattctgagccatgaacgccgtgtctcccttgtcgatcttaggcagggtatcggtgtagatgaactgaagcatggcccgaaacaccctcaaatccatatcatcaatccgaataacgccattgccagttgccgcagcagcagccttcgcctccttctgatctttcccgccattattgccgaagagctccgccatgaacaccggcgaccgtgccgcgagcacgttcttgtgcgccgcgaacagcttgccgccgaccctgatgcgcacgtcggcccccaccccgctgccgaggagggcggcgaggtgccggtgcaggtccggcggtggcaccgccaccgccgtggtggccgcctcacagcggataatatccatggtgatattacatctgatatagaaactttgaccgtctagatgtagacacgaccacaatcgactgtccatcttcttcctcttgatgaatcttgtatgcccccaacttggccagtagccattggcgaaggagaatttcttggccgtgcagatcttctcttcgaccaccgcaccgtacgtcccgctgagtagactgagcgtgaatttcgcttcgacgacgtcgtcggccgcggcgccggcagctggccgggcgaggcagaggtagacggagacccagtcggagtactcctcgcggtcgccgtcggggtagtaggctatgtaccaggtgtggcctccggcgtggaacttgctggagttgatgctgttgccgacgccgatccccttggtttgagagtagccggcgatcctcatggtcatcgacccggttgctgtctcgctcacgacggccgccgccgctgccgccgccgaggtggttttgggtttgggcttaccgtcgccggcagacttggaagtggtttgacccatgggtacaacaagctgtacctgccacggaacctagacaaacagatcggaggaggacgacgacgatgagttatcgatatgatgcgtctcatccacggatagattaattttgtagattgatgggaattagaacgagttcgatacggaaggaatcactgaaatatagaacgtctcgatcggaaacgtatgcaggtaggaaactttggattttttttttcaatatagatccgcctctgtttcatctctcactggattttatgcacattcgctcttggtccgtttcaatatcgaagcgaatccgtattcaattccgcaaaacttgagataaaaacggacggggtagctcatcgccgggccatcattggcgacagttaaacagaaattaatttggtgaatttaagccaaattaaaaagaaaaatcatggggaaatgataagtgaggggtgaggaatcgatttttacaattgaaagaggaaacatatgaggagacagattgatgtggcggcggctctagaattatgtcaagagagaagaacaagcggcgaatcgagacgcgcgcggtgaaaaaggctaggatgagcgatggctgggccgagcccaaacacagccaggccgagggatggaggggggagcaagccaaggcggggaggaaaaggagatgactttcggccggaggaggaaagtccaagagaaagagagatgaaggcccaagagggagagaaaaagggagtgtgagaaaaaggccgaatgggctggctcagagacgatgacggacgaaaaaataagttgtggaagccttacgtattttttaactagacatataggtatagatgtatagaaaaatgacgtgtgttgcaacagataaagatgtttttcagtgatataatagctactatgagctaagtaataaattgaaacattgggatatcattatcattatacattataattgaaaaagtttatgaaaatgcttccttggattcgggccaaaagcccattaattgctttcttttcagccctagctcagaccgtaggttttgaccataattagatcaacgcatctcatccacaaatcgattaatttgtagatgtgaattagatcgagttcgagacgaaaggaatcattgaaaaacagaaagactcggaaatttttttttaataatggattaaatcggtctctacacccaaagaatatacacagcataagactcggaaacttatgcaggtaggagtcttacttttattgaatgcttaggatttttccaaatagtcacaccaggatttcgtccgtagctaaccttcgtgcttcttgcgtttcaatgtaaatttctttccttttgactagtgctatattgccatgcccgtgtgtttcaacgggatctgaagattcaatgacgaaatacaaaatttctttccttttgactagagtgccatactgccatgcgttaaaactgaatttgaagatttaacttcaggagttgagtctagagtagagttgtggagctgtctaaagccagcgtcacaactctagtttattttgtgagagagctccacccaactacacttccagtttgggtgaaactgaaactgtttggctgagctccagctccaggagaggtggagctggagctagagttgtaccaaacaggcccttaatgacaaaatatggacaaacggttttatgacagtttttcctacgtggtttttcagctggtgggtcgtgaatgaaaacattagtaattttttaaggggtaatttggaaccatgccattataattttgcaaagtttgagatatgccatcggtatctcaatgacatgtaggacccacatgagtcaatgacatgtgggttaggatggcatggttccaattttgcaaaattataatggcatggttccaattttctctttttttaagtgggtcttgcaaacacgtactatttcttgcatgaggtgttttttttttggtagtgattatttcacttttcacttttcttttcgtgaaaacacttgcttttttcatgggccgtgaaagcactagttttcatttggcttgtgaaaacatgtacatatgcttggatagacagtttttagacggttttttcttagaaaggtacgatgctcatggaggaggacaactctattttcagagtagaccagtagagagagatgagtcctatcaaactctgcagatctgttttgatgagtcagatcaaagtctatgattcacatgttcgcttccggctccctaacaaccgccaacctgtaccccaacgtcgaggccggccgccggcgacagcaacttactcccttcgtcctataaaaaagaatctaggaccggatatgatatttcatattcctataaatctggatgatgtgtatccggtactaggttggtttttttatgggatggaggaagtagctctcattgaccacgccggagcaagaggcagtggtggggatttgggtgcacgctaaatactactccgtagaagagaaggagcagagaagacagctgaaataatggtgaaagcagaggaaatctttcccgggctccgggtctgattggcattgatagatgacaagggtctatagaaggagaaacaagagagcgggagtgtaaaatgataaaggatcggaagcattctcccctctactttcttttactctagtattttttttatatcagaatttaaactatcatagatctgatttaaaattcatctatagtgttatattcattttgattaaattaataattcaacacccatattgatccctacatttttagtaggcaaaactttactttatatcgtcttctatccttttcatgcatcttgtaccatataagccaataacaatttggtcagaatctctaaacattgtgtacgttattaaccattagagatacctatgatatcaattactaacagtaaattcctaccagaaaagatattggcccccgtgtctttctgcttggggcaacaatggtggtgattcaggctgccacaacaccacccgcctccttgcctcctcctccctctctaccgcctgagcgggccattggaaatcgtgtggttgcaaggatggtagcggcagggtcttctccctctcttgttgggcaaccgacaagcagcgagctgcgggagccgacccggttgcgttggcttccccagtggtggcgaaggcagaggcagctgcgcaggagcccaggatggtggcggtgacagaggcgatgaggtgtggtggtggtgggacgccggttgcgctggcttccccagtggtggcgaaggcagaggcggctgcgcgggagcccaggatggtggcggtgacagaggcgatgaggtgtagtggtggtgggacgccaggcatagtggaaaaaaccggaccggtggtgggacccctgtcgccaggtcgcagccggatctaggcctccgcacctagccatgagatggtgtctgcaagaggccagacggtttggtgaccgcgagggcgtccacgacggtggtggaggcggctgcatcaaagtgtgacggtggtggaacaacatcggttgtgttacggacggatatgggcttccatgcatagatttgtccatgcatcggcggttgtttcgatgggagagcgagcatcgacgggacgcgatagttggggcgtgaccatctaggggccctgcaccttgatccccgttggggactacacaggccccatcctcggcaaggtaaatggtgcgatgtgagggagacgaggccaacgcacggtggacgcatgctgacaacaaccgtggccaagggcgagttcgcgtgcatggaatttggggatgtctgagagcagttgctggcgactactctccactctactcatgctcatccatcgatgatgggatgtggagggcagcttggcaatgggatggggcagtgtaatgatggccagctgcagcggtgtggacagtttttcccctacttgtgccttctggtgatgggatgggagcgggcatggcaactgttttgtcaaaggggcacatcaagaacataacaccgcccgttttcttgtcctatccatgtcaattgaccaccacctccttgacctcctctcccaccccacaacgccacctcggacccgccaacatgtgccacattgtctctgcagctcttagctagtacttcttgtttcataataatagtttacaaacataggaaaataatacttttatcaaactgtatttcaagatcattttcaaacatagaaaaataatactcatatcattttcaaatatcgatacccaatacataaacataacatgtaaccaaagtttgaaatgaattatcgacttaaggcaactccataaattccatttatttgtgacttggtagtacaaggattcttcattattgacatacatacccatgaaatataccatttacagtatggggagatctatagacgactcgatatgtgactttggctccatataataacatctagaaagtcttttattcagttttctcttatagaccaacaaagaatacatatgggagcaaacaactcgacatctcaacacacaccttggactccaacttcagaaagcttaaatcaagcaaaagcagctattgtatatattcttgaaaatatggacctgtgtaattaatccgccgctatataagaacgtcatatgagacattcgacactagatcagttttaagcatgttcagggccagacttgatagtaggattctatttggagccatcatgtttttcttcacctcctttcttccagaagaaaagaataacaacaaagcccaacacaggtaagagaagcaggatggcatccttgaatgtgcaccaattccgagtactgcctgccgcgtaggctcccaggagggcaagcatgtccagcaacatggctgtgtgcattggccaaagaggcaatttatgttcatcgcccttggtcatccttcgaagcagcaaaacaatgacagtgatggatgccatgaaggaagtggagttgctatagaaaaaagcattgtaccgacgcttgtcgatgtcgtagaggaccgggttgccagcagagtgcccattaccttcatccctccacaggccaccaggtggttttaggcccgtgaggtaggccacactcgcagccaatattcctgctagcattaagtacttggccatcatgtcggctttctttttcatgtcagcttcctgttgatcttgtgtttgtcttggtgtgtccatcatgccatcttccttgttggtttgttgattttgtgtttgttttgactgatgttgatttatgtttgcacgttgtccacgaccgatgattgccacatagactacagctgcaaaaactaccgtaaccaatattaagacaacgatggaggttcgcagatgcatcgaacttccagcagcataggcatcgatgaggccgaacatgcccgctaccatgcagacaaagagcgcatagcactttatgcccggcccgtacagatttcggttgagaaggagaatgatgagagccacggatgccatgaagcttgctgcattgcaataaaaaaatgccttgtaacggatagggaacttgtctagtaggacagggaagcctgcacggtgcccaaactcatcattttcccagaagccacccggtggggtcaagccggcttggtaagtgagtgttgcagccaagatttcaacaagcagcaacaactcacgcttcttctccaactgatgctcctttatcttgtcttcctcaccctgcttgtccgacttcttttctagtgtggagaagagaatgtgaatcaccacatagataaggacaccaccagccaaggcaactgtgtaaatggaagtgcttgtgtccctgcaacttccgacagcgtacgcgcctatgaggcaaaacaaatcaagtatcatggctgcctccagtacatggcttctaactagaaattcattctgcaacatcaccatgatgactagggatgccacaaaagccaccgagttaaaatagaagaagaccttgtaccgcctagggtgtgttgtcaggagtattgggtctccactgtggctagccccattgtctgcccagacgcctccaggtggatctattcctgcttggtaagcaacgatcgccgcaagaatggcaaggagctgaattaattcacaaggcttgtctagatcattgttgtattgtttacttcccctgtacaattaaatagatagttcaattgcagtctagaataattcttttggtactcgaaattgatgatgtggaattaagaatttctagcactcaaaaaatgtgtacaaaaatgcaagaaattctcaccgaatcaatcccccccccggtcccccatgtcatcatgattgaaatgatagttaacaatgtgaaacaaattaatttttgttcggttagcccaatatgtggccttaaatggctccaatcagtaatcactacatctccctaggtcttgattgaggggcacgaaggtcttttccttcctcttaattgatatgtactcaaactattagaaatgctacagcccccctagtactggtcctttctatgcccatgccagcggcatggatgatcgtagagctatcttcatggaagtagaaagcatgaatagaaatattttttttcaatgatgataagcagcgatggagcaagctagaatttcctcatgcccgggtcgaggctaaaaacaagggaataaaattggcaggcgactgatagcattttaatgatgtggagcacaagtagttgggcattatgaacacatcaaggtgtgaagagcttgagctgatgagcagtccggattggaagcaaggtcattgggtgcagtggcatggactagcaggaaaaaaattataagattatagccctaagagactatgatcaggaaaaagaaaaaaaagcactccgctgcaagttggcgactccaacccatagactcgaggacaagactaacgctatgcgtgctcggttgctatcagcctttcgaagggagaacaaacatgtcgcctagatcaatggttctcgatgagcatgtgctttgtggatctatgatcatgttcaagcaaaactggtacaataaagtatagatgttaatagtgaaatagttctagtgataggctcattttgtaaggctcatgtctacatacttttgggagcaagacaccattgagtccatggaccttttttttcttttaccgtaccagtttctttacctatcaatggttctcagtgagcatgtgctcgtttattatagttttacagttttcaaatatttctaagtaaaatcatttcctacaatacacaatataaatctatgatcgttttccatatatctttacataaggaaaaagttcaaatacccccctaaactttggatggaaatccgtcaagcaccttgaactttaaaatcaaacacccattctcctaaactttgtaataccatgtatattactctctaaggtggttttggatggtgtttttgcatatttgaaggcttaaacgagtggttttgaataactaatatacatatttaaatatgattagttagtaggacatcaatttatattatatagtggtgccatattattattatgttgatactcattttgtaagtgagattgaataaagggtacaaattaaagaagggatatttaagtgaagatcttagcatgtatatctaatgtatatgtcacgtgatcaaactcattcaacttatatacaaattagattaaaaacatcttatcgggttatataaatagtactataaagttcagagagttgtatgtccgttttcgaagtttagggtgctagatagacttttactactagagaactcatcttttatccaatgccccaaacatacaaatacctcggatggattaagaagcgttactaaatctctttagtaccggttctaaaagcccaagtccctagaaacatttttagtaccggttggtgttatcaaccggtattaaaaatacatctgtagtaccggtgttagcaccaatcgagattaatgctgatggatctttagtcccgttgatattatcaaccggtactaaagatgtatttttagtactagtaggtaacaccaacccatattcaagatatttttactaaagatgcctcctgagttagttcaaaaggaaatcatctctattcaagtcaaatgtgtaaggtaggtgggatcgtaacacgcgtgagggctgaagtgagatatcttgagtttgattcccacatcccacatattttttttttgacttggtttgcatcgttagtaccggttctttagtcttgatttttttttgtcacggttgctaactggaattaatgggtatacatctttagtaccggttcagatcgagatctttagtctcgattttttgtcacggttgctataatcgggattaatggcggttttcaactgatattaaaggtgatttctctcctggtgtttcaatcaaagtttagggtgatatttggactctctcctgcatataaatgtactacatgaagcaaggaaaaatgtagggtatgtatgtttttgacctaatgtggttttatatatcctacactttgaccattgtattttatattatattgctcatgatcttgaaattgacatcattggaaaatgtttcgaaatatgaatctaatcataccataatgatttttattaaggacaaagaagttttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacatagccggtgtgcctgctgtccctgcagctcccggcggcgtaggcgccgccgagtcccaagatcgccgtgacggtgagcccgtacagcgggaacttgatgcgcttgaggtcaagcttctcgtagtacacgttgaacgtgatggcgagcagggacgcgatgaaggagatggcgttggagaagaagaagaacttgtaccggattggatggaggcccggcagcaccgggtcgccggcggcctcggtgctccgccagaagccgccgggtgggttgagcccagctacataggcgtcggtcgccacgaagatggcgatcaacatcaggatcccgacggcggcggcggtgtcgttttcgccgtgagggttgggacgatgaagacgatgacataggcggcggtggcggagacgagcgcggcggcgccgatggtggtgaacttgtcatggctggtcccggcggcgtaggcgcccatgagggcgagcaggtcgaccaccatcaccgcccgggtgagcgtgagcagcttggtcccctggtgctggtggtggccggcccttgtgcaggaggaggaagaggaggctgaccaccaccagcgacgccgcgaaggagatggcgttgaaccagtagaagacgatgtagcgccagtagttggtgtcctgtaggatggcgtcgccggccagctgccaccggccgccgccgccgccgtcctccagccacgagccacccggcgggttcagccccgccgcgtaggtcaccgtcgccaccagggtggccagcagcaccaggtacttcttcagctggcactccattggcgacgacgacgacggctgcttgtcgtcgctgctgccgctggaagaagtgaggttttgctggctacttccaccggccaccgccggagccgccattgatctgctactgttgatcgggtgatcgatcgaggtgaatctttgagcaataatacacacgatggcatggctctatgcatgcatttatatagagggctgatcgatcgatcgagcgtgtgtcacaatcatggcatatatgtattacttgatcgtctagtcatattttaggctttattcccttgtcatttttatgccctttgcatttcattcggtagtgtcatgcaagtgacattcattcgtgcacagtgacccttgcacgcacgccaggtttctattccttatgtgtgtcgcgcacatgctttgttttgagctgctgattaaggccgtgatctctcggcacacaaaacgaagcacgtattattgcatgattaattaagtattaactattttttaaaaaaatgattaatatttttttaaaacaactttcgtatagaattttttttaaaaaatatacaccgtttaccagtttgaaaagcgtgtgtgtggaaaacgaaagaggtgagttgggaaaactaggggaagaacacggtctaattatggacgtttttacacgaattatgcaccagttcattgcacaaatcgtgtgtttttccctttcttatgagtacaacgtaaataaagagcgtgtaattttgtatacactagttatagggctagcctaatgggcgggtgatcgccttgggcgatcagcacccccatccctcccctaacacgcacacgtctccccttttatcctcttcctaccacactatgaaatttcaaaccatttaaaaaatataaaagaaatctaatacacttgaaaacatattcatgtgaataaactttacacttataaattataaatatatagactttatgtatagaaatattctatataaaaatatatttgaatccaaattcaaattcgaatttgaagcgagtatataaacttttaccctataaactttgggtatatatgtgtaaactgggctgatagccgcgcgtgatcgatcacgcgttagctttctagctagttatgtcccctgcgttgcaacggttttttatccagtttagtagaaaaaattggaccgagtagaccatcggtttttataaagtgaccgggctttttttaattagaaattggttttttaggatggatgtttttttatgagaggtaagatatgtttaagtagaaatggaggatggattgatagaagaagacaactccctctttaagtagttgtgagatataggtttttattcggttaagagggcaactccctctttaagtagttggagtattttttttttataaaactagagtacttgaaattaaactatcaatgtagatatgttatgacgttttagtcaaattatataaatttatctaaagtaacaactttcataatttattgttatgtaataatgatacaatttaaaatgaactttcagtttcattggtatgtaattcatcaagggaacatttttttatggaacactaatactgtatgatttaaacataacacaatgtatgccaaactaagggccttcaaagttcaaaccaacctttccaccggaaatgcatttaatgtagtggacgaattccggcccatacgtatagatgggctgaggggtagtaggaccacgtgaagaaggaaaaagtccacttagactcccttaattgttcacc

SEQ ID NO: 74760 - DNA, 30978 bp, Oryza sativa
ctcccggagtccacggagctcggcgacgacgcgttgagcgagctgcaggcggccgagctcgcgtcgttgctgctgctgctgcaggtgcagctattgctctcctgggacatcacttgctcttgctccattcgtgtgtgacgagctagcacgcgacgaaaaccaagattgcttgctagtgatcagtgatcactcgagctactggcgtttcttgctgcaacttgtcactgtaagttggagtgatcaacaagttggctgactagctagctgtcgtctgtggagatgaaggcaatgtgatgcaccatccatgtatatatattgtggctctaagtcaatgtgtggaagacacaacaattaaagtggcactatttcttttcttctcccaaagaaatgtgaatgacatgcaaacggagagagagaaaaaaggtgtaaaatcacgccatgatatgtagcttaaggacgcgtttcttctctgatctgaagatctcaatatactgaagttctgcacaaactatagatttcattattcattgttcccgagctcggcgcatcgattggcttcgtgcaaaatgtgtttctttggacgatcgagcaatgattaaagtagccagaaaatgccaagccacatggcaactccgtacttaggtgttagcctcgtgcaaaatattaaaatgcaaacatatgggaatcgtctatatttcacagatccaaatctttggatctgcgtgcttatattgtgtttcaataattaagtacaaatcaataatgcaaacgggcgaaactaatggaaagggtgtcaaccagcagatgggacagaaaaagcagtgtttgttgggataagaagatgagaagactaaagaacataatgcaaagcaaagctggcaataacccattatttttgtgaagaaaatgcagccatgcagcccatagtaccctttctttccccataattttcaacttaactattgatgaccccgtgtataatgttatctgacagaataatcaaatatatacgaccagagattccagcgcgggaacataaaaaaaacctacggggaggaactcgtggcgttgctttggagaattggggatacaggtgtttcctaagatcacacttaaaactttattaaggattgctaagttgcgaccaaacaccaaaattcgtctggagaaaaagctgggataaaactaatcttcgctatttgagctcacctttcatttggccccatgctagaatatagtgacaagcaatgagtgctttaatttctagtggttcgtaactactggaatggaccagaatgagagtattttatagacttgaggataacttttttttttttggctgagaaggcatgcatcaattcgagaaaacagaaaaattaaggtcaaagcagaacagataactaaacagagatgatgagtgaaaacagcgtgaggatcttcagacttcagtgaaacctgatgatatgaagaattcttctctctctttacctttacgttcaaagcaaatctctattcgttcaaaaaaaaaagcaaatctctgaatcttagttaaatataagtagctagcatcaaccgtagtaggaattcatcgtgttaatttggtcaattaaaagcagatgccacagacggcaactttgcacgaaagcccagatgatcggtttagatgttacctaatgcacaacgcgagtacgactgttgaacaaagaacgaaataagacgagaaagtgcattcaagacgattcatttctttggacggcaatttgaaaccgaaaacacgctatgtttttatacatctaaaaacgagtaaaagccttttcttatactccatatatctatcatcaaacactttagtgaacaagggcgatacgtagctaaatacgggccttgcttcagttctgacttgaccttcctgccctgtcccaaacatttttttcttaagctatgacgacgactagccgtacgtagccatggatgcagagacaataggagacatgacagaaattacataacaaatcaaggaattctagaacacgtatcacaaagtgccagagcaaatgagtatgatgtgcccatatgtagccaagtaaagagtggttagtacgtccatgagctccacggccgaaataaaagagtggttaaaacgtccatttgcttcataacttccatataagtggtctttttcctgaaagaacagcatgatgcttatgtagacggctggaagaaataatactagatggtgctcagttcacgaaagctacacttctactgatcgaagcgtcatattgttagacgaaataatgcgaataattaattagctgagaccacatgcgttagtttcagtgaaactaacacgctgatggggatctgcagggcattattgtcacatgaagaacggtacgtacgctggtcaatcgtattccctactgtataattagttacaaactacaaactttttgtgtgtttgattctaatagaaaaggacttttgaccaattatggtggtctcaatcgatcgttctcctcacatacggttcaattacatctctcttttaagtgtgatctggctagcttttgttttaagttttactaattcaaagccagagcttttctctttaaagtgttcaaagcaacagtcgattgattgctactattgtctggcaacaatattcagaatgaattcttcagataaagagaacgattgttatattgcccatcttttcttattccaaaagaaaatattgtccatcttttcaatatatttgtatgcaaggattatatactataactaaacattcacaaatacatatgaatgtgagctgttttgcttcagatatttctgcacagcctcttataactactggttaaaattaaacttgaccaaaacctccatttcatcgtactattgtgccctattgattttgaggtgttattcgatggtctctagactagtagaatagttatttctaagtagtaatggaactcataaatcaataatttagatcacttttactgatgataattatagtagaatatatattaccgtaaagtcctaattgattttagagttcttttatggtcttttatgacccttgtgggcacttaaaacacaaaagcccacaaattttttaactatagtccttgcgaaccaacctccagggtttaacttcactgtatcccccaaccacaaggacatcccgatcgtgtctgattccgttggcacttccacgacaaaatcaggtgacatctatcggaaaagtggtatatatatactcagcaaatctcaatcaagggcatgcttgattaaggcacgtacgcgtcataaaatcaatcattaaacagatcgatcgatcggctggtcgcaccaacattctgttgagtgcttgctaaccgattagctgcttagctcacactgtcacacgcattggcacgtccaaatccccgcaaaaaattgcgaaatccccagcgaatcgcccgctcccctctccgcgcccgcctgcaatctcaaccagcagcaaatagaggtacattgtgaatatgttcacgggttagccacttacacccttaaaataagaaaagcgaacgactgaagtcgtgcggcaccacagcctcacataccgtaacgttcccttctccgatcggcacgccggccggcccggccggcacggctcgcttccggtcgggccggcggcgacgacgacaagacccctttctgtcataggatcctctcctagaggcatcatttcacgcattatgtaaccgtacatgcgtgtggtttagccggttttgattattatcagcgctgcgtcgctaattcgacagctcgctcgcgtttgctgctgctgctgctgcagcttgcaaacgcatttgctcctctggccatgtgttgtgcatgtgacacggtcgcctctgctcgtcccgcgctcgacgcgagctcgcacttgggctagctagctaacgtgtactagtacctaagatcctcaatttgcgactaattggatgattaattagggaaaggtatagatggcgagccaggagaggttaactggttcgctgcgccactggcgttggacttggactcttgtgggaaccggtaactggcgtgcgagtgctctgtacctaaccttctagtcattggcttgtggttttatttatttttcataacttacattggcaagtcccttgttattttctaattaagatatagattttttatcttaatttttaaattgctaaacggcgtattttgtgtggaaacttcttatgtagaagttgctttgaaatatcatataaatctatttcttaaatttaaaataaataaaacttagttaattatatgttaatagttttcttattttgtatatctgtatttaaattttcattagtgaactcaaacggaccaacagagacaagtgaacattgtgtgcacactgtatggaaccttctttgctacttcctctccttttcttttcactcttctagtactgttgagatattgagttcagtaccactagtaccagcacagtacgtgtagtaaagaaaggctggaagtagaagagcttgaaggcacagttggcatttttatagtttattatttaactcccggtacttgttcgaaggagctgtactccctccgtcaaaaaaaaaagacaaatcctggtttccgtgtctaacgtttgaccgtccgtcttatttgaaaaaattataaaaaaaattaaaaagacaagtcacacataaaatattaattatattttatcatctaacaacaatgaaaatatgaattataaaaaaatttcatataaaatggacagtcaaagttggatacgaaaattcagggtttgacttttttttttttttgggacggagggattacgtaataatgacgtggcagcagcaagatccggacttgttatgagcaagggctaatctggtgagaatttgtgtgagaacgcactctggtggtgagtgatgtacacaagaatccatgcacttactgccaaactcattgtgaaatcattgaggcaagcaggcaacacatacatctcaattctgatttttgctgattgtccgctgtttcaccgcaccattaaaacgacctccaaacggccggccagcagcccaccacacccacatgtccataaaaaaaaataaattatgcacatcaataattcaatcagctgaaaaaaaatctgcttcgaattaattaacttctattagtagagagatctttttgattgttggtacacaaagcacacaggcttcatggcctaatcaagcacaacatagactaaactttgtcaatagcagtaactactaaatatagcggtaataacatttttcccttttttttctttctttcttgagagttgtcgttgtagcctattcatgagcccagaaaggtaaaatggctactcggcccacaagagtggctcattgagcacgacggcgtcgccgccgtcgtactcctcggccgccagtgccgccggccacaccggcgaccaccagagcccgtcccgtaggtcgagaagaaggtcgggtaggtcgaagagagcattgtcctggccgccgtcggcgtgcaccgtgtcagggcaggcggcttcctcctcgggttgctcggcggtgggcgacgacgacggcgacgactcctcctcgcaccgcacctcggcggcagccttggcggcggcggcctggatgtctgccggggaggtggactccgggcggggcagctcgtgggcgctgtccgggaagttgaggtgcgcgttccggcccttgatggcgagcgcggccacgtcgtgggcgcgcgccgccatctccgcggtggggaaggtacccagccagatgcgcgacttcttgcggggctcccggatctccgacacccacttcccccagctccggcggcgcacgccgcggtacgacgggtgcttgaagccgctcctcggcgccgaggcggcggtgcaggtgctgctgctgtcgacgccgccgccgccgccgcccgcctgcgccttgccgctcgccgccgcgttgtcgtcggtgctgcagctgctggtatcctcccctgcgccgtgggcggcattggcaggttcctccgcggccgctctcttgcgcttcttggcggcgtgtttgggcttggagctcttgggccggtcttgcgcgccattgtcgacgagggaggaggtggaggaggaagtggacagcgacgaggaggagaaggagacggagacggaggaggaggtggtgggtgtatggctcgcgtctgcttccatggctcccgttaggagaaggccgtggcccgtggcgaggagagagatcgatggaagtgcggtctgcggcgagtgagcgagtgagtgcctctggctataaatagtcgcgcggccttgctttcttgaggtggggcagggtatgttaaaaagccttttgtttccctttctacgcaaggtttttcattgattaatgtagatgattaattaatttcatagtttcattatagaactcaggaccattggatgataaaaaccaggaccatcggatgataaaaccatcattttccaaccatttgtacgtatagcacttcttggaaacataggattaaaaaaataataataaagaatatatgatttcagcgtaaaaaaatataggattttaacaataatacttgtgtaaaatagataattgaaaaacattaagaaaaaacatgtttgtttagttagatggtgggaaaataccgaaatttaagaagaaataaagactcaaataaaacttttcatgagattggatatcatgttaaatttcttatataatatgcacggaatgaggaatttgtaggattcaatattatccaatattttatttcaaatggctatttaaggaagaacattttttagaataaaattctataaattccttactatgttttttcttcaaatcgaaacggcctaaaatgctatttcctccgtttcatattataagtcgctaggattttttttctagtcaaaactttttaagtttaaacaagtttagagaaaaatttagcaatatctaaaacaccgaatcagtctcattgaatctaatattgaatatattttgataatatgtttcttttatgttgaaaattctactatatttttctataaattaatttaatcaaacccaatcaaaatttaactaaaaagtcaaaaggacataaatttaactagataaaagtcaaaaaattgttttgcctcttctgatctaaagctttagaacatagggaaccccaaacctaaactaagatttgttcaagaggtgggttcttttgcattttaaacaggtggagctagtgaaatcgatccctgaaacaacaacaaaaatatcatcccaataagtcaaattttgaccaaagatagtttgactctcatagtttgattcaaaaataatgtatggtcaaggtttgttacgagaataatcattatattacaattatatatgagttttcttaaatttgtatagaagagttgacattttattcacttgagcaaccggccggcatgaggcagttgaaactaaagcaacaaaagtttgtttgtttttaatctggacatttcagaaaagtttagaatgcaagaaaaaaaatacaaaatatattatgataaagcaaatacagcgactctcactgcttttactgtttcatcacatgagtcaaaatcaaacattcagattttttttaacgaaccaatataaggtgtaccaatttcattaactatagcaggggaaaaaattaactaaacaaggtaaaaggagaactatgttacgactacggaacagtcttcgaaaaacgttttgctcttgctaaggcttaagtcttgaactcttccttttttttttcaatcaacgaagacgccgatggctcaaatattttgattttggtactatattgaactactaatttgcttgagaaggttctgggctttggcatttacttttagcgttgaaacttaaaagggattaagcagagtatatatataactacaacctactaacagtactctagacctggtcccccaaaaaaaacccgtttctctgccgaactagtttaaagctaaatatacagtgaccgtacatactgaccacgttgatcgcaattctagctaattctggtcacgtttaacacttttaactattactacttgatgcaagtcaatcgatctgtacgtagcacagggcatatagattaactcatcccaaataaactatctcagagccggttacttaacaagatcttcagtagcattatttaggcctaatggtggagccgcggagagcaagtggtgtttgcttgggtacaaaatggttcggcgcaacgataagatatggcgcgtcgtgtcgctggagttcgacacgagcaaatcccaacgaacgtttggtcgtctcgatcgggtccgattcgatccagagccaaactttggcttcgttttctcatcagttttcctttttttttcccctccttttttgccgtttctgcgcttgacttccccgtgagtttttgctactactctcctcggtcggccgaaagaaagggatgcatgttaggccgtggcacaccaccctcgcgagatttcagctgtgattgatggggagcgtgtcgatcatggcgcgtatgcttgcacgtagcatccggattgaattgcgatccgttgtctgcatgcctcgctctctttctctcttccgaggatttgtcatttatcaacgtactgctccaagccagaaagttggattgtaagggtcaataactccgtggaacccctagtgtgcggatcgcaagagataccccaggaagtatgagaaacttattagtttacggactagctagctagaggccggccgtcttccgagtagaacggaggggaattgaatgccgttgtgaactgagaggatcagtggattgaagaacctgggcaccggagagggagcagattaatattccttccacgcatatctagccgtacgtgctggcatccaagtactagtacccaggtaacccaacacgatgatgcccctctgtactcgctcgtgcgcacgaacgacagcacgattaatatggggttcagaaagcttcagaaaacgagtatactttactctcagtaaaaacgcaatcacgattcgatcaggacgtacaccggagctgatcgagacaggcagaggtaaaactaagggagaaggcctggctgtcagctgattaatactagtagtaattcagaggatcaaggcacggaaatactaagctccccgagacgtgtagtgtggttaacgcgacgcgattaaatgcttgctgcagggcttgctctttcgggcaagctacagctacagctacagcacagccgcgcccttcgccgatcgtgcaacacgttctctctctctctctctcgcgcgcgcgcgcgcgggagatgcgagatttgaccctttgaccctgtgggggcacaagacagaagagaaaagaaaaggaaagaaaaaacaaacgatcgcgcggttcccgcgggtcgcgagccgcgcgaggagccacgtgatctgagctaccgctgcctgcggcgcccgcgccgaaaaatccaccgagtctctcatcaagcaaaatcgcggtggtttggcacgcaaaacctctcacgtcgtcgtcctcgacaccaaacgcgatcccatcttaccagtagtcccagtacacgagtactaagggggtgtttagatggggctaaaactttttagcccatgtcacattggatgtttggacgctaatttggagtattaaacatagactagtaaaaaaattaatttttataaatgagagctaatccgcgagacgaattttttaagcctaattaatccataattatcaaaagtttactgtagcatcacattgtcaaaatcatgacgtaattagactcaaaagattcgtctcgcgaattagtccaaggttatggaatgggttttgtaattagtgtatgtttaatactctaaattagtgtctaaacatccgatgtgacagggacttgaagtaagtccctagaaaccaaacaggccctaatcctgtactatgagctaaccttagccagtgaactaacgagacctccattgatcatcctagtagtactagacggtagccctggtacaaaagtcccggcaccaagggcattacttctaagttacagagcgtgtctacctgtccaacgcatttatatatactctctctacgacgaacccgggcggtgtacgtgcacgtacatatacgttgcatactgctgcccactaaggccagtagacggtcgactctctccaagcgtcgtcttatatatacaggcagcagtacacccctagctagctactgcttgcaagtaacaattcaccgtcaagcgtcaaagttgtatccaacctcttccgtatagcagcgaccggaggagtcctcctcgcagagagtcgcagtcttcaattcgtacgtgctttagcattgtaagatttgggtagtattagtagtaccagttcttaatgcacggcgacgaaactacactcgcattggttatcctagcgccgagacacagtacagcttaaatgcgatagcccaagaacagatgaatggtagtagtaccaagagcttgagttattgctcctcgttaaggcaagcttaacaattgcagcgtttagtctgaactttttctttcttttttgcagtactgcagatatatgcagtgtgctgctacagtgtagagtagcaggtacgagctgccctagatgccaacggcaggtaattaatgctaagtaccaagctggcaagctgccctaacggaaaattactgtattggttaattctccatcacgtcaatgagtacagtaaccgcatgctaccggccatgcatagatatgctcctgcagagtcctaatctactcctcccgatgatatctccccgcatattaatcatctccaatgtccagctgagcgtgcaacgcaacaggctgtagttaacgaccgtaatttaagacgccgggcggtgtcaatgccgtacaaccagcagtaattttgtcataaccaatgaagcatttaaccagtgatgatgcagtgtgcgtagtttgacataaccaattaatgatgaggcgtttcaaccttgaccactcagcttactatattgtaccatcgccaactcctagttacgttgatcaatgaaataagcaatgaaccaatgagtaactgcaagcccccaagttaccatgtccacacgcaaagaatggtgtttacattgtgatccatgctaccatgtgtctagtagaagcctcaactctaaacactcaagttggactggacacctgaactctcggtggaacttggaagtagtagtacatgtacggggcaatggcagattacggcttttacttggcggctttcctttgtattcatatgatgcggtcaacagcaagttggccgcaacggtttggcgaaaaccggacacaatccatccgtatcaaagagttcggcacacaggcacagaccatggcgagctaaatcctgaaccgcgccgccaccatgagccggaaattatggcagattggctgtgaaacttggagaattttcagtttcaggcatatctacctgaaaaaaaagggggctaatggcggcgacaggaagatgcgttagcattagcagctaccacaaagagcagggattgtgaattactagagcctctgctcttggtaacggagaagataattaagacaggtgggtcacagctggaatttcagctagtaagagaaagtttaaagaaaagacaattatcgtcactaatttggagtagccggggataatacatcacaactgcactaactctagcacactaatcttaatatttttattttatttgtttgtccaatacattctttattttttttccttttttagagtttgtgtggaggggtcccttgcacatggatgactccatctatgtttttcttcgagtaaagtgcataggcagtctttaaacttgtaaggttatgtcatataggtccccaaactcttaaaatgcacatctaggtcccaaaacttgtcaaagtgtatcatttaggtcccaaatcgacataacccctatagaatcctatatggcgctgatttggcatgccatatggtcgtgatatgcccttttcttctttttcccttcttttttcttcgttttcttctcattcttctttttttttcctttcttctactcgggaaaagaaaaaaaaaaggagaagaaagaacaaaaagaggaggaggaaaatataagaaaagaagaaaaagataaatgggtttcatttgttagtcaaaatgatgccacgtcttgtccgtgtggcatgccacattagtgccacgtaggatcctataggggctggggcgatgtgggacctaaatgacacactatgacaagttcttgtacttggatatgtattttgagagtttaggacctagatgacacacccctacaagtttaaggaccgcccgtgcactttactctttttcttctctcttttatctcacatactagcttatgtgatgtcctgagacaatgctctaattcaggctgtgtttagttcacaccaaaattgaaagtttggttgaaattggaacgatgtgacgaaaaagttggaagtttatgtgtaggaaagttttgatctgatgaaaaagttgaagtttgaagaaaaagtttggatccaaacaaggacttgatgtgatgaaaaagttcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagaaaatttgaagaacaaaacacggcctcaagattcaggataatggagtattttcgtcaatgtttttctggccctttgcatgattcacattacttattacattggcagacaatgatcacagttgccgaaatacggtttactttatgatccgctgacctgcagacttagaactctgtactgttagcttttagtagtaagaaattactgtgaatcctgcaacgtggttttactttagagagaccaactagtttctggaattctggccagtccttgcctctttggacttctcagctctaaatcacaaattagcttttaggagtatcgcataaaggcttgtcgcttcctagctacttttgctgactgcttcatactgtactcagcatcccaaacagagacgcatcgaagacccttcagcataccattttcagtcaatacaacatgtaaatatgttcattaccaataaaaacagaaacgaatgctcatccaccactttctcctaggtaggagtatatcttatgaaggccaagaaagccttatgttgttagcacaagcttatatatcaaacgacacaacttagacattcactatttaatttaactagtacaaaatacactaaaatgaacagtctcaccaaaaactacttagtttacatggagtatcatcacttgcgccagaaagtgacacttcttactgttgagcacactgtactcttggagcatcctcctcctcatcttcgtcgtacgcttcctgcttcctttgatactgcttgcgcctcatctcctcttctatgttcacatcatgcatggtagtttcctcacattgatccaggtccatatctgataattggtgcccaggtttaggtggtaggatcatctcaagtgcccggcattggtcacgggagagtacaccagattcagggaactcaacattgaattccacaaagagacggcccttcatgaaaggccggccatggtgtggcattccctcatcatttatggccttgtgttgacctgtttggaaaatatttgagttaattctttaaaaaagtctgcaactgattagaatctgaatagaaaaaacagaattacgaagtggcaaacaaaaaggctagcattttaaggggatgagataccaggtttaataatttcgccaggatttgccttgattaggagctgcctactgtccagatgagtgaggatgaattggaacccacacaatgcctcagttaaagagattgtgcgctcaatgaacaggtcatcatatttcctcttaaatcttggatgtaccttaacttgcaagataaatactatatctcctgtcactgtatcaggctgcaacagcatgaaacacacagtgcaaaatattagataaagaaagtagtgcatgcacagatattcattagcacaaggatggatgaatatgtggctgcaagtatgtatactagtataaatggacaaaataaacttacagcttcatcagcttcaccttggaatacaattttttggccatgttgcattcccttctcaatatgaacctcaagcacctttttctcctgaataactttgctagctctgcagtttgtgcatttatccctgtcacttatgatctcacctgatcaagtatagaacattacaaacataaagcaggctcctaagaaatcacaattttgcagcaagatatagcataaaaattggagcaactgttgcatacctgatcctctgcattcaggacagacagtctgcatatgttgaatcatgcctagtcctatctgtcgcattatattcctcattcctacaccatgacaaccatagcatgttgctggagcctcagatttggtcccttttctgaaagcagagagtaagatggaaaaggtgaaacactacagtcaacactcaaaacagataaaaaaaacatgataaactaattatttttttgaatgaagggcaaaacctttgcctcttctatatttatagaaggaattttacagggcccctcagaatggtgaataaacctggattgaaatgggccacaaaaaaaacatgaattttgcctcgtatatattttgaatgataaactaaactaattatggtgatagagctagctacgcctcagaatggtgaataaacctgggttgaaatcggccatatagatgtatttgatctgtgtaatgtgttttaactgggctggacttatttttaaagctttactgggatgaagcatttcaataggcactgtctatttgattgggtgcactgtctatttctttataaaatgggaggttagctttcattgcacattagatgtcgtatttacagaggcagtcaaaattagactaggtattcggtagtcggtattgcaagcttggcattatataggccaattcacagccatcttaatcaggatttacatactacatatgttattctataattatactatctgaatgcccctgcattgcaacatgaagagaactcctccatacactttacagcctcaaaaattaataaaattattctcattgtaaaatcttctagtcatattatttgtcatcatttttacctcacttcaaaagaaaaattttctgtttgatggcttgaggttggggaaggggcaaaagtccacctacctcactatttgggggacccacatgcagtggtggtgggtggtggcaaattcaatactcaccaccaccattggggtcttttagaggagtatagatatgtaggactataataaacattggctttagcatggagtccaacatattccccaaatgtgcaagatacccttattaaactagttttggacttttggggatggttcaggttctataaaattacgtttgcacctttttttaattcaataaaagattcaagaatagaagcagtgtggataaatgtaaggatatcttctaacattgttggctgacacaagcatgtatccgttagcattaggtctctcattaatgattttttttatggataggttgaaacagaacataaatggaatgggataatgttaagggattatccagtaaccgaaacatttaactgggtttccctgcatctcaagtacatgcaaaaataatagaaataagtgcgcacgaaaatacaaaacaaatacaatcaccagttgatggatttaaactagcaatatagagaaattacagtgaacacttcgggataactatttacaccttattttcaactagatggaatcatatgtatcgataatgctaaagtgaaagagcatgataagtaataattttgccaaataatgagtacatcatttcctccagttagcaaattgaagtgcagcaataacatacaaaggcttaccctttgcactttgggcacagaatatttcgtgataatgatagtttcttcatagatccattatacacatcttctaaagacaccttcaaagtatgcgccacatcttcaccacgtctctgtctgcgtactcttgagctactccctgttaaccataaaagttagcatgaataattctgtttttttttaaaaaaaaagttcaaacaaaaaaatgttgagggtgctggaaaatttcagggtacatatgttgcttacccccaaaggcaccacccccgaaaaactgctcaaatatgtcaaatggattatggaagtcactgcctcctcccattccatccttaagagcatcctccccatattggtcatatatgtctctcttctcaggatcagtgagaacctcatacgcttgtgataattctttaaactgtaaaacacataaaaatgtaaaaacaaaatagagattctgaattcaaacaattgcatgtcacactggcacatcctcaccttttctggatcccctcccttgtcaggatggttttttatggcagccttccggtatgccttctttagctcatccttgcttgcagttttaggaactccaagaacctcatagtacttggtgttgttactcctcggtacacgcccaaacatgtttacagatcacaagataatctccctgtaaatctgtagaactaagggtcagtctgcagtggttgagtcggtgacatattgtgcattggagtctactcaaaataggggaattttactaatcctagtatgactttgtttccctgttacaactataattaaaatgcttatagtaacaatttttaatcaaacatcgaaataaactatggcttttgaacagccaccgaaatgccaaacagagagtaaaaaggccaaggatcactgtaattttaatatatatactccgtactcaacgatcagtaatatgctagtaatataaaatgtaatcagttctgttaaacaaactaaaatgggagctaattttacgcatttacaacaaatataaaaccaacaaaaaatcgtagaaggacgactccaccacatgcgcaagtgcctgaccacattgaacttttaacatatttggcacccaactcaaaaacatccggaaaatcgaaggaaaatctagtctcatccccaccgaactctgtgtttcgagcggagcagacaactaaggtaaaaaaaaaaatcccctaaggagagctgatcacgaatatttctccagccaccgcgaacccccacgaggtgtcctacacaaccctggaaaacttcgcctcccctccaaatcaggacaaggctccacctctcctccgaagaatccaaccaacaagatcggtagaacagccaagaaaacggcgcagaacaagcaaaaaatacactcggtttcccccctccagaaaaatcacggggggctcatacgcgatccaaccggtccttaggagagtctcggccatgaaagattggggcgtagtgaagcgatcgtacctgaatcggcggcagagagaacctctcggtggaggcgaggcggacggaggcgagcggtgtcaccaccgctcaagccacgcgaccgagagagggcttgctaagcttgtggtcgtgggcctttatccttgccggcttgccggttggtgtgctccccctgtgaggatgaggtaatctgggccgttggtggaagtgattgtgtggcttagattggttttctggtctttaggataaaccggtgcagatgaaaggcaaggatgtctgctgcctgcctgccttggtttcatgatcttccatttggtttgttaattaaaacatggtagtagaaaaaactggtaacgtctacatttgtcaatagtttttgcattctttatatcttttaggccaaaactgctcttcgccaatacaatttatagcaattttttaacaaaatatttttataaaaaataaaataagttcgacaatattccacgtgtaacttgttacatgtgaaatagcagtgatgatcgctaagtagttcactgaattagtgtcctataatctatagtagtacgtactgcataacaattagcaagcggtcacgcgccatcgttgttaacttggtagtacgacttatatatacaccttacattctgcatccacacttagaaacattgtcacattaatccgacacgttagaaggttcagtataagtaggctatgctgtaagctgtcacaggcacaaagatatccaaattggcaaccagaaaagaatcacgcaaactgcgtcactctccatcgagcaaaccaacccgcaaagttcacaacacgtcgtcgcgcgacggcgatggcgatggcgatggcggcggcggcggcggcggcggcggtgggggctgatcaacagcgtcgtcgaacatgttcggcgggaggtcgtcaaaggccccgtgcttgacggcgtcatgcgcgcactccatgccaaagaacggcatgatcatcggaaccgactgcaccatcggaagcagctcctggtaggcgaggccatccatggcgccggcgtccacgaacccgtggccgacgtcgacgtatctctccggccatccagggaagttgatcagagggtacggaggctggtcgaacagcagcggtggtggcgccgactgagctgcattggacgagctcgcctcgccgtcggcgggtggtagtagctgcagcggcagtggcccctcgaaagcgaagaacccggagcatgcctgatcatatcccatgaacggtgcagcctcgcggcattgccagccgagggagttgccctccaatgaagcttgatccagggaggccgagctctggtggaactgcaagaaattaagtacagtgtcatcagtgcaagtttccatcaagaaactcaaattcacagtggagcgagcgcagtaaattcgtaacgttgatgatgattcatcagcggttcagtgaaaggcatgcattaccgtggctgtttgggagtcgagagaagatgacgagggcgctttgcccttgccgctgttgtgcttgttgggccgtgcagcagggagaggcccgcggaggagcctggcgagccgcttctgccgagtgctccagaaattcttcacgtcgttgtccgtcctgccctgcaagtaggtcgcgatcctcgcccacttgttcccgaactgcgcctgcaactcgatcaccaccctctcttcctcggcagtaaacttgcaaccgctttttaaaggagggaaaaagaactcgaaaaggtgggttatacatgaacatttccatcgactagtttgatcaaagataagcagataggaacattacagagacacaattcagtgcaagtgcgatcaaagattgcacagaccgcagatatagagtttactaacacattatcatggagtagtgggtttacaagcaaaaattcatctggccagttcaatttaagcatgtaaggacgaaacatttacttcctatacttaatttgtttcgaaacccacacaaatatccagagtagtgaagcagtaacaaagaaaattaaacacgagtcgcatggctggacgctaggttagaggaagcaaacacttctaaagttttaacagaactaatgttactctctatccgtaaaaccagtggtgccattgccggtgagaagtgagaacaaccaggaacactgcaattgccgtgccgctctaacttgcaaatgcacgaagaacttgaccagaaaaaaaaatcaaggaggcgagagaactgatcgaaccggggaagggagaagatcgaaaaaagagagggggggattcgcgcttacctcttgaggtttggcctgagcttgttcacccagcggaggcggcaggacttgccggtgcgcggcaagaggcctttggatcgaatggagctccagtccatggggccgtgggtgcggacgtgctccagcagaacctcgtcctcctccgccatccacgggcccttccgcagcgcctcgcctccgcctccggcgccgccgccgcccgcgcccctcctcccgctccttcggcgaacgccaccaggtgctctcgccattgccctcacaaccgccgccccacgcgcgctcgcgaacgcaaaagcccagccacaggggagggagggagggagggagtggtgggagggagtggtgttcttatgcgagagcggggacgacgacgacaatgcttcgtgcttcaactctcagtgtggggttcctgcaaccggcgtagtggcgcgactgagagccgtcgtggagggatcggacggtcgggtttgattcgcggcggcacgactaaccgcctcgccaccaccagcccccacgaacgccgggtccggttccaccgagaattctagcgcgtacgctccgggagtccaggcagcgcgcgtttctgggctataccctcgcgcgcggctcgaacgtgctttcttttttttttctttttttttaggtgaaactgccgcacgcgcgcggggaaaaaattgtgattaagtaatttgtttccaaagaacatgacctactaagataaccttcctttttttttcacaaaacacaatttcctgtttttctaaaagtttgaagatatattttataaattggatcttttgcctccaatttcaattgaaagttttttaaattgaagctgaatgttttcaaattttgagacaaaagtattcaaatttgaataatttgaattttgaggtgacagtttttaatttgagttgaaagttttcaaacccgagttaagttttcaaatctcggcttgaaattttttaattttgagttgaaagtttcaaatcttcaattgaatttttttaatccgagctgaaagtttttaaatctaagttgaaaagtttttaaatctgagttaaaatttttcaatctttacttgaaaattttcaaatctaagttaaaagttttcaaatataaatttatactttcaaatctgtacttgaaagttttcgaatctaagtttaaaaaaattcaaaccttagtttaaaacagaaaaaaagaaaaaaaaacgtgcatagagaacttttttgccggaaaaaaggaaatatgcacgggagttttttttgtcatgtggaacgagaaacgcgtaacagaagattgaacccatagctgccttgcacctcgtgcgcgagacttggtgaaatggcttatacgcgccaattagtcatccccaagatccacggccctgtccgctggacgcggttttttttttgcacctagctaggccgcgtgccatctatcgttttcacgctttgtgttgtatttctatcgttttcgcacctccgtaagtatggttgttatagacgctggacataatcccttctcggctgctcgatacccctcctccaccgtcccgaccacacaatctgcaccttgtccacacaagcattcaccgctgcgcgcccggcggtgatggcgtcaacgtcgcacgcggagtggaccgcggcaggtcatccccgtgcagtcggccaagagtgtacggtagcacccgcggatggaatggggatgtccaatgatatagccgcgccgccccgtccgacaggctctttgtcctacacagatctcattcttagttgatgctcgggggtgggacctcctgacgaggccggcatgtgagtaccctcgacgccccacaacccctcgctgcggatcttgacctcactcttatttaaaatggcaagtattatcagcccaaagggagtacttgtgcacgcatcacaaagcaatcctaagtctagtagcttgggtgatgcggcactgaggtgtagaaaagactttcccctatggactcaaatagagggcccacatataagtggcgttccactatccgcttggaaaaagggcccacatatcagtgacttccctctgtccgctcgccaattcggatccgtgccttcgtgcggtgggtctaccccacgaatgttcaccaggagggaatctcacgaaccgatatagcattccatcattcttcagacctaattatacgtctataattatgcctttagtaattgttagcactgattttcagttaaagaaaatccacgtatactttatgctttttatgttacgaggtttgtttggatattggattctattcatttccaaaaatatgcgtagttgataaacaattttttatttatatagaaatttataaactaaacgtttagttgcatatatataaattctaatctataaagtttatatgtagaaaattttttatattaaatattttcgtggaaactttttagatatagactttatgtatataaattatttacatttagactttttatatagaaagtttatatatataaagtctatatgtagaaagtttatatacacaaaatctatgtgtagaaagtttccacataaataatttatataaaaagtttcctttaataaaactatagaaaagactaacgaagaaaaggaaattaataaaaattggaaaagaaagaaaaaagcttcatgcgtaccatgagaatcacgttaaaaaagggaaaaaaagttagtgaagaacggacacgtttgttacgtatccatatctaataaaaaaatacataaggtttcctcatattttttcgtccatcatcctgatcccgttactaaaatatattttaatccgcttaatagtccgatcagacattttccaatctagtaaaaaatcgcagctgatatagaatatgtgttctttcatgtaacctccaagcaaaagtaacagcttgcccacatggttaggaaaggaaatctgccaccagggttcaattcccaccgtcccctcctttacgcctattattatttgcacgctgtatggttaaaaaatcaaaaaagttttgccacgctgtatggttaaaaaataaactattattatttgcacgctctatgagcctctcctaggccagattaccatatcaaaaatttttgtacttattattactcagaataagtctactttacgtcccacatctcaaatcctattttcgcgtaattttttttctctccgccactagcacggaccatgcacatccgatggttaaaaaatcaaaaaagttttgcctctcctaagccagattacccactcggaataagtctactttgcgtcccacatctcaaatcctatttccgcgcaatctttttctctccgccactagcacagaccatgcacatcccatggttaaaaaatcaaaaaagttttgcctctcctaggccagattaccctatcaaaaaacttttgtacttattattactcggaataagtctactttgtgtcccatgtctcaaatcctatttgcgcgtatttttttctctccgccactcgcacggaccatatatatccgatggttaaaaaaacaaaaaagttttgcacctctttcttcaacatatatttattttttctctccgccactagcacagaccatacacatccgatggttaaaaatcaaaaaagttttacacctctttcttcaacagatattaagtgccactagcacggaccatgcacatccgatggttaaaaaatcaaaagttttacacctctttcttcaactgatttttagtgattctgaaatcttgtaatgaaccagtttttaattcgaaaattaaacataattaatgaaccagtttttaattcaaaaattaaacataattattattttcttttcgtcatctgcaaaagacgatatattagagttcgcaccatctatcgttcacgcatgagccgtgaaacgatctgtctccacgcgagtccgtgttcgattttagaaattatatcagacgcttgccatgcaaaagttgagagcgtgtgttatgacaatataaatatatcaatatgcaatagttgtttcttatcagtcctgattatcattaacaatgcattaaacaatttatctatgttggaatattataacatatatgttaactgtgtatttatagcatttaactttcattatacccgtagcgaagcacgaagcacgggcattttgctagtacaagaagaatcacgtaaaaataaaaaacagataattagaaaggaaataacggataccgaatcgcgtaaaagaaaagaaaaagggataataagaaagaaaataacggatatctccggttctccgtcgcgcgcgccctctaatccgagccattcgcgggatcactagtggagtagtgggcgaatttcctgtcgtgcacaagggaggggaggcgctctctccttgaaaccgtcgtttcgctcgctgccgctgccaccgtcagatcagtaatgctccaaaagtccaaagacaaggagtattcaaatttttgacaggcaagttcacaagagcaaacaaagctttcgctgtgagcatttgcaacgaagtatcgaggcgattattgcttttttcttttccaattccagttcaaacagacgaacatttcacatttgggccttagacgatgtgaagcaaaaaactgaggatttctagagcacatacaatgcctgggatctatcgatacaattgaacacgcactagcgttgtgctggtcatgggtctcctcctccctccactcggcgtcgtggaggagctcccatccacctccggatgctcgcgcccacgcccttcatctcgtccacctgcgtttacgcggagtcacggaacacattagtgcaaaaccagtagtcacatggtgcgatctgtgagattttttttttttttggaggattcgtcttaccgatccgacgcccgccgcgagaactccggcggtgacggcggtggcgccggcgccgacgaagagggtggcgatggcgaacgccttgaacggcatcgcgaacgccgcgccgcccctgccccgccggaaccacgccacgcccgccgccacctgcgccgcgctcgcccccgcccaccacggccacctctccgcctcctccccgccgccgccttcctccatctccgccgccgctagggtatttggggggggagcgcctcggagccagagcgagtgaaacaacaacctaaacaaccacgaaacctcaccgacatgtgggacccatgtggaagaggaggaccaagccaggccactgacatgtgggtgagctcgaagggactcacgccaccgtagaacaaccaaaccccgccgcgaaatcgcagctttccatgggaaggtcacggaggagctacgcgcggcttcttctcctagggttcctactgctacggttcagctggtgcttggtgagtgttgattcgatttaggttggttccgtgatgtttggattggggatgtgatggatttaatggggggtttggggggagggggggatttgactaggcggtggctgatgacggcggaggcgcggaggaagggggagggatttttccggtggtggtgagcacctggcctttccgggaggcggtcagggcggcctgggaggtggtgtcagccagtggcggcgcaggttgttcggccgtggatgccgtcgtcgccggctgctccgcctgcgaggtgctccgctgtgatggcacaggtcagttgtattcaacctggggtgtgggattgattgtagtagttcactgagtttaattgggaacagtggtgatgcaatgtgctcagtgctgatacactaatctggttggttgggtcaaaaactgcgataacaaacttcaagaagagtttcgtttccacttggaggaatttcacccctggcttccattagataagtgatgtttgacgagagtaataaaaaaaaacaattctgatgaacaactattttcaggcagcaggcagaatatgtgtagttttgattgaaacacgatataacatatttgcatcgcgcttaccgaactacaaaagcaccttttacaatctttttcctgtctttcatcatgaactcgtgaagatgacattatcagcagttcctattatgttgcacataattatttgcactgaaatataatacacagaaaatacattgtatttcttgtttcacttttgaataagaatatcgaattggggtttgcctcctctgtttctaataataatttctagtttgtcttactgtgcagtgctttaaacccaataatatagatcttgcaaaacctattttggttgaatcccttggaccttattcagttcaaaaacttgactactttcagttagcttcatgaagcaactatagtactggttttaaatggtttacatttcatgcagttggcccaggtggaagcccagatgagaatggtgaaactacattagatgctctcatcatggatggggtaacagcttttttacatactcatgccacagcccactgagcattctgcagtttctgttgcagcattcttggtgtataatgtgttgcatttgttttgcttaagaaaattggcagaccacaatggaaatcggagctgtcgctgccatgagatatgtaaaggatggaatcagagcggcaaagttggttatggaccatactgaacatactcttcttgttggagagaaggcaacatcctttgcgatttcaatgggacttgtggggccagctgatctgagctcaccggagtctatcggaaaatggacaatttggagacagaaccattgtcaacctaacttctggaaaaatgttgttcctgctggtagctgtggcccgtacaatgctattgatgtaccatcaggggagtctaaggcctctgccaaacgtgtgctagagcggactcagggggacatttgtcaaggattatttgaacctaataatttactggagccaatgaactcccgtctaaaaatcgttaatcgccacaaccatgatacaatctctatggctgtgattgacaaggtatataggcatatagcccatccaaaataaattgactttcttttcatcggaaactaacaacagtgactttgtcaagatgggtcgcatagcggctggcacatcgaccaatggtgctacattcaaaattccaggaaggtgagcatttttgcgcttttggtgttttcatgttaccatctatcatggagccttttatttttatttaaggttatatttttctcacgtttgagtggtttcatgtcactttaatttgtgtactctggcataatctattttcatcatctaattcaattttccatggttaatgacaagactcacaattccgaccgtgaaatatatttttcttagtatttttatgctgtatttgtatatgtaaagtcactggtgaatgttgttgttaatcttctgcatgtctgcataaaaaactaataaaatgctaatgtatggtcagaaatttcattgccttgttaatgatggggtttatatatgtgattaacaggtctactttttttttcgtgacatcttgactctcaaaatggatttgatagctagacatggtttttaatcattatggaattgctgtttcatctcttggtaggtatcactgagcattgtctgatcatttggttccagggtaggtgatggaccaataccaggatcttctgcatatgctgatgatgaagttggtgcatgtggagcaactggtgatggtgatattatgatgcgcttccttccgtggtaatggaaaaataaattagtatttttgacttttttcttagaaggataaaagtccattttactcctccagtatttcccgggagcacttaactccccaagggtatttctcttttttgtttctccctgtaaaagttgtatttcgcactggaatttagtactgtaggatgatgggagatgcatcacaacttacatctcaatattttttttttagatttttttatcattgcttacctaggttggaatgatccaatgaaatagtttgagggagtaaaatagactttttttccttacaagtttataagcacctctataagtttcttcctagcaagttttttttctttttaaatgtaagagagatacccaaccatcttttgttctctatattattatattgatatttgcatcctaggggatgatgatatcattgacattcaactataacaatattccccatccattctaaagattagcccttgcatcatgtagtctggcgttagtatttttattgataggctgagtttactgatggcctcatgctccatgtaatcttcttatatttgctatagttatcaggtagtagagagcatgcgacgagggatggagcctcgggatgctgccatggatgctatattaagaattgcccgcaagtacccggactttgttggtgctgtatttgcaattaacaagaaaggagtgcatgctggggcatgccacggatggacattccagtattctgtcaggaattctagcatgcaggatgtggaggtcatcactgtatcaccttaacatgggcagatcgtaacagcatatggtgcgtcaccaatatggcatttttcgaactggggataccccatttccattcaccagcaggtcatgtttctcatgatctagaattttcatcattcagtcccctgtcaatgcagcaatgttatttggggattgtactggcttattattggattgcactcctcctggaagttcagacggccttgtaagcagattggatgcactcaattcattcttaataacctcgtctgagtgttgtctaaaagatagtaatagaactacatgtgatcaactttttttgcaattatctgttcagtaatacctagctaggttcactcctctaaaaaagctaggttcactcgagcatcttcaaagttgggaagcccatctatccgttttgcaggcatgtggctttcaagattctcaatagcttgccacctccttttttgcttttgctttggtctgtttctctcgttttttagaactcatgacttttatttagttcaaacagttagaaacaaagtacattagttatgattgcctcttccagagagagagaggttttgcaaagcaaatatgttagggcatctcggtggtaacaaacatgagtgttgttatgacaagtatatttttatttttttagccctcagatcatatcttgttgcactagcttatcagctactatttcatttgccttcatcggaatccacctgacctgtaaatgttaaccatgtaaaagatgaagaaatttggacagcatgtattctcttttcatcatataagttgtcttcgtactcagaatatcaaatattagtgactgaagaagggagagaattgtgaaatcacacgcttacaatattctatggctagttggatagattacgtaatctgtgtatcttattagcaataatcatcatatatttcttgcatttttaaagcctattataaggggataattgcaaagcttccgtattgtcgccgattaagaaagccagttgggtatcttggtgaaggtcgtgctctcatgtcctcgttgggatgttttgcccttgttttccgcttgagaaaaactagcggcctgctggtggaatgacacttatccagttatcagctatatcgaccgctgtccagtactgacctactaaattttctccttttccttttggaaaattgacttaaatctatttagcggtacctgcctgtacaatggcccctgaattctcgaaggggtacttgtgcgctgcagtgctggagattcgaaagcaagccaaaactgtcaattttcttcctaatacaaaaattatgatcacctatttattatggttagaagaagcttaaggaaaaagaagtcgttatctttatctagaaattgctcccaccgtgctgaatacaagagatactagatttacactctctttgtcaaaaaatataagagattctagatttatcctaagtcaactattgtaagtttgaaaacaataacaacatatttcaaagtgaatctaatctaatgaggctcatttaatacttaaaacaatcatatgatctcttatattttgggatatttttggatggaaggagtaccatattcaattgtagaatgtccagatcaagatgttcatgattgatcaacacaattgtataattgtatacaagctgcaattgtatttataggaatatacgtaatgctgttcactaaaatcaacttttgttcttttttatattttaaaaaaaacctactcctgataaggattgtccaaattgtcgacaaggagagctcccatccaagttaacgttggacaggaattgccatggaaaattagtaaatgcaaaaaaaaaatcataaactcaactagtatccaataataacgagaaaaatacgcaagcaactctacaactcgtttttcttcaggaaaaactgggatgtaaataataacgagtaaattaataccgagtatccaataaactcaactagtatccaataataacgagtaaattaataactgggatgtttttctacaggaaaagttgatatatacgcaagcaactctacaactcgttgcaacgcaagcagcaacacttgaactaattacaagaaagggcgccgtgtggaggaggggcagaggacggaggagcttgagatggaaccttaatccgtcggaagaaaaggggattcgtgaagcagataggcaccaccatgctggtactcgagctgggg

SEQ ID NO: 74761 - DNA, 97591 bp, Oryza sativa
tgcgagatgaatttattaagactaattaatccatcattagcaaatgtttactgtagcaccacattgttaaattatggcgtaattaggcttaaaagattcgtcttgtattttacacctttttttatatttaatactccatgtgtccaaacattcaatgtggcaggatgaaaagtttttatgtgggaactaaacaggcctatactagtcagtactcagcaagctagctatgagtagtagtcgctactacagattcagacatccacaatccttcacgagtaactcatctttaaaggattgagaaatagccgattaaaatatggctacggagaatgctaagtttccttcaacaaatagtttccttttataaattgctatgagtcgatgtcgccattatctttctctcttttccatgtaagcaaacttaccctcttaacaactctaagaaatctctatttttttagtagtagctatatttatggcgctatattttttaccaaaaaatagtcaccatatatttacattgtaaattcatataaattacatatgtaattttagcttattaacaatgtaggtcctaaaattacatatgtattttagtgtattaaaaatgtaagtcctaaaattacatatgtaaatcatatggaagtgatgggtaagttagacaaaatgagttagttgctcgcatggtaagcgtcttggtttgtaatgctcagggcatgagtataattctgctcgtctcttggatctctgattctttttgttttatgtattgcacgaatcttaacatataccgtatggattatgaatcgacatattctttccacaaaatatggagccatttttttagcagctccgttttttttatcattgtgcatatcctctaatacggtttttttttaagaactagggcacaaagcccccctttccattaatggaacggcataattgtcttacagattctaaactagaaacagaaagcccagaaagagggttcccacaaaaagaccagcaaaacaactggttgagggagaatatcctctaatacggttagaataatatatatgatcaagctaatattcggaattgtcttttttcctcttcttaatcccatcggccataagtggttagatctatattcttcttccctcatcttgctctccaactctattcttaacccatacccagtaatataggccggtatagtccttccctcatctttattttcaatcctattcttatcaacccatacccaattatataggcaagtatagtccatcctaatcatatagacccgttgcaattaatgtgtgggcatgttactggtgtatagaaagataaagatatactgtagaaatgaaaattgttttaattaaggtcttctgacctatagggtggtaagagcaaacaattgaattttcatttgtttcaccaataaaaaatcggaattgctaaatatttgttgacagatttttgatggctaaatctttcactttctaaaccgttggatgtgtcctagattcatgttaacagtttaatacgcatcaagatatgtgcttttaggaagaaaaacaaaatcatatttagggatcgatcctgtaacctcataggatgaagacgtgactgccccattgggctactatatttttatgatccagtttgaacttatatcttacttatactataattacatgcgagttacatgcaagttatatatgtaattatagtgcaaatatagtgtaattatgaaaattacatacgtaattatagtataaatatagtttaattatgaaaattacattgtaattatgttacagttacatttgacagatttttagactaatttttagtcgaatgttgtatagatagtcccataaaaaatattattttttaatttcggatcaataaatcgatcacagcaaaaaggaaatcaccaaggtccataattaccctatctaaatttaagcatatgcatccatacaagaaattaatgctccggtacggttaaagatgcaaactttataccggccatttgaactgctcgtgaattcgaatatttttgtttggttatatcataaatactacaagacgggcaaccatctggacgggataactaaagaggaattttataggacttgaaaaaaaattttggtaccttgaggtaccaaattttatattagaaaatgtggtacctctaaatataattctcaagaatagtaaaattaccctaattaaaaatatctagcgctctacagatttactctattctctctacctctctctctctgactaccatccccatgagcacggaggtaacaatgatggctggccgtgtgggtggttcatccggcgcagccattgccggtggtgtgttgggcgtggaaggagccaccgtcacaggcgccgctggtggtgatggtggaggtgtgggtggagtagaggaggagagtgtggagttgtttgtgtggcaggtgcccaagcacatgatggaacacagagctgcttgccattttctataggaggtggccatcgtcgataaggtcaccgtcatcaaggacaaggcttctcaaggtgcggatcctacatccagatctgggcttgtgaccctgtgctcttgcattgtttgttttggagtttgattatggggtgttctacatgttctatgggtgtttctacatccatagcaactttttcctggaattgattttttttagctctctcttgatgatcatatgatttgttgttcttattgcaatgatattttagttgtatcatgatactttggtacatataggtcttgaatctagtacctataggtatcaatctagtagcgaaatattatggctggtacatagaggtatatatcgtacttggtacctataaaataccagacctagtatacaggtatcatgttcgataccaataggtattacacatggtaccacagacgtatatagtgatggcatcattgacgtgttatctagaatatcagacatagtacttaggtatcatgttctgtactaataggtattacacatggtaccacggacgtatatagtgatggcatcattgacgtgttatctaggatatcagacatggtacttaggtatcatgttcggtactaataggtaccacatatgcatggtaccgaactgtacgtatatagtgacattaacattggtgttgatacgacattatcaagtatctagtccggacgggataccgttctgtagcagtccgttatttgaattcgctaccaataaaagttctacaaaaactagtagtacggaaagaaactgaaatgcatcaaaacgaatttgtactttaaaatatcaaattctgggtgttaaaataaaattaagtactgtccggtttcaaaatacctgaaagttgttataagcacttgaattctttatattctgaatgttcatgtcctaatatcaaattttctatgggattttatcataaaattaatttaaatttcttatatgtacaaatatgcgaagttcagaaattcttttgtatattgttaatcgaatttaaaaaatatagcaagtgatgttgttggattaattgcttgaatttttttacgatgagcatatgctaagcttgtttacaccgtctagttagtactacaggttaatccaatggatcgagtagtcttacctcatcggaggatatactccctccgtcccatgatacaagagattttaacgttttgcttatactgtttgttcacttgtcttattcaaaaattttgtgcaaatattaaaaacgaaaagttgtgtttaaaatactttagataataaagtaagtcataaaaataaataataattccaaattttctttgaataagacaactggtcaaacagtgtaagaaaaatgtcaaaatcctttatattagagtacggagggagtagtaagcaattaaaagagttaaattttgcgtacgcacgcacctccactgccttcttcaaggcaggtctgaaatcggtattgccgctggccttgagcttgtctaccaaattttccagcttcttccggctgtccgctgaatttcttgtcagcccgtactcgctgacgaccgcgtggttgaaggacacgatggccagccggtcggcgtcgcgaaccaacttgatgatgtacttcatggcgatcttgagaagatccagcctcgacgacatgtgctttccccggacaaactcctccttgttcatgctcccgctgacgtccagcaccgcgaccaggtctatgggggcgcgcttctccggcgccaccaccttgggcgcctccaccgtcaccagcacctcgaagtcgtccttccgttggtcccgtgcgatcgccgcccggatcggggtggtgctcactcgcacctcttgccggtcaatagccgccttcgacgttgcctgcactagctagctagctcatcattaatctgatcagcgttgggaagacgaaaagtagtgtactacagtattagatagctatatatgttatctagctgtgtactgtatttgccatcaattcgatgaacattcaaccagaatccactcttgatcgatttgaaagaattattacaattttttcccgaaattaagtttttttaataagtccccaatttaatttcgttgcaacctacagatactgcagatcagccaaccaatgtacatgtatagatatatagctccttacttgcagcaagcacaacacagagaataatggccaacaacaaattaaaaacaactaacaacaactaatttaatcaaagatatagaacagccatatagatcgatcagatcataacctccatcttcgtcttcccagcgctggacgatgccatggctcaggtcgatccagaataccgtacaatcttaatcactctccctagctagctctcaattggattagcgcgttgagtgcagatcgagagctggtatgatcagcttaagctaaatgagaatacggagttgtagacaggaacaaatagatatgtatatatgttgtgtgtttggagccgagcgaacgcccgtgaggccgtgatcatacgacaattactaaaaggcacatccttgataaacaatgacgcgaccctcatcagtcttaatcttatcaatggaaattaattaatattgtagactagctcgtgaccggcaatgcaaattaccaagcgcttaatgtggaaatgggataagggcagggttttcaatttcgaaattaaatattatacttgggggttaccgaaattttggaaattttgagccaaaattatttgaaaatttgactgtatttgaataaaatttgaccaaattcaaaaacattgcaaaaaaccaaaaattttgggcgagatttgagcatgctggtggggggctgaaatttcagaaatttcgaaccgaaatttcaaaccctatataatggcgaggcgcccatgttttcttccgcatcgggcacccgttgggaagtgttttgacattcgatcaggacaccagacatgagaagtgacacaaatgtgagaagaaatttagagggaaacatatactatgtacataagtttttcatgcacaccaactaacaaataacaaatgccactaaaaattttagaaaaaattggacatatactttaaatagtattgcatctatatgtgaaatctgatatttaaattcatttttagtcataacaaaagagacaaaattttgacatatttttactcttaaaactgccagattgttcacttttttattacattgttttgcgatagtgctgtaatatttcttggtccatcgtttctttagctgcaattctgcaaatgcaacgcaattgaagcatcatgaaccactcaaattaaacaacacgcacagagaaaacgcacatgcagtgttagggtaaacaatcagtttaaatgtttgaaaaattctgggtaggatagctttcgttgggttcaatgcttacctgcgtagcaggagaaggtggaggacatgatcagaagaagcatcaaaaccgccgcgatggagtaggacatcctcttggtagctgccattaggagattaatgaagaaacaggctccgatcgagctgttattgtacagtatacagtaagtatgtatatatatatatatatatatatgtatgtatatatatatatatatatatatatatgtatgtatatatatatgtatgtatatatatgtatgtatatatatgtgtatgtatatacatatatgtatacatatatatatatatatatatgtatatatatatatatatgtatatatatatatgtgcgcctgctctgtttcgcaatgcgctcattgttgtgcacctttgctcatgtttttagatgagttcttgcatttatgccttcagaaatctctagtgtacaattaattgcttttccatgtgtaaggctgtgtttagattcaaagtttggatccaaacttcagtcatttttcatcacatcaacctgtcatacacacacaatttttcaatcacattatctttaatttcaaccaaaatccaaactttgtgttaaactaaacacagcctaaggtttctttgctgtcatttcaaatgttccagcattaaatgccccttatatctttgtacagttaattgttgtcatttttgttttggatatacacgtatttatatatgacaatagatctcttcagatgtgcaaaattttgaacagaaaaaagtttaattgggccgacaagcgttggcttgtcctgttaggcctgcaagcattatgtatgcatgatcggttcatgactactcgcccatgaaaggagtatgcatgcttccccaatgtttcggtataaatagatcagtgaatataaggtaactatgctatgttaattaagaaatgtacgctctgactttaataattttatgcgagatatgtgacgtcttatatgtatatggcgagagattggagtgaaacaaattataggaactatacaatgctagcaaggtatcatgtataaacagttaatttgctaataggtaacttaggatagaaaatagtaacataagtatagaatctggcactcgtaattatattccaagttacaacaacctctaattcttcatgttgttttcagccagcacagtttcccaccaagcgactcgcatgagcttgttcaacttttgctaaatattataaaaatttattattcggggttatatgtgttctaataaattatatagcactttgcaaatttattcatagtaagtcatgtagtatatatactaacctaattttatgattcttaattataagatgtaagagggaatctttagtccaggcttaggctcttacaaacaaaaaaaatcatagagattaatccttcaaaatccaaatcctttgtttttactccaaaccgaataactccaaaagtttatcattgtttacatgtcctgcagctatagattaattacccaattttagagatgaatcatcaattgaagcttaaataatataacactatatatattctaaaacaaagcagtttcattaagaacaatccaacttaattcctttattaatttccctttaatatagcatttatatctgttcatgcatcactgcaaaatctaagaacaacctcagacattattttccattcaaaataaccgtatgaagtttcttgattatgttaactcttaattaaacctcagacattattttccattcaaaataaccgtatgaagtttcttatttacgttaactcttaattattccacccagctgtaccaatttaattgggccagagcagtatcacaaatatgtgggcggccaaatttagttgagctgagaaacgctggctgatcttgtcatgtctctatttctaatctatggattatttgggccgcaagggaatacggttgtcaaagcatgtttgcacgtgtaacgtcgcgcttttagccagacgttagaaactaattcggcaaaatcataatttcaaaaatttggttctttgtgtgcgagtctaagtcgtgccgtggatctcaattcaaatcccgttgttccctctcatcgccatcaaaatccccctcctcaaaatgtcaattctgattcaactcccaatgtcaaacaccgaaattcaatcccgtccttgaactccttgccaatatttctcttggttctgagaataccaaatccccgtttggaattccttcgtcaactcctccctctcatccaaatcccaaatcccgaagtccaaatatcaaatttgaaattcaaacctaaactccaatactctccaaattcaatctttgtcaaagtctatttcgcctcccttgtcaatgggctgttcctctctcccggcccatcccctcctctcggcccagctctctcctgcgcgtgcaccggacgtgctcggagcgagcgagagagcgccgtcttctctttcccctctgtctcgctcgttctctctcctctctcaccggcgccgatttcccgccaccgccatccgaacctccaccgccttcgtcactccggcaccaaatcccccgcccgtcgccattcaatttttggccgcgccagccgctccttgcacgcgcgccatgccgcctggtcgccgccgcgtcagccctgacgccgcccatgccctgttgccgcgtcgtcggttgtattcttgggctgttctgagctgcaacctaagttaaggtaaataagtcctctatttattttaaggattgcgatgaatcataattgtcaccgtgggtaccagcgctatgtcctgggactggtactgagatcatggtttcgtaggaagcggttcgcactgtttttcctacgacacgctcctgtcaggtaccgttgtacagcggtatcagattgggtgtgacagcacgatcacacaattttgtagcagaatgcatgatatgatgatctatacatgcttgattaaataaccggttcactcctaacacacaaatgggatgaagggaagaatgcatgcttctcccaaaatctcagtataaatacgttaaggaatgtagagtagctattgtatgtcacaattaccttatatgtaagattattaaataaggactaacccaagcagtcacgtgtgcggtcgggagtgagatattggggtagaacaaaattaaatggccatgtctatccttaattattgatttgatcatacttataacttagaacaaacataattgttgtgaaataatcaatatcttttagaaataattatccatacactcgcatgtattctattcctgatggatctatcacatttaacactagaaaatttatttaattctatagaagatatgatcaatgatgccatgtcagttaccatcttcatctggtcttatgtttgtgtaccacaattattaattatacttatttgtgttacaaagcacttaatttgaatatgaaatcaactacatgcacacattttacttgggctagaatggtgtcatgacacatatgtgggcgccaaaatttagttgggctgagaagcgctgacaggtcttgttacacttctagtagttctctaagtattgggctgcaagggatcggaacatcactgtaaatgcatgtatgcatgatcacacaattttgtagccgaatgcatgatcccatgatctaatcatgcatgcatgatcaccagcatcagtgacggcaacgcccatggatgtgcttgctgcctctgcaaattaagctctgctgcctcctaacatccaaatttagttgggccggaaaagtgataacacaagtgttgaaggctccctcttaacatcgaagcgttggttgattgatatgcagttctacacatgttaggctagaatgggattggttgcatcctgacctgatggccgatacactactcctaaagaagcagatcgttcttcttttgacctttatcgatagatattagcttagctagcatattatatctctccatataaatacgtaagtatataatcatagaaagctctacatgacaccaaaatagtgtaaattggttttaattaaacatgtgtctgccccgcaaaaaaaaattaaacatgtgtctgagtaatattgttttgaggtgaaatattagagtgaaacatattaggatacccatgtctgggttttgtagttggttattattggtatttgttacagttaccaataaatccaagtgtatgaataccgctgcaacactccacctaacagtatttcaaggatatcgaataatagatgtgtatatctacaaacatgattctaccatacaaatggtaggcttaaactagaggggattcctatgaattaattaactaagcttaaactaaataaaaatctatcaattggtgtccagttcatccctggtctaccaagagatctatgtaagtaaacgtggggatagaagggatgatggacatggttgtcacacctgctgtctatcatactttccgtggagagtcacgtagatattaatttaagtgcctacctcactataaatttggcgtctatgtggcaccttctgtctgccgtacttactttccgttgagagccacgtagctattaatttaactgcctacctcactataaatttggcgtctatgtgacattgttcatcgtgctatatgtctatgagagaatatgattagaaaaataaataaaagaactcaacagaacccacatgttatgattagcttaaataaaaataatattgtagaacctagtaggccagcggcagagggtaatcgatcacttgagcaccgccgtgggatgttgcttccccattatcgcaccactagcctactgaccgcatcgctgaaactgtcctctgtgccgagctcgagacggtaagagctcgagccttagccaacgcaggggaggacgcggcgacaatgatggggacgatggtggatgaccaccgttgtcatcgcacgagccgatgatggagcaggactagccacctctagggctaggctggccagcactaagctaaggtgccctccttgctctctcccgttgtgtcattgccagctggtcatgcatgtgccagaaggcatagcagctccgatccctcatcatcgccgatcactctggccaggtcaggcggtgatctcggtggagggtgcatcactcttgttctcgtattacctcttagcaaaagtgtactgaagcatctaggtgcataaggacgactgcccaaccatgcaattgatctagtagctcttgaattaaccggaacttacgtcgatgacacgttagcacaggttttctggtcacaaaggacaaaattaccattcaatctatcgggggagtttcgatagcggaaggagtctccctatctgattttagggttgagaaatgtgatttaaactggggctataggtgagaaaggtaaaatggacggtttcctttgcagaggcagcgatcaaatacaagcggcaaactcaatctctctcattttctttttcccaagagaacacggtccgcctcggtttccaaatttagttgggccggaatggtgcaatagtgaacgcttgcgggcgctgggccctaaaatcttacttgggccgacgttcagtgggacacagaggccgcatgaaagtccggctgatctggttgggccttgtagtcgtacggctcattatgagttgcattgggtcgaaacgagatttgcaaaccaattctccatttaattaacccttttttttgtgttctctccgaaggaagtaataaaagaggaagagaagaaaattttgatattcgttgcagttctgttcagagtaaatggaagagacaaaatcgatgcagatcctgaatgtgatttcagctatatcatccctgttttgcactgttttcttttcttattttgaatcttttctgaatacgcatgcaaatcaacctttgcgaccagctcgcgtgatacacaaacacacgattacaatgttaggaaacttgttctcaaggcgcaaaacttaccgtgacagaattgcatgatggagagatgctacttaatttgatgtctaaatcgaaacctcttacacaacaatcttgctctactagcttctcttacacaacaatcttgctctactagctagtgtattatatatagaacatgttggtgagagaattttatgtttgctatcagtatgtaatactcttgggagattcgaggaaaacaaaatatgcatctcgtactctaaacctcactattgcattgttctccacttatattattcatgtagtaacatctgatatgttatttaccacagcgaaattctcttttcaagtcagtgatgtaaaaacatctaatctgttagttgccacggcggaattctcttataaagttgactaggaaaaatacccgtgcgttgcaatgggtgttgactagaaaaaatggccgtgcgttgcaacgggtaaagacgtttcttcaatgatacaacatatatgagtagttgagcaataaattaaaacattagggccactatacattataattaaaactaaggataaacggccagtcggccatcatcaacgatgaagattaaatctaataaattaaagctgaattgaaaagagaaatcgtgaaaaaaataatgaggaaaaactaatccacttttgcaattaattggaggagaaaacacacggaaagacatattgatgtggcagcgggacatattgacgtggcagcggtgctaagatttggcccggtgacggcgggaggctcgcacacggatgggaaaataaacgaagcgtgattggaacaaatatcccaccaaaacaaggacaaaaaaaaatccaacccattctaaggaaacaaaaacaccatataccatgtctgcacaattaaattctcttggaacatctccccttgcctaagcaaagagggaaacatgagtttgactgatcttacattttcaaacaaacaacggtgataacctctttaatttcatcataaaccccgagataaggactgcatatgaatcacattttgtatgcatatgcaacatgtttttctccgaaaatgtcaatctataacaggagcatggcatcgtcccttcagttcagatcttcaaatattatctgaattcaatcctcgatctgataagtagtgtttgtatcccataagcaaagcctgcataataccgacaaatcaaaagatcaacacaagctagctatcttcttgcagcaatttcagacctgctgtagcaaccagcagcctgaccattgaccaacctgacaaacgaagggtatatgaactgaaatgcctgaatttcaagcaaaattcgtctttaatcccctcaaggaacctgatatatatgttctggtctttgcaatttttttttgtccttcacttcacatcatccatcaagtagcttgatgaatcatgagtcaaacacacttttagctagctagctagttgcttccagattacctatcatatccgttgattttttttgagcaggctggagaaatcctgattcaactctgccacagcacatagcacttaattactgcctgattgtccaatcaacctcatgtaaaaaacctagctttccacttgcaagaatatcagcagatactcatgtcatcgaggcgctaatcgtgcactgactgatgcgtcgcttcagaggaagaaaactgcaaagctcgtgcttgcctgcctgcatgtcaaggcgacacatcttaatatggaccttatcgttttatcacaattcacaatcctatcattttgacaatgggaaagttttctttttctgagggaatgtaccctcgcttttttattttatatactacgatttttttagaaaaaataacaacatttaaattaatatgtgacataccactcgataaacaagtacaaatttaactttacagattataacaaataataataaatataaatttgaatgcccatactaactctgggcctgttcggtggctgcagtcgctgcaacagtacacacgttgttcagatcgctatgatgcagcggcagtgctgcgttgcagccgcagccacgggctgccgaacacagcctctatttgttccttttattacaacccatcgaagttaaatttaatcttaatatgtttgtgcaattatatatctcatattaatttatcttaacatttgaaaaagttagtaacaactcttttgagtcgtcgtgaaaggcagcaacaacctaacagtgacgtacgtgcaaaaccacggtacagttatcagctatagcaacgaaagaaaccaaaacccctgcagctgaaaaggaccataatattttgcagaagattcgcaggtttctgtcaaactatttggtgttgaattgacacacagtacacgaagtcattatccaagcataccaccattgacttgaccacagattgagatgcatagcttagattttaatattatataacacaattattttttgaaactttgatcagaaatattttgttaaattatttagtaacgtgaagtaaaaaaatattatcacattgtcatgctaatttaaaacgtgtatgcttgtttgttttcttcaatatttttaagaaaaacgaatggtcaaacaaactataaaagttaactgtattatatatattaaaaaagtgtgtattggaaaatatggtagtaatatactccttttgtttgatgttgtgatgttggttagctcaaaattgaactaacagtgcgtattaaatgtttggaaatggaaggagtattaggttcggacaaaattaggttgtgctcagggacaagacggtcccaatcactgggaggaaatttaacagtgctccggctttgaaatgtgtgcatatatatgttggtcgatgacgtggcgtacgtgcaaagttgcttctctgccgaattaaccggcatgttaggcagccgttgtggcgccaccttggccggccatgttggtgccgtgctgctccgacaatatagttgcttatgtaaatttggttgcagatgtgtcaaattgcttgtgggatatgaaaacttataacccctaattaaactaccactagtaagtaagtgtgcacgtacaaagcacgtcatacttctcatcgtctgctttgttaacttattgtcatagcttatactcgtttcggtttcaaattaattattatcatattttagatttgtctgatcagatcattaattcttaggaatgtatgtataatttaacaacatatgatttatgtattattatgaaggtatttctttacgatgaagctaaaagtataaaattttgtaatattagaccatatgagtgcatagaaattaatggtcaaagattgaaatatttgattcagaacaaattaacctagaatgcaagtaatctgaattagatggagtactcaaattttgaaatttaattaatataaatttgattttagtttcctttttttcatcatattctattttttcgtaactgtagcttataagtcgagtacatataataaactgatgaaaaagaattcctcacgatagcttataagtcaacaacatattataattgaattgataaaaataattttagggtaccacaaaattatcaccgttgaggattttatatttacatattcttagctgttctaaagccaaacctgcgagtgaaaagaaaactttgaattaaattctaaaatgatggggacgtattgagggtggtcgactgaacttggatctcattaatttgcatgcattcctaattattggacagttatatgtccgaccaacattttactgatgtactaggcgtgctacaaagagttgtggctgatcatgtagttaattgatggcttaatatttggctttaatatgaaggagaaatggaacaataattcttcgtccgaaacatatatcaaatgaaatttgctgagcagagattaaatcaatacttacatggcatgttttactgcattattatcatacttcttccttttctaatttttatattagaagtcgtttgattttttttcttagtcaagctataagtttatagaaaaatatactaataattttaataaaaagtatattattaaaatattcaacattaacttaataaaactaatttggtgctgtaaatattattaaattttttaataaatttaatcaaatctaaaaatttgaataagaaaaaaaatcaaatgatttataatataaaacagagagtacttaattattcttttttacaggaaacacagcaggagatactcctaccgtgatgcattgcaaaagacagagagtgtttacgagagactgtagggtacttaattatgtccaacagccacctaccaacacgaggggggttaaatcactgacgcatacgcaacgtactgtttgcatttcttagagtataaacagtactgtttcaattagcaccgctgtttcttgaatcttacaggcactgtcactgtgtagtactccattatgaaaattaagaagtttggtgtcagttaacaaagcaagttcaacatttaattaatttcctgcgacgagccaaagcaaagtaagtacaaaagcaaactgagtacatttaattttttttcaccacacatatcggatgagccacaaattaaagcggataaactgcacctagggcaagcgtggagactgaaaacataattcttttctatctatacgaatagatcgaaaacatattcgctttgtaggtctaaaattactcagcatcagtcattcaattttttttctctgtggaccgtggagaaagctggagaaaaatatattgtaaaccgttagacagattttgatgaaaccaaattataacagtgtaaatcgataataatagttgtatacaaaatataattatgtatatatagaattagaattgtatattaaatttaaagttagttttaatatatgttgtaaatagacacatctaaatagacgtataacaagtccaatcttacaatctcacgcaaaattacgcagaaaaatcccctagttgtttttcattacaaacaattaagcaaatgaacttctttactgcttgatcttcttagatctgcaaggaaattaaaaattctactatcattagtcagctcgacttatcgtgagtgtttgtgattatatctgaaatgatatggttgcacctcgtcagcgatagattcatgcttgttgcatgtatgcagtctccatctctttcttgtggtactcatacatttttcttccaagcacgctaacaaactcctttggctgcatgctgcatctatctcaagttctcaacccaaaaatgccaactttggcacgcaaatcacgcacaaatcattggccaccaccgtgtataatgattatttagttatatggagtgtagaaacacccacataattccagatgacacgtggtatacaagttcaggttaagttattcagaggaaaaagttcaagcagtacctgctctgttgtttcacatgtaccaatcagagaccaaacctgctgcgatttctcacaattcggcagctgttgattgtgcctactgcctagatagaacttaacatcttaacggtattttgacctgtatgtgctggcctaatcaatagcattcatccatcaactgaagaacaaagaggccattcatggttcagagttcagactgaacctgcaggccaggtagctagtactaatgtacaagtgcttgtacatgtgagaagctggtataccgactgcttgcacatgtggcgacaatgtaaccgtcagattgaacaaaaattgaagccgatcacacctactgtagttctacagtccctttcttccctgccatgaatatacatgtactatggctactagctcatgctggacggttctcaatgagatcaagacatctagtgtgcgatctatgaccaaatatctaacatgctatcctgaataagaaagtaaactgtgcattatttatttcagagtttgttactaaaggagaaggacagccatgtaggcatgcatgccatgcatatggtccctgaaaattaagtactagtaataagtatggaactttcacctatctatctatctagctctttcatgcatgatcaggcaggaaatccaagtgttgtcttgtcctataaaagaagggaccattgatctacctctccacaattcaatccatttcttcctctaccatactatacctagcttgccaccaacaacagtacaccatgcccaagaagaagctgtcacataggctgttctctgccttggtatccctactccttcatgggaagcctatctctagatcatcatccaacaccaacaccacattgccacacccttccttgctgcacaagtcctcctcaagcttccctcccatggagaagctcgccgcgaaaaccctagtactcgacgtcgaaggcggtttgcttagatcatcctccttgttcccctacttcatgcttgtggcactagaggcaggagggttcttgaggggccttgtgctcctcctcctctacccattgctatgtgtcatgggaagtgacatggccttgaaggtcatggcaatggtgtccttctgcggtttacgggcaagccggtttcgggccgggcgagccgtgcttcccaagtggttccttgaggatgttggggaggaagggtttgatgtgatgaggagtgccatgaggagggtgtgtgtgacaaagatgcctaggatcatggttgaagggttcttgaaggagtacttggaggttgaggttgtttcaggtagggagatgaaggtgatttgggggttcttcactggcatcatggaggaggaagaaggtggtgatcaagaggaggtgttgcttgaggagaagaaaatgttggttgatgttgtgggcttctctacctccttggagttcctccaacatcatctctcacattgttgcaaggtataatatgtcataagtaattaattcaacatgtaaaatttgcatgtttgtgttaattcttatactttgttatatatatatatatatatatatatatatatatatatatatatatatatatatatatatatatatatatatatatatatatatatttgacttaacttgcatgtgagtttagatcacctagctaaggtagctagttttacatgtataaactcccctttttggtttgtgtgatttagctagttcaggtattagacatgcatgtaatacgcgtgattggattgaaacaacgtatataatatctgcatatttacacctgaaagtaaaattagatgtaatagttaattacgtgcacgacgtcttttcaacggccggtctcatgctgatcgtgcaatcattgatcatatatacatactttttttcctctttttatgtattctttttgtatctcatcatgtgagaccaacaaaagcataatatctgttactgttagacggccactcattaattttcccagaaagaatgtgacctttaccatcaagtcacaggttttaccccttttcccaaactccccagcactttcccgtgtcaattaaatttaagaatattttgatagtcctccaaaaaaatagagaatattttgatagaaatagagaattttcctcatgtgaagtagtactgtatagtgcatacacaacatttcgtcaaatctctaattaatctgaccatttaatcacacatgcaacagtttcgttcccacgttataaaatttgagatctgaattactgtgtatgcatttcatcttgtcaaatctgtaattaattcgaccatttaattatacaacagtttcgtgttcccacgttaattaaatttgatcagaacaatttgatacaactaatactactattttcaaaattaattcccctcatgtgcattgctgtatgcattccatcttgtcaaatctgtaattaaattgaccatttaatcacacaacagttccattccccacgttaattaaatttgagaacaatttgagatacaaccaataccactattttcaaattaatttccctcatgtgaattactgtatgcattccattccattccatttcattttatttccccaaccacttttgagatttgctagcagcatagtgtggtgccaccccctccctcttgtttgttggagtagttttttttttcgcagtagtccttttcttttcgcaattggttgttgcagtgattttttttttactctcttccagcatacgtatgtctagccgattgcgttgtgtatcaaaacctctatttcttactaatatattgacgtacaatccttttacgtattcgcaaaaaatctgtatttaatttgacaagttaattattaattactcactcacacaacacaggaggtgtacctggtgacacgtgaggagaaggcgaggtggtcggcgctgccgcgcgacaagtacccgaagccgatggtgttccacgacggccgcctcgcgttccggccagccgccggcgacacgctcgccatgttcacctggctccccttcggcgccgccctcgccgtcgcccgcctcgccgtcgcgctcgccgtgccgtacaggtactcgacgccgatcctggccgccacgggcttgtcgtggcgcctcaagggcgaggcccccacgccgctcgccggcgccggcgacggcgcgcgccggcgcgggcagctgttcgtgtgcaaccaccggacgctgatcgacccggtgtacgtgtcggtggcgctggaccgccccgtgcgcgccgtgtcgtacagcctgagccggctgtcggagctgatctcgccgatcgggcggacggtgcggctgacgcgggaccgcgacagcgacgggcgcgccatggcgcggctcctcgacggcggcgacctcgtcgtcgtctgccccgaggggacgacgtgccgggagccgtgcctgctccggttcagcccgctgttcgcggagctgagcgacgacgtggtccccgtcgggatcgccgtcgacacggcgatgttctacgcgacgacggccggcgggctcaagtgcctggacccgctctactacatcgccaacccgaggacgtgctacgccgtgcagttcctggagagggtggacacgtcgccggcgagggagcggagggcgccgtccaccgacgtggccaacctcgtgcagaggaggatgggcgacgcgctcggctaccgctgcaccatgctcaccaggaaggacaagtacctcatgctcgccggcaacgatggcgtcgtcaacaccacccaagacaaccactctgctccggggaagaagaagatgcaataattatgaattagattagccaaaaaagttctcaaaaaagttctagatagatttcggttgttcttttatctttttaattatttttttatgttgctgggtagtttaatttggtgtgtgtttatactgtatttcattcttgcttcagtttggctggtgtgttcatcaggttgatttcttctgtgtgttttaatcaaattaatgattgtatagaaacaacaagaagctggcaccatcaaggagcttgtagagaaagtactactacgtgtgtgaattaattagtgcatttaatttgttaggtatgctcgaccattgttgcaatttgcttgttttaaaaaaaatctatgtatattttcttagggcatattcaaagatagagtctgatatagtcttttagtttatttgtagactatgattttataaccattgagataacaaaggctataataattagtgaactaagataagtttttattatctttcttttctcttccccaagcaaagtttctttttataaatgctaagaattgatgttaagtcattgttaagcttagagcaagtttaatagtatagccagctactagctccaaatcatctatagtcaatttaatagttaattcatacaatagttacctatgaatatatatactatattattaatacctggtcccacctgtcatacaaacattgccatcttgaagttagtgctacagctggctataaatctgtagtctgctgctcacctctctcctcatttatctcctcgaaatatgtttatagttttggcttatagtccgctattgtacctactcttagtatgtttctctctctctccttcctcctcttttttctactacctatgttctaaaataagtttatttttttatccattacacacatatcaatacaaaagaaaaggactagaatacacctactttatcaaatcctaatgtaaccattcatcattttatccacctctaaatacaattattttctacatttacaaattccgatgcattgattactctaaaaataaacttaatgtgggacagagtaagtatatcagcaaacttaccttgttacctactcaaagaacctgctattaattattgtacatactctgacatcctattaaatgaaagtgaatatgggaatcatagacttgctgtctctctgaagaaaatcccaaaaggagaaaatggagcatcttggacttgtagtaccacaaattttgggtaaacatataatggaaagtgatctaggagtaccatttatcaactatttattgttcattatgaagactggcatatcctagctgaaagataaaatttttggaagtttgaacattactcctgtctgttggaagaaatatgcaatctatcatgggtccattccatgaagatgacataatagagaagcaacaatgcaatccacatgccactatctcatttaataaaacatttatactagaatatgtaaaccagcacaaaacataataaactgtcgctcttaattttgaaaggatcataatcttctgtactgtctaaattgaagacatgaaaatgccattatgtattttattcaagtatttaaaatggccatcatgaacttaaaaaggaatcagaaaaggctttcatgatcttctatacggtctaaattaaagacatgaaaagaccattatgtattttattcaagtattttaaatagccaggatgaacattaaaaggaatcagaaaagctgaaaaggcttcaggcaagtgaaaaagtgtctaaattaaagacatgaaaagaccattatgtattttattcaagtatttaaaatggacaggatgaactttaaaaggaatcagaaaaggtttcaggcaagtgaaaaaggaagaaccatgcaaataattgcgtttgccgggagtcgaacccgggtctattgcttggaaggcaattatgctaaccgttggactacaaacgctatttgtcagttattaatcaaatttattaatgttcaaagctaagcacaacgtgtgacactactaatcattgtcaggcaattatctatggtgcctaacaaaaagacggtggaagcgattaatggatcataacttcataaggatcgttgcacaatcattttctagcataaaactaattaatcaagaacctctcactgtcatgacattcatgcatagattgacgcctatctcagagggaaaggaagtaaatgtatcacactctatctcaagcaaacaacgaccccaatgaaaacagcggccatcgacccatgcattcgacgtcgatcgtcgacctgcaatgcacactgatctgctttgcttggttgcgttcatgtcggctcagagttcatcagcctacgatgcttgagcttcctgatcatggtggactctgcctgcccctgctaattccggtgaccacgtagtacaacgaacaggagtctacttgacttgtagtagtagtgctgtgcattcaaagttcagtagttgaggtgagcatttcagcaccagccatcacatctccattagcccatacgctgcaaagcaatctatcatcatgggccatgaatctataatcatggaccatgatctatgaacaaagtggtagttacgtactagtagtactgtattaatgcaccgccgagttgtacgcacttacgaggggagagaacaaaaatgtgatgtcatgtttaattcgtctacatcttggtcgccgtctgatctcctcatgatctgaaaaaaaaagctggtgatcaggattggatcacatgctacctaccaacagaataaaggttcagcacaggaacggacccccacaagagaggccctgatcgaattctgaaccaggggaacagttatgttcagtaccatgttattactgttgcagcacgagctccttcgatccccaaatgtacttatgtactatacatgtgtgctcagcttgcgtgcccacactgaactggtagaatcagatctccaaaacttgtagtctagtgtaatggacagaccaaatctgagtagcaaacctttgatgaaaccagttgtttcttgctcgtactgtctcctttcggtgattgaactgccaggaccaccacggcgctcgtccaggataattgaactgccgcgcttctgctgcgaccctgcatgaaaaagcaaaatgttttgtactgaatcagtaattacggtgagttgtaccgtggaaactttaactgcagacttaacactaattaagttcagatttttagtttcagatatccataacatagccaggaagagcatccacaagatcagctctttggtgtagtagtaacagatttaatcatttttctaggaacacatggaagactttgcatataattgcattaattttctcaaggagagaataggaggaaaaaaacatggagaagtcataaaaacaatcgagttctttgttcaagccacccgtcagattgccaagggatcatgatagcctggaggatttgaatttcatatcccaagtgccagacgcaaatgtagaagagagcagaaattaaacaagatgtgtgggatgcaaggaacaaggctagctaagacacaatgatttaatcatggacaacaagcattctgttgaattccctgggcaactgctcccaggacagactcaattaagttgcaaggaaatgtagttgagatctggataggaatggcatggttcatgtcaattattgatcagttccttcattttagtgtatccgtggagtagtatgcaagttgcagccgcagcaagccatcaacagtagatgagaataaggtggttcgaactgtgacattcttgtgaggacaaatttcaaaatcaggccacacagtttctcaagcaatttgattgcacgcattaatttaggtgtccatgtcctcttattcactgtatgtaaatcccatcaagcatatatacggcggattcgaccaacagtacaactatactgcagatacagcctgccaatactgcagacacagcctgctacagaatcactgtccatgccactgtatagataggatgacttccaacaacccaacaactaaatgaagacatatgtgaatgtgagctctaaaaaaattgaattagttgtgttaagatgtttacttgattatattaacaactgatggtcattacataagcaacaaaaggtggctgagacatacttacagagatcaccaaagagatgattatactatatatcagagctgtcactcatccagtggtttcatccagttgcgtctcacctcagagctagggtccgaaatcaaattagcataatcttgatctatgtgtcagttaacacttccccaggatataatttttgtaaatcctaaaaggattcgtgcagccaagtaccatcgaaggttccaaacaagcatcaatgctactagaggtgttaactgctgatccttgctgcagacgaaaaaaaaagaacagattagtctcagaaatactttttgaggctgtagagaattgagagacaccaaccacaacatgaaaagaagaccagtatgataccatgaatcagtgtgacaacattgtccaaaagcaaaagatgtggtcaacattatcccattgttgtcattgcaccgactctactatgaaatctgacaaagacaccaattgtggaaaagaaccatgcaatcagctgatcaatttctcccatctgacactacttgtcaatgcaccaagtatggaacataaaaatcaatgtactggaaagtggaaacagaactaaaggcactcacatatgcgcagtaatgacaatcactgttcccatgcaaagggagataggagttaatttctcatctttatcattttttgttctgtgtcctttggggtgtggaaggatcttctgtaggcatgctcaaacttaaacattgaaccaatagcccatttgtggacgactatctcaccaaaaatctgaacaagaacatgatcctactttgaagtggtgaaacctatatgggtctctcaacacaatttccctattaaaaaccatgctaaccagcttaaataccagatgacagtctgaacagactctgagattcttgaatattcttactgtagatccttctgggacaacgataaggccatatgccaacgcaagtttctcactatggttccaaaggttctgctccttctgctcttcatctgtatcatgcagtgcagatgatgtgtcagcaatataacctacttccctgagtttcagcaacatttcatctaactttgcgtagatcttctctgcatgcttatgaccccggtcaccaataccaaaggtgcttacttcattcttaagcttaagccaactgcaagctggtcttttgtttatattgatggttttcatgtgacttcgtaatttgtcaacatccgcccatcttgcatttgtagcatataagtttgacagaagaacataagctgaatcatcgaatggatccaattcaagaagctttttggcggttttcctcccaatttcaagatttttgtgggttctactagaggacaacaaactccgccatatcagatcatttggtaagactggcatttcttcaataaatttctctgcctctgcaaaccgacctaagcgtccgagaagatccactatgcatacacaatgttttattccaggggaaacaccaaaggaagaagccatagagttatagtaatctatacccttgtctactagaccagcatgactacaagctgagagtagagcaacaaacgttacatagtctggctttctacccgttgcaaccatttgcttaaatgtttcctcagcttccttgaaatacccatattttgcataaccagatatcagcgtattccagcattgttgaggtcgaatggcttggtcaggaaccacttgcaacatttcatccatctttccacatttcccatacatatccattgcagcattaacaacgtatgagtctgaatccagcccagatttcataccaagaccatgtagctgcatgccttcttctaatgatgcgaggcttgcacaggatgacagacattcagctaggcaaacacgatcaagtttgtttccagcatgctgcatatcaatgaagagctttagagcttcctctccatggccaagttggacattcgctgctattatggcattccatgaaacaatgtttttgttggtgatactattgaatatattagtgcttgactctaaattgccacattttgcatacattgtgattagagagttagcaacatactcatctgacaaaaatccagtgcgtattatgtatgcatgtaagggccttccataattatgcagatcatttgaagatgcgaaagaaccatggatatttatcattgtaatgtaatttggctttatccctgcacttctcatccaagaaaatacttgcattgcctttgtaccatcctcaagtactgcgtagccaccaataagtacattgtagctgacaatatcatgagtcggcatggactgaaaaactttctcagcatcttccatagaattgcatttcccatacatcgtgatgagagaattaccaaccagtagatttctctgaagactcaactgcaatacgatggcatgaaccattttgccatctatcaaggctcctggacttgaacatgctcctagagcactggaaaatgtcaggtgatttgggctttcatttgtatgaaataactgacctagtgtcttcaacgcgtcggtgctattacagttctgcacataggatgaaatcatagtgttccatgatattaggtcccttctactcatgttccagaacagaaactcagcatcactcaattttccagcagcagagtacatattaaccagagcattaattactgttactgatgaatccagactgctcctgagacacagggaatgaattccacttccatggctgaaatgatctgaggaggcacagacagacatcaagctgcacagggttgttgcatcaggccttaatccatgatgacgcatatctgaaaacaccagaaaacatttgctgcagattccttgatgtgagtacatcgatatcatcgcgttccatgaaatagtatcatgttcctccattcgatcaaagagcttctcagcatcatgcacccttcccaagttgccaaacatggtaatcaacgaattcgccacagagacctggttttggagtccagagacaatgacctgggaagcaacctgaagcccaggcacctcattctcgagcgatccacacaagctgaccactgtcgcgaacgcatttgcattgcatgggaccccatccctcctcatctgacggtaagctctcaatgcctcttccaggtaaccattggatgacaatgccaccatcagtgctgtccacgacacgacattcctctcgggcatctcccagaacaacctctgcgcatcggacacgatcccacgggagccatacaagtgcaggagcgccgtgccgatgtagacgttgcccatgagcccggccctgtgggtgagcgcgtggatggcggcgccgcacgcgatgccctcgtcccggccccggcgctcgcacgcggtgacgaggctggcgagcgcgaacccgctgagcgggacgccacgctcccgcataccgcggagcatctcgaaggccgtcccgtcgcgtccgcagcggacgcagccggagacggcggtgtaccaggtggatggggtccggtcggccatttcgtcgaacaggtggagcgcggcggcggcggcggaggcatcccgttggcggaagtagaaggcgaggagggtgttgcggtggaaggcgctgagcgggagtgcgaggcggacggcgaggccgtggatggcgcgggcgaggagggggtggtcgccgaggcgggagaagccggcgcgcgggaactccgcgacggccgggtgcgggtggtcggcgaggagggcgagagtagatggagggcattgttgcgtggaggcggtagtggttacgcggcaggaggaggaagtggtggcgaggaggaggcgtggcggcggccggtggatgcgacggcggtggatggccggcggccgggtgcgccgaggaaggagagagagaaacagcatccagagcttcacggcggcgaatttgcggccttttggcccatcaaataagtagaatactgagtaggaatagcccaaaagaatttggatccataaaggcccatgaatatttggcccgaaagataaaaggaataagttcactttgaacctcaaaactaatcgaaatctaatggaaaaagtacaccgaaggtccctcaacttgtcatcgagttacaaaatggtcccctaaccgcaaaaccagataccgggtgtccctcaactaataaaatcgttagtttagatcctccggtggttttgctcccggttttatctgacgtggcggctgagtcagcgtgcaacccacgcgggtcccacatgtcagaatgtcaggttatctctcccctcttctcttccttcctcatctctttctctgacttctttcctctctacagggcggctggcgggtggggaggaggtccggcggccaccgccggcggcgacggcggcggcgcatgcgacctcggggtcggaccatttgacaggcccgggaggcggcggcggcgacacggaagaaggaaggcggcgacggctgcgacgcttgagatgggagaggcgcccggcggcgccggcgcgggaagaagttgtcttcggcgtcgtgcccgctccgcccgccaccgcctgctcggctcgccgctgccccgcgctcacacattcccaccgccgacgccgctgacggcgcgggcgcgagatctgcggccgtggacgacgatggcggcggcgtcctcgctctccccatcccgctccctgtcagtgccatcttcctctcccgcagcgcgcctgctcgccgcttgtctgctccgccagccggctgctccccgcacagtctgcggtggcgaaggtgaccgtgccagcatcgaggtcgtagccgaaaatcacccaggctatatatagctattagccaattctagagccaaacgagaattcagttgcaagaagtaattttcttatatcaccgctctctacaaattaaacgaaccccaccacaagaagctagcacatatgagctagcacgcaggatcgattggatgatgatgattatggaggtttctgggagagcgcggatacgatttcatgggcatccttctcgatatattgaacgagatccatggcaggccgctgtgaaaccatcttcttcatccgctccgtcattgatagcaggaatgtcttgacagatgattcaaggctctcaaactgcctgccgaccgatttcacaagcccatccaattcttccagatccttcacgagtgttttattccaagattaagttattgctgaacaaagaagaaaaagtaccattatattataaaggatgagatgaattccgaagcgccttcttcggcgatcgtcgactccatttgtgttttcagcccctcgtacgcacggttgtaatactctcctacctcctgtgcacaagaatttaattgatcatgcatgcatgacaatgtataataaagtactaattaattaactaactaacattcgcatggtttttgcagcaaccgtcccatatattgattcctggcgcgtagaggttggtaatgcgctaggcctcgagtttgattattctttcttgcctgcggtcagccggagtgggggggtgttgcttgcctggcggacgaccgtctggtctatctcagatgttcaccttgcggatttctctcttaccgcgttggttcggcacctttctgatgttgccccctggtggctctccatcatctatgggacacaggaggagcctgacaagcttcgtttcttagatgagcttcgttcactacgctcctctcgcacggggccgtgggccatcgtaggcgatttcaacctcattctcgaagctcgggataaaaacaaccttaatctcaatcgtcatatgatgggtcgttttcgtcggctcatcgacgagttggaactccaggagctgccgcttcacggacgttgcttcacttggagcaatgagcgcgagtcgcccacgcttgttaagctcgaccgcgtcctcttctctgcggattgggaggagcttttcccctcttgcctcctccaagcggcctcttctgtcgcctcagttcactgtgctcttctccttcatacctgcgtcacctccccaaaagcgcatcgttttcgttttaaggccttttggcccaagttcgacggcttttcttcaagtcgtgcaggacgcctggcatccccctgccaacctaccccctcttgctgctcttgcctggtgcttctctaccacggctaagcgcttacagagctggagtgaccgtcacattggcagtgttcgtctacagcttcagatggcgaaggaacttgtcttccggcctcatgttgcgcaggagagtcggtctctttcccccttggagacctggctgcggcgagatttaaagttgaagtgtcttggtcttgcctcacttgagcgtaccatcacgcgtcagcgttcgcgtttggtctagcttaaggagggtgacactaataccaagttctttcacctgcacgccagagctcgtaggcggaagaacttcatcacgcaccttcgtgatggtgaccagcttgccatctcccatgatgcgctgcaagagcttgcctcctctcacttttgcgccaccttggggacgagcgtcgagcgtgaactcgccctagacctccactctcttggcctctgccctgtgcagcttgaggggctggactgtcccttcacagaggatgaggtctgggcggtgattaagtccttgccctctaataaggcgcccggtcctgacagttttacaggctgtttctacaagacttgctgcccggtgatcaaggtcaaaattctggtggcccttaactccttgttcctgaccaacggccaaggtttcacttccctcaacgacgccctgatctccctcttgccgaagaaggacgaggctgttgacgttaaggatttcaggccgattagccttatccacagctttgggaagctgttctccaagatcttagcctcttgtctctcccctcgcctggacgagcttgtggcgcctaaccagagcgctttcatcaagggccgctctcttcatgacaacttccgctttgtccagcttgtggcaagggcgctccacgccaaacgcgttccccgacttcttctcaaggtggatattgcgaaggcctttgacacggtcagctggcctttcttgcttgaggtgctagcccagcttggcttcagtcaacgttggcgtgattggatctccctcattctcagtgcctcctcttcccgagtgctggttaatggggtgccaggtccacggttcccccatcggagaggtcttcgtcaaggagatcctctttcccccatgcttttcattctagtcatggatgtgctcaatgcattgctccgcaaagcctctgactcgggtggttttcttcccctcaattatcgtgctattcgacatcgtgcatccctctacgccgatgatctagttctcttcctttcccccgttcggcaggaccttgagttcatccaaggcatcctctctgtcttcggtgccgcttccgggcttcggaccaacttcaccaagtgctcgattactccgatccgctgatccgctgctcggttcttgacctggagctagttcaatcctcttttccttgctcgatctcggagtttccctacacctacctcggcattccactgtcagttcgcaagctgccaaaagcggccctgaaaccgcttgtggataaagtctcccatcggctcccccctggaagggccgtctcaccactctggcgggtcactcggttctagtccagttggttctctcttccattccggtctatgtttctgtggcgatcggcttgccaagctgggttatcaaagccattgacaagaagtgtcgcgccttcttgtggacgggtacggactcggccaatgggggacagtgccgggtgtcctggatgagggtttgccgtcctagggatctcggtggaccgggcattccggatctcaggatggctggctttgccttgagtgttcgctagctctggcttcagcgctcggggcatccctactggtctgatctgaaggcccctattaagcggagcgtctccgacatgtttgtagcatacaccttctctatcctgggagatggtcaatccaagctcttctggattgaccggtggatcgatggtcgctcgatagcttctatagctcctgacctcctccacgccgtgcctccacgcttccggggatcgcgcacggttgctactgggttagcgaactactcctgggttggtgacatacgtggcgccctcactgtcccggtcatctctcagttcctgttagtctgggacgcggtgcttcctacccagctctcgccgggtgttgaggatcacctcgtctggagttggacgggtgaccagtgctactcggtgtgatcggcgtatcgggcgttcttccttggccagcactcttttgcctgtgccgacctactctggcacgcgaagggctctgctaaatgcaagttcttcctttggtttgcatttcagcagcgctgctggactgccgatcttctccaaaagcgtggtatcgatagccactctgcttgccccttttgcactcaggagtttgagacggcgaaccacatcctcatcgattgcgtgttcgctcggcaggtctggctccgtgtgatgtcccctcctggctgggctgccctctctccccctcgtggcagctggctccaggattggtggtcatcctccagggcctgtttacctgagcacctccgcagcggcttcgactccttggtactcctagtctcctggcagctgtgcaaggaacgaaactccagggttttcgactctgcgctcgcttcggttgcagtcgttttggagtccatccactcggagggccagctgtggtctttagccgacattgctttttttggggatttcttggagtgtagcgtgcctctaccccctcccgctgtttggagttgtgtttttaaccgtcgtagtagtttctcgcttcaagttttctttttactttgttccccctctttaggcataagccagtctggctgattgctttgtgtaacaaaaactcttttcatgctaatatattgacgagcaattcttttgcgcgttcgctaaaaaatgcgctgtggctcgaactttcaccgcattgaggacactgctcagtatagtcactagctgattaatcaagcaacgcacaactaattaattagtggagtagtaattacctttgcttgtccagtgccgcgttgaagaacagcatgtagcagccacttctccaggcacgatctgccgtaaacatgtccacagggaatgcaactgaaagaggaaatgcatgcaattaacatatataaattaaggaggactactatagtactatatatataattgattagttatcaaattagtactaattaacaatcgatcgagtagctcatcaattgagacgtgtcatgcatgcaggaacgtatagtaccagatgcgatggtcgccgttgcaggtccagggttgcagacaaatgctgcaggtcggcgccggcgcctcctcctcctgctgcttatcaacttcttcgaccagctgcgtcgtagcttggccgctgagtcgccgccgcttgtgaccacgaccatgtccctctagctccatcgtcgtcgctactgatgccgtctcattatccttctgctccgccgccggcatcgacgaccatggccaagaaacgccctccccgccggatcccgccgcggcgcggtggccagcgtccttctcctcctcggccgccacatcgacgcgtgccccgctgctccctcccggccgcctccgcggcgtcgtccctacgtgcggcagtgcttgacgattgagggcgatttagtgcgggattaagtgggatttgttggggaaattgatgcccactacacaaggaaccgatttttgcaattaatttggaggagaaacgatagggcagggagatcaacgaaggcggcagtgcttgagtttcacgggagagatgaacagacgacggacagaggtagaagaagctcctagcgagcggggcccgcctgccagcgcacggacagcgaacggaagagaaagagagggggaggatgaggaggatgatttacgtcggcctcgtatgtcagtaggtcccacacatattttttggtgaatgacaaataggtcccacacatcccttctttctataaagttaatgccaaaagttcaaacctcatgcttccacatcatcatcagttgtgaatcattggatgaatgcattagatcgcttcttagccgttggatggaacgcggcatagagcccaacccatcaggtaccgggtgagtctcttcacctcctcagtgccaaaatgtagcccacatgaacacattggctcatcttcattcacatctacatgtatccggcccgtcaatccgtataaaaagagctttatggccgaacacccctttagttgacattacaatttgttaacttatgttagaccattttgcttctttatagcttacgctttgaatgtgctatctaaattatctacaaaatttggatagggctgctaaaaagaatttctccaagaaagtcatttattttgtccgtttcttcttgagattgtacctcctatctaacaaattgatgttaaccaagtcctgcagcaacgtgcggggcatcctctagtattttttatttctaataccacctaagcgccacgtcaacgccacgtggaaaggagaccgagtcaatactgccacgtaggcgcacgtcagtgaaaccgccctccaaaaccggttttgagagttgggggtcgagatatccggtttcgtggtttagggtcacggattagatttcgatcactttttcagggtcacaaagtgaacttattccaagataaaattaggtttgggcccaccatagtctggacgggtggggaaaccgctgcgagtgcgacccccgccgccgtcgccggagaagaatgggtgggcggggcggaggaatacaggcgattccctccataatctccggcaatagctacatggatttttctagcaggttagtgctaccgctcgttccctcactcttcagggatattccaaaggtaatttccagatttattaaggaaaccggtatcatgtttatattcttttcttatcctctttttgctaaagaaaagataattttgctttgttgactccaagtctccaactcgggtcacccaagtcttcgcggtgcttaacttggccaaattgttaggtgcctgaagcatttcgcccggtttggagaacgagagtagctctgtttgcagagtatcgatcactgttcctatgcagtgatggggcttcaaattttggattcttgtgttttaagccggattttattgctgcttgattcctgcagttatggaggcttggcttctgatcaggtgcaatgccggcgatctgagctggtggagtataccaacgtaagggtgcgcagatggatgtgtagctggagatcgtgcgggtgctgtactgcagcaatcggggctacagaggattgatatatttgcctaaacttccatgaacatcggaagcgtgtcatgcaaggtcatgttggtgctagcttggtactgctatatgcttcttcttttttcaaatcatttgagaataaattgattaaaacaatctactccaaagggcacaatgaactggtggaagaagagaagcatccttttcaaattgccataatgggagcaatagacaaactgcatggtacttgttctatttttatgttaaatattagtgacacatgttacaagatcataagttaattaatttagtgaacctactagattttaccacaatatatattgatgtattttcattaggaacaatctgaatatattattcatctaatgtaaagatatagctatggttctacgcagttaatttctgatttttcccaaaatgttattttgtatggaaataaaaatgaggcttggtttcttctccgttgcaatgattcatttcttgccaacatggattccatgtgcattattgtactctgtttatttttcattttcaacttcaatggaaaactaaaatgaagcttgatttttatctaaaatggaaattgactttttttgtatgcatatatgtggggacacctaaattaggcctggtgccccgaaaatccactcgtgatcgtccaggatttcgattacgcacagattaatatacataacaacttttgattaattatacaaatttgatcatacaagctaattatacaactgttaaaggtttaaaagttccaaactaacacatccttatttgaaaatacaaggaagaatccaaactacccaactactaacctcctaaactactaatttacaactaataaactccataggcaaaagctcgagtgtagacaagcctagaaaaactcgttgttgctttagacctcactatcttctgatcttcttgttagcacaattcctctatatgttaaattatgcaagaatgagtacttatgtactcaacaaggcatattataaataattaaatgtagagagatatgaataaataaaacaatgagaaagtaaaagagtagtaataaaatcatatatcatttttgtgctcaaaattttagttttaaaactacttatacttcaggagtatgaatcacccttatgacacaactccaaaatcgggagtacagcgcattcgaatgatttaatttcacctctgtagatactatctagctttacccacacgatgcccacagctagctagaggctgagaataacagagccgttcgaaggtcccacttactactagttagtgcacagtggggttttggcccatcatagtagttgaactcttgctaggcctaagcaaggttactttatcatcatactttcatgggacccactgttgtgaagcatgcagcccaaactccttacgcacgttcaccccaaaacctgctcctagtgagccaaccaacagtctttcatatagtgggacaatatactaggctaagtccaattacttgatcgtgtggatggacacaaactatgtaatttccatggtataagggggtaattataatccggttaaaccaccaaaattatctcaacatccaaacttccataccaacaaacttcatcattcataaacattcaacattcacaatcctcaacattcacgacctcaactcataaatgcccattataaccggattcttatgtttttaaagatgtttgaaatagtaaaccacataaaatgataaccaatgcatctttctataacctcatgcaataatgcttgaaatcgtttaacatctacccatgagatgttaaaagagtaaggtattatgcatcaaattaaatatgaagattataattagttttctatatgatcaaaattttagttatgtcttgccttgtgccccgaggtttcctgcggcttcaacgtagctatctgagtccacgtcagctccttggatgtcgatagatcttgctgtacagtctaacgtatgaataccaaaaagatagcaaataaagcctataagaaaaatgctacaaagaaacgataaaccgagaaataaataaaattggagcaaggcgaaggaaaaaggaatggttcaaaatatattttaatttgaaaacaaaagagaggtgatggtttctataggttgggaatcaaataaaattgaagaaaaggtaatttggataggtggggtttatttggtggatttggtttctagtcggtgctagagtagggcagcacaacggctagatatttggagttggttagccgatgctaaggttggggagcatcacggctaaatattggctcgtctagttgatgctacagtcaaacaacacaacggctagagagttgggaagtttgtgccggtttgtggggcggaatagtgttactttacagctgtgagttgtagcaaagctgctaggttcgcacagagcccgaaagctagtgtgcggcgtgctatggaggttgatggagtagtgaggctccaaccactgtacgcgttaaggcgtggggtgcgaggagcaatactttgaccttgggattagcttatgccgggttttacgaccaacggtttgacatcggggtttgagaccacgtgaatgtctccatggaaagcgtaaagttctcacggcggctgtttagtggctatgggatggtataggtatggtttagaaataaaaagggtatttaaataaatcaaaggaatttgaattcaaaaaggtttttaattaaagaaatttgaatattcaaaaagggtaataaagaattttgaaatggtattttaaatcataaagatatttaaatgacgaaaatgtatttaaataaattataggaaaatttaatttaaaaggggtttttaaataaaacaagagatttaaatttaaaggtatttaagataaataaaataaattaaaaaggtatttgaataaaatataataatttaacaaggttatttaaaacaattttaaattcagaatgtaaataaataaaaggtatttaaataaataaagaaatttaaataaaatgtttaaaataggtaatttggtatcaaaataaagagtttggaattagatgaatttagatcaaagaatttctgggattgggtttgtggttgaagagatatgggtgtctaaagtttgaaattgaaataaaatcaaataaaagatactgtttatgtgggacccactatcagatgctccttcttcctcctctatttcttcttcttctcttcttctttcttgtgacacagataggggagggagaaaggcacggtagaggaggacggtggctccatgttgatgcgaaaaacacacactggcctaagagatttgcttgagtctagtgtaggtccgaatcttgcttttgggtcaaagggcgtgccagttggtttgatcctgcaactaacaagaaacaaacaaggaaacatagttaaatgcataaacgatagccgatcgaccacttgccgatgacgtatcgtttgtagactagccgatataacgtgaattagatcggcaatggtatataaaacataaagaaagttagatctagtcgatcggctgtagatattaacaatatataatctatacatcgaaatatgtttaaactaagtgattgggatagatcggacagcttgccgagacagtataaatcacttatgtataaaagtacttcaatataaagattatatatgttcatagcatagccgatgttgtagatataacatgtatcggctaataccctgatactactttatattaagatatcaatatagaccaaatatattaaataaggattaatcaagtgttaaggtagattaacgtattaataacaagtttaatatatttagttacagtgagatcttaacataaagggcagatttagcatattaagtaaacataaagtaaacaaaataatcaaatcaggtaagatcggttgaaaccccgatgaaaccctaatcggcaaccaataaacaggctagagattgatattttaatcacgacttataagatcaaaattaactgatgcagttataagtataaaaagaagaacaatacctagaaaatcaagtcattggatgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgatcacaggcgcttgacggcatccacgagctagacaccaaagccttcatcttccaggaactccacttctgggtttgggaaaaattgagcaaaactgagtacaaccaccgtactcaacaagacacacccacaagtgcaggataaatacaagggagtacaagggggttataatataaagggttagggtttgcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaagctaaccattccacattttagttgttaagcaggttttaagaatttaaaacactaacttgggtacattgctcggcttgcccataaccgagggcgcggctattcgaatagattatactctgatcagaggtgtacatctttacccacaagacacatcttcctcacgtgtaatcacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccaacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggacgtgtgaatccaattccacaataatccaactattccatagtgtccaggtggtgagaatattcccaaagtctagagttataaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtctacatgaccaacggaaaagaaaaggcttttactctgataaactccatataacaagcaggaacaaagcacaaaaatgggttcttgacttcttaaggaaaaattagagacttgaacggtccaattccgagttcaaatggccaagctatggtcatttgaagttatatcctctttaaatgaatatttgcgaatttcttcatttaaattttaattttaaaagggtttattgcgtcagccgaggggaggggacgcgcggaccgggtccacgggagtggggcccacgcggcagcctcacggtccacggtggaccgggtgcacccgggctcacaccggccggcgccgtgggtcccacgcgtcagccgcacccgagggcgcgggcggctgacggccgggccccacgcggcagccactcggcgcgcccgagggcggccaagccggcgcagccggcaggaggcggcgcccgcgcctctatggtcgccggcggcggccataggcacggcggagcggcggccgagagaggggaagggaagggggaaaagaggcggtggtccacagctcaccctaggtcgacggcgacgacgaaaaaggcggccggagcggaggaaggcggcggcgcagctcgggtcgacggggtcgacggcgttccggtggtcggcgagcgaacggaggggtagatgaggtcggcgaggatgcggcgaagccgaaggaggcggcgccgaggtgggaggtggttcggggcgacgacggcggcggaccggagctcggcggtgacggcggagagagagagcgacggcgcgagctcgattccggcgaggaggaagggcggcgagaggcggaaacggacggaggaggtgcggggagggtataaatagagccggggcaagagagggcggccggggaaggaaggaaaccggcgcgggaggtcggccgccatcaatggcgccggcgagatttgcgggggcaagtccgtccgtttgaacacgagagagagaggaaaaatgggtggaaagggagagggaatcacggggaataattccccctattgattgcacgcggggacgatggcatgcgccggattcggcggcggcggcggcgctagggcgcgggcgaggcggcggaagcggcgggaggaaggggatgacgggtgggccccacccatcagcgagggtggcgggcgggcccgcccgtcagcggcgcgcgcgcggggagaggccgagtgggccgcggggagaggagagagagggggagggagatgggccgagccggcccaagagggggagggagggaaaggggacctttagggtttttctttttataaaaccattttaactttgtttattcttaataattattatttgtgctctgaaaattccactaaaatttatttacgcattttaggcttttaggaaatatacaaaaatcctccaagccttatttgacttttaactttgcacattttaatttttttggaggctttcacacggattttaattattctaggcataatttagaggatgtattttagagtcgttttgggacgtgacactatattagaaacccactcagcatatcggcatggctgaataaaaccagcatcatacaaacgtttaatttcggccttaatagcctcaaacatatcggccttacatcttctaggaggttgtttatacagccgatatcctggtttgattggtagccgatgttgaacaatcaatcggctaagtcctggcatctcgaaatattcccaagcaaagcaatctctatattctttcaatagctctattaacttggttctaaattcagatgacaaattcttactgataaatgtcggcctcggcttgtctcccggaccaatgtcaacttcttctaagtcatcggccgacatgaaaccttgtcctagtttgccatcgagatcatctacaatatccttggtgtagaagcttgaaccctccacaacgccctcaaaggagcaattggggctctccatctccaattggctatatgtcaaaatcggacacctttagaaaatctccttcccaaactttgccagacaagcaatcaattccatccatctcccaaatagtcaaatcggcattagcaacattgactgacttgtcggctggcacaacttcaaccttatcgccttgccattggatcaagctttggtgcatggtcgaagggatgcaacaattggcatgaatccaatccctaccaagcaacaagttgtaagaacccttcccatcgatgacaaagaaagttgtaggtacagtcttgctgccgattgtcaattccacgttaagaacacccttggtttccgaaggattaccaccaaaatctttaagaaccatgttggtcgtgatcagatcttctgcagtcttccccaacttcttgaaagtagcatatggcatcaaattaaccgcagctccaccatcaaccaacatcttggaaatcggcttaccattgacaaatcctttgacgtacaatggcctgaggtgccgattttctgctccatctggcttctcaaagatagcttgctcaggtgacagaaccaacttagccgaggattcctctaccacatcttcttcctccatatcggcatgatcaacaccgaacttggcaggcaacacaaaagccatgttaaccgacgaagaaacaacagattttcctttagctaacctctttgcttcatcggctaacacgtctcctcttattcagctgatggttgatttcttgctcacctcctcaaactgctccctattcctcactctgaactctcctcttctggttcttggtgaaagggcctgaaggacaccattgcttgttctcaacttgctcccgttcctgagccgattcatcctgaaagtagtcttcatgaatagggcccaatatctggtgaacaggaagtttcttctgaggtagccgattctccctgggacgtgatcggcttgagcttgcaacatgcccccttttatgattactacaactagggcaatcttcgatagatggtagcctcatcccctcattccagcaaaacctgaagaattcacaactccagtgggggtcaaagctatcatcatcttcataaaatttctcttcatgccgatcatgtctcttctgatatttgttgataatccttgcagaattgagttgcttggaccgataatccttcttatcggctgtcttcccagttgtatgaaccatgtttacttgaaaaggattacgctcaattttcatcagcctcttggagttatcaaacttgatcttaccatcttgtatagccaactagatctgttgtcagaacagcttgcactcattagtagtatgagatccagtattatgccatttgcagtatttccttttgcctagttcctcagccgatggaataacatgatttgcaggcaattgaatttgtttctcccgaagtagcatatcaaagattttatctgccttggtgatatcaaaatcatatttctcctccttggaagatggcttcacccacagacatgtagtaacctttttgtttctgatccattcggctgctgctacttcggactcatcttcataatcggaatcagaagcataattgtaagaataaacactattcatctttttgacaatcttcttagcttcctaaaaccgttgttcatgcactccaactttctgggccagatgagccaagctttcgaagtcctgagccgaaaaattttctctgatcggatgcaataaaccctggaaagccagatcggctaattgagaatctgaaaaggacaaactatagcatctgttcctcatatctctgaatctctgaatatagtcttgaatagattcatcatgcttctacttgactggaatcagatctgtcagcttcatctcatgaacgccactgtaaaagtagctatggaattgcttttccaaatcggctcaattactgatagaattgtatggaagattagagaaccaagtaaaggccgatctagacaaagacaaagggaacatcctaaatctaaaagcatcattagccgatgcctctcccagctgagctagaaatcggctgatatgttcataagtagaaaatttggaaaaatctagcaccttgtatcagtgtggtaatggaatcctatcaaactactcaagatatggtttccgatacaaattaccagaatctttaggcttgaaaccaaactactccctcataatataggctatcatatcggcccagggcttctgctgttgctgctcaggtgcaccctggaactgctgctgtgctagatcatactgattgaattgaggcacaaactacggctgtggtgaaggtgctagccgatactgtccttgaggtgagtatggttgaaacatgttacccccatcataaggtggtggagtctgatgcaccatgtggggttgttgaattggatcagtgtcacaccctgaaaatcgctaaattataaatcgttgtgaaaaaggaatttttagaaatcatttaataactaaagaaagtgtgtgaataaaatctatgaaaaatttgaacttaaacttgagctagataaaattttattaaatactttgtatgcccaagtattttctggatttttcccagaattatttgagcattggaagtatttttaataactgaaagatcatttcagcaattatttaaattaaaaagttaattaaatcctcttcctcagtctgggctgaatccggcccactcctctctctcccttctcccttccgcagcccgtgcctctcccttggccgaagtctgcattagcaccctcctcctcctttctctcttccgagccgggcccacctgtcggactcgccttcctcctccagccggccgctcctcccgtgacgtgtgttgcagcgccgccttctccgttcgatccggtgcatcccgtgctccgtttccaaaattggttgcaaaaacggattcccctcgatctcctctatcttatccccaagaaatccccttgaatcccgtggtatatcgcgtggattcgacgtggttttgagttcctattttccggcgaaccctaactaatccgtcgccaattccatccgttcctgagccgatctctccctcttccggctataaatagcagtcccaagacctcctcttccgtttccctctttttcccgagtttttccatagccctagccgcctccccacgttcggcttctctctcctttgccggccgccgctccagccgcgctgtgctgcctccccggtcgtccccgatctgcgccgtcgcttccctcggcttcgcagtgaagagatccacctcggccacccgttcctttgcgccaaatcccgccggaagccgctgtcaccgtgaaggccgagttcgctgcctcggtttgatcttcggcgaagctttgccgtcgactccgtggtcgccgaaccccgccgtctcctccgttggcattgcagcgacaacagcaagcccggcagccacctccgcgaagacgcaagccatcggagcaccgtcgtcactgtgaagccaatctgttccatcttcagccgcgccgttcgtcgccgtccatcgccgccttcgttcaccgtcgccaccctcgggatcgcaggagcgaggtgaagaccgtccgcccctcggttgctgcctctcgttgccggaaagccgttgccatcgtcaacccaaggtcgccgccttttggagttcgtcgcctgccatgtccctcgtcgtctgtcgttgcgtaagtggtggtaagggtcgccttgatctcctctctctcccggtgccctccgtttgcatcattgtaccgtggttcgctggtaactgccgttcccgtgcttgcggtcgtcgatcctgcgtggcagccatgtcatcgctggcatcagcgccatcttggccatccaaaattaatataaatttgtcatctcatttcaatgacatattattcctttttaatatatgtcatctaccaaatatgatctaatatttttccggaaaatgttttaatcttctgtctcagctataaatcatttgtaaattgtttaatcaatttggaatagtcttttctttaataggtttaattagaattaaatcttgtaaaattcatatctaattcatacgaactcagaatgaggtcgttcaagtctcatgattcatctaaattcaagctctacctatttatgaactttaattgtactattcatttgttttttattagtgttttactttgttttgcgttctaggtttagttttccgttgttttggaggatcgttcgttcgttggagaagttcctgaagacgaattgaagatgcttgtttgcaaggcaagtcacacaaatcccaaacacaattcctttgagcatgttgatcctacatttaaattctctatttatttcaattgtgcatttattttcgaatgtcaccgggtggtgagcctttcccatttaattatggccgaagatgactttatttacctatgggttagaatttgattagctagaagcttatatattggtttggttcagctagatgcttataatagattcttagccatgcttagaaaaaatagctcactaatgggataaatcatacttcactatcacttatggatatttaatggaagctcacgatggttaatcgtgattggttaattaattaatatgtcaactaaaacttgataaaggtgggttgtgagcacatggttttgatggtcgtgctcatgacaattaaggaccggttcacgagtttcggttgtgaaacattaaccgtgccaaccacaagccagcatgggcaacggctttaccttttgtatagcatggttcattgcggagcaccagactgagaagtggcagagataagcccacgggggtcgctggggagtccatgccttgtttataagggggtgattatgatccaggaacggtgcactgtggtggattgtgttgtgcgaggggtactgtcacagctcctttccgaggtaccgtggtgatatcgaggcgcatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataatgaaagatgatataactggtaataatttgattagctcctggtttggaatggtacattcctggtttggagatagatctgtacagacgggtatggttgttcaggatggttgggcctgtgcggcatgggtatgttgtatagtgttgattaatattgatgattaattgctctactgttttacaattctcaaatgtttgctaaatgctgcttttgcaaataagccctatattatgccattctttggtatccttgtgcacttgcatatttgctgtgtggcttgctgagtatgtcatatgctcaccttgcaataatcatcaaacctcagttgaagaaaaaggattcagaagaagaagacgtttggcttataccccagttgagctgcctgtgggagtggagctgaagctcgttaggttttatttttccgctgcagctttcttcatggtgaggactaagtgcctcttatgtaagtatttattcgctttagttattgatgaatctgtatattaaattgtcagtttgtgtacctcggctgattcctggacgaggattttatgcacaaatgagttcggaaattactagtgaatttctgggcgtgacaatcagacatgaactgagcaccgatcaactgagtttgctgaattggagtctaaggcctgatcggtatgttctaaatcggctgttgaacaggctgttgaatctgctgctgaattggctgagtgacatcgaacatagacgatatttgctcttgattaacttgaggaatgttgtgaccaacgtgctgaggttgtggtctcatcaggatacgaggtctgaactctggttgtttgtgagctgatgaaatcacagttgaattcggctgagccgatgctggcaccatcgggttaggttgagccgaatttgtccccgtcaagttaatctgaggttgatttggtcccaacgggttcagcagagccgaagtttcccctattggattaggttaagccgatgttgatgcaatcggctatcctgaagtaatcccagaaacaggcagtccatctgtaaccaaggtcctgtaattaggaaacttgtcaccagggaagaacgctggacctctggctcccctttcttcaaacttgcaatccatcatcttctccatcacattgctcatcacattagctaagattcctgactgattgatgagagcatgattaaccgcatagtcaacactgtcttggaaattcttgaactcgaggttggcatcttcttgtttaagtccttctttgccttcttccttgttgcgtccagaagtaccagaaccagaagcttcactgtttgaagggggtgggatttctaccttatgcttctggatcactgttccttgtcgagtcagagcaaaagaatcaaagtatgtgttctgtagcttgctcaaccatgcatcatattaacccctttgctctggtgtcagcatgtcgatggttatcggaatcttgtttgtggaatcaacttcagtcctcttgccatcatcatcagtaggcttgacgtccaccatgatgaaagattgtcacactcgtgtcccaccgggcgtgccaaaagcgtgttgatgcgaaaaacacacactggcctggaagatctgcttaacttcagtgcaggacctaaaatctctctttcgggttcagggcgtgccagttggtttgatcctgcaaccaacaagaaacaaacacagatacaaagttaaatccacaatagccgatcagccacatgccgatgacgtatcatttgtaggttagccaatataacgtgaattatatcggcaatgataaataaagcaaaaggaaagttagatctagtcgatcggctgtagatattagcaatatataatctatagatcgagatacatttaaaccaagtgactagtatggatcggaccaagtgctgagacaacatgaatcacttatgtctaaaagtactttaatataaagattatacgtgctcatagcatagccgatgttgtagacctaacacgtgtcggctaatactccaatacaactttatactaagatatcattatagaccaaatatattgaacaagaattaatcaagtgttaaagtagattaacagattaataataagcctaatatatttaataacagtgagatcttgatataaagggcagatttagcatgttaagtaaacatgaagtaaacaaaacaactaaatcagataagatcggctgaaacccccgatgaaaccctaatcggcaaccgaaagcaggctagagattaaaattctaatcacgacttataaggtcaaacttaactgatgcagctataagtatgaggagaatcacaatatctagaaagtcaagctgttggttgattcatagagtggtagataccctatataatctaagtcaaagttgatatttaacttgatcggctgccttccagtcatagatgttagccgattgaaggttaaataacaatattgccagaaactatataggatatatgataactcaacaaacaatattagagtgtcataaatatggaagcactaatcccgagaacacaagccgccataacaagttttacctcttgtcagagatcgaagccgatgcagcccaactcgaaagcaagaactcgtcgaaaatagaacaaaacgaaagggtggcgatgcgccgaatttgattgaactaagcgttaattgtttacaagggttcgggcttacttttatacctgagatacatgatatgtccctatcggacacgacttcgagccctattacaacttaggatacgaacaagtccctaaggcggactcttaccgactcaaatcataaggaaattacataaaatatcctaactaatagatacaattgcctttccaggactcaaatcgtgtgcagcaatccatatgaagcactttgattcaacccaatgatgtataccgagtcgtattgccaaaattcggctcaatcggctaaccttgttcgactcgaactctgccaatcttgaccgcagccgattcagacttcagccgattcttactctgttttcgaaacagtttatctcttagattctgcttcgattttatccttatctcagatacttggattaccaaatttggtcgttaacacatgccccccaagtccggaatatttggtaatgtttcggatttgccatatcatatctccaagaaaatcgcacattgccatttttccaaccgttaccacacggctttaaatactaaccgacctccccgagaaaattcacaccgttactttgccctcaaccgctcaagcgatttctgtcttctttctctccggcaatcccctcggcgcaaaaagacgatctcaaggcgactccctctccggtcaacttccacccgcggcaatgtcgtcttccgccggtccatccaccgctccatcggctgagtacgcagaggtaagcccttatcggctaaatcccttcttttatgcaatagatcggtttctcttggtctcagtttgccttctcttccctttgctcttcttttgtagcatcttgcaaatctgattgtgatccctagcttgtcccgcgagcatcagtactttctcggtccgattggtaactctcaccgggcagagtttattagtgctgaaatcaataggatcccctacaggatagccaatcctagcctaggccactggaaaaacaccttcaagtcttggccttctctagagaaaagctggcccgcatggtacaagcgcatatcggctagcaagcagagccactgggatgagctgggaatcggccaggctttagccctaaccatagcaaattcggctaaagatgaacccttgatagcttctgcagcctatttctggtccaacacccttaatgcttttatgttcaaccaagggccgatgacccctactctgcttgacatcacaatgataactggcttggacattacctcatcggctaaccacatgaacctgaactccaagaacaaatttgatttcaagactaagagtataggaggatggtcagggttcatttctgctaatatgggccagggatctgttaacccccgagagcacacagcctatctgttagtgtggctagaaaagtatctcttttgtggatccagttgtggccctacttcgaattggcagcacatagccgaggcccttgaagaaaagaagcttgttattaatatattaaaagaaaatatattaagcttgttattaatctgttaatttactttaacacttgattaattcctatttaattatttaatctatattgatatcttagtataaagtggtatcggagtattagccgatatatgttagatctacgacatcggctatgctataagcacgtataatctttatattgaagtacttttagacataagtgatttatactgtctcggaaagctatacgatctattccaatcacttggtttaaacatatttcgatctatagattataaactgctaatatctacagccgatcgactagatttaccctttttcttgctttatatatcattgccgatctaattcacgttacatcggctagcttacaaatgatacgtcatcggcatgcggccgatcggctatcgtttatggatttaactttgtttctgtgtttgtttcttgttggttgcaggatcaaaccaactagcatgccctttcacccagaagcaagatttgttcctgcactagagctaaacagatctctcaagatttttgatggggaaaataaggggctctcaccggcttttataggcggcgaaggcggcggagggagagaagccgatgacagcacggcgcggctttgggagagaggcggcggcgcgtgtcgattttcaaatgggcggcaatggcggctcagtggtcggcgttggctcacagcggcgcgtggcatagctcagtggttggcgatggcttgaacaatgggtggcagcggcagagcaatgggcaacagcagcaatacagcagcggtggcggcatagccgcggcggccacaggatggccatggcggcggtggcggctgttggggtggcacggggtgcccctaggtttggcagtggcggcggcgcgtagcggcgtggcaacggctggtgaaaggagcggcgcggcagggcgatgtggtagcagttgggcggcgtgtggtttggggcgaggcgatggtggctgtcacgccctgaagtttccccctttttcttgctttaaaaatttgttgaataaattgcccaaagaaattgtttaaataaccatgagctaattccctaattaataaatgcattcaataattgtaaatggcatggtgggatttcgactctagaggatccttgggttccacatgtcacaatacattaacagcatttttagtggaattttcaaagccctataaataattttaaccaattaaaatcatgaaagtgcaatattttaaatccaaggaaatcaatttcctctttttcctttttcttcttttctttttcctcctttctctctttttcttcccgcgccctctccctccttaccgggccggcccatttcctcttcccctctcgaagtcaacccggccaccctctcactctcaggcgctgacaggtggggtccacctgtcagtccttcccctacctccagccggttggagctgagctccaaccgccggcgcccccacctccccacgctgcctgccttctctgctccacctcgcgccccgactccgcgccgctcccacgtcgccgcccctcccccgctcctcccgcactcacgcgcacccgagaatgggcgggattcgatttcgaatcccaccccccattctctctctctccgcccccacgtcaccggtgatttcggccacctccttggccacgtccgcctcccccttcacctataaatcgctccccgcgtccccctctctcgtttttcgctctcgccgcgctctcccgtgcctcctaccaccgccgcgccgtgcacccgagctccgccgcccgccgcccacctcctgccgcgcgccgccgccgctagagccaccgccgcgccgcgccatcgccgccgtcgtgctcaccgagtccgcccgcacttcagccgccactcgattgccgcaaaaacccactggagtccccttctcctcgcacgctggtgagtttgtccctcccctccgcctccggtcgtcaatggcatccgctgtggtcattttccctactcgtagctcctctcctcccctcctttaggtatcgccgccgcccatccgcccctccgctcacagggtcatcgtcgccgcctttgccttccgttccggccgccgtgctcgccagtgaggagctcctctcctccctccttccctctgtcccgcacgtgccgccgctctctgcgctcgccatcgccttcggccgccgccgccagcctatgcgccatccgccgccgcttgccgtcgccggcggtcgcacgccgccgccgctccccatggccggccggccggctttatgccgagccgagccatgcctagccccgcccgcgccgtccgatcggccacccggccaatctggaccgtcggtcccgtggaccggcggtggaccacccgcgtggtcccggtccacggtagaccggccgccttgtgccgctgccaagtggggcccaccagccagcgcctccctctcccttgagtcgctgacccatggggcccacctgtcggtgcccccctgatgacgtcagccctgagaatatattgcacaataaataattaaggcatttctttttatagtaaaaacacagagaatcttctaaaaatcataactaattcatccgagctccgtttaagtccattcaagtctcagtaaatcaagaaaaatgcaatgaatccattaaaaatggttttgttttctgtttcagtagtcttatagcatgttttgcttgtgtgctttgtttgtcgcgtagatttcggccgtttcgtcgatctgcggttcctcgaagacgttgctgaggtctcatcagtgcaagagcaaggcaagtcatgcattacaattgatcatattgtacccaatttacaaatatcccgtatttctattaaatgttgcattcttttacaatgtcatgtgggatgggtcctattactcagccatttattgtttaccttatgccattgataacttgggtatcaaaatgactagatgttggtttaggaaaatgcttagccatgcctagttcaactagtacacaaatggggatcacattattacatagactttgactatgagcatagctttggattggtgccaccgcaatggtgttagttaattaaaatacactaaatggtgggctgtgggtgcatggttttgctggtcgcacccatggcaattaaggaccggttcacgggaaaccctgggagacttaccgtgcttgccacaagcgggagtgggtaactgcttgatctgaagtatagctcgaccctttcctaggcaccggtggcgagggtgggagtgatggagttgggtcggtcgaggtgtccggttgtccagctgccggattcaccgcggcgcacgaggggactacccactgccttttgaggggtgggggtgaaaccttagcgtggtgtggatggttaggggcgggttatgcgaagggtcttgtcacgatttcctcctttgcagtgctatggtggtactcggggcatggtgacatgtgtggaatcgtgtcttgtgggtacagttgtgcacctctggccagagtaaaactattcgaatagccgtgcccgtggttatgggtgatcaaccagattcaccgtgattagtctcacccctagtttagcttaatgaactggtgtagttcaggtggtgggttgggcctattgcaacgtggtgtagcgttggacagtgattgggtaatattgcttaatctactgcaattgttttactgttttcaactactgtttttaaatgctagctttatgcaaaagaacctttagcctcttttggttatatcctgcatcataccttctcttccggtatgacttgctgagtacagtgggtagtactcagtcttgctctcttttcccccacaccagagctgaagatcttcctagttggtgatgtcttattgaagttggtttcgtcgctgccgtcaaggattgcctgtggagtggagtcgccccgctgctgaagtcaagcttccaagtttagctcgctttttccttttccgctgcatttgtaatcttttatatttttgtaagacgtggatctgtatgtcagcaattgtcgtttgtgtaccctggctggtcctagacaggggtttaatgcactttcaacttggaaattctggttcgtgaatttctgggcgtgacagtggcgcccgcggtggcgtggtgatggcggcggcacgcccacagtgagagagagcggaggcggctcagttgggctggcttggctttggctaggccgacagcccgagggggagaaggaagtagaaggaaaaagaaaaaggaatgggccaaatgagagggttttatctcaaattgaataggaagtttaaataattttgtgtggagggttttgattggaattcaatgaagataaaaaactaaaggatggatggatgtggactttttaaactttgaacaaagaatttaagtataattttgaagggaatgaaaatgaagagtatttgtttggagactttttgaactttgacaacgaatttgaataggatttctaggaaatagaaactaagggagaagtttgaggacttttagaattttgacaaaaatttaaatatagaaatttttagaatacaaaaggagtttgaaatctttttaaaataaaactaaagatatttattttaaggtataaatttgaaaggataaaataaagatgctccaagtttatagaattcaataagaaccaaatataaaacttgtcacaaaagattttctctaatattttataatttaaaattgaaatagttcacaaatgatttaatttctgactttggatgaatttttgggatggtggcaaaaataaaaggaagggaataaattggactttagcccaagattatgtggtacggatttctgagtgaaacatttgtgggctaaaggaaattggactttctaaggaagcgattggaaatagtgttcttaacacaagagcaatcatttaatatttgtattaatattattcttctgccgaggagaatcaaaccttgggaatcaaattggcggtttgatttatataagaatttggatagtggaacatctagaggagtttgtggaaggtgttgtatgaaggagaaacataaggatttctaaagataggtatagatcaagggtttgatccacaataaattccagcaaaaaggaaattatactggtttagccctaaggataaaaagggttaatgggatataacagaaagttgggccgattagagaaacattggcccaaactaatttgtagacttggaaattttgaataggtaatttagatatggaggattccaaagggagagtatttgttggaggataaatttggatttggagataaatgtaggtggggaattataggaatttttataggaacggatttggtggtagtataataagctctaaaactatgttgactcagagggagattgaaagttgatattttatgtactctagagatatttgggtagagatcaaagggaaagtattaactctgaggaaattgaaaattattgttttatgtactctagggatggttggaaattattatttcatgtactttgaagatagttgagtgggaatcgaaagggtatttgtagatgtggagatgttcgggaatggattcgaaggaaatataatctagagccaaagttatagattaaaataaatggaagggttttgtaaaatttgaaataaacaaaataaggaataaaataaggattttataaaatttagaagagagcatttaactttgcaaataaaatttggatccaaattaaaagatattaaaagaaagcaaggttgctcaacgtaagaattgagaagagcatgacttaaaacatttcgcaaaaaattttcatgaaattttgagtatgttacaatatatattgagtgtgcaatgcaaaatgttgggctcaaccaagatataatgcagaaaagaattttgtggataaattttagtggttattctaaccttataactatcattctatattcgattggtaaactattttgatccctcaaggaatgtccccttgtttgattaaaaatcatctaaatggttatgaaaaattctaaaaaaattgtcaacactcatggaacatacttatacaactccacaaaatcttaagtccaaaatcaactcatatgtcgagatatgaaaaagacaaattcagcgtatgtgttcacttctaaatttgtatttttatctcaatgtgtaggtcaaatttgaacttgatttttggtggaccaatagatatcactatactctacattgttaaccttttcagaatttttcacaactatttatatcgaatttgaaagaaaaaaagtacgtgagaggacatccctggtgggattataatacactcccatattcgattgctaaaacatgtattgtaccaatgtctcttacatgttttattttgaataacaattgccaccgtagcgttagcacaggcatattaatagagactgttcttctctgaaaaaggcaagtacttatcttctgtcaatgtcttgagcgagtgaaacactggtggagaaaccatcttttgtcgatcggccgaattccacaatagtcccggttgcaacaaaaaccgggactaaagatgatctttagtcccggttaaaaagggtaacgggcatatttgatctttagtcctggttggtaacaccaacctctttagtcccggttcaaatgctgtcagggcttgtcaggtccccccgggatctttagtttccggttggtgttaccaatcgggactaaagatcgtaactttagtcccggttggtaacaccaacagggactaaagatcccccctctttatatatgccttcttcctcctccagcccgagagcaagcttcaaaatttcttcaaaaaagaggggaggtcatgccaaaatttatagtgaatttactttggtgattatatacaaatcggaggtgcctaaaaggttagcaacttcatcctccaattttttttggtcatattacatttggagctatgttttgcacactttttttgtctccaaaattttgttgtaagttgatgagagagaaaatttgtgtgggaaaagaaagaatatatagaaattttgtttatttgctaaaaaaggttttataaaatagttgagtaggaaaatatagtgaaagttaatcctaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaatgaatatttgtgtacgatttttttttcatttcatgtagatggatcggcaatggatgtacgctgaccggcggtccaaagagtttattgatggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttgaaatggaagaagatgaagtggaagacgacaatattccagactttgctcagtacgctggatttgaaggaaatcaaacgggcgaggaggatagagatgctgattataacgacattgcggatgatcttggtcagatgttgcaggataccaaggaggactgcgaaagtgaaaagagggcccataaattggacaagatgttagaggaccacagaacatcgttgtactcaggttgcgagtaggggcacaaaaagttggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctaggactagaagttcagaagattcacgcatgtcctaatgattgtatcctatatcgcggtgaggagtacgagaacctagaagcatgccctgtttgtaaagcactataatacaagattagacgagatgatctaggtgaggttgacgggcagctaacgaagaagagaattcctgctaaggtgatgtggtatttccctataataccacggctaaggcgtttgtttaggaacaaggggaatgctagaatgatgcgttggcacgctgaagaacgtcaataggacgggatgctgagacaccccgcagatggttcgtagtggcgaaacatcgacagaaaatttaaagacttggaaagcacgcacgaaacatatggtttggtttaagtacggatggcatgaatccttttggagagatgaccagtggccatagcacttggcccgttacgatgtgtatctacaacctccccctttggctatgcatgaagaggaagtacataatgatgccgattattattcaaggccccaagcaacctggtaacgacatcgatgtgttcctaagaccactggtcgaagatcttaaactgttgtggaagaaggaaggtgtccccgtgtgggacgaggacaaacaagaggggtttaacctatgagcgctgctgttcgtaaccatcaacgattggcctgcacttagcaacctatccgggcagtcaaacaagggttacaaggcttgcactgactgtatggatgaaacagaaagtacgtatcttaagcactgtaggaaggttgtgtacacgggtcatcgtcgatttcttgctgcaaaccacctagtacggaagaaaggcaagcactttgaacataaggcggaccaccgtacgaagcctaaacatcacagcgggaaaacagtgtttgctatggtgaaagatcttaaagtagtgtttggaaaggggcctggcagccagcctatagactgcgaagatggtcacgcggcgatgtggaaaaaaaactccatattttgggagttaccctattgggaattcttggacgtccgccacgcgatcgacgtgatgcacctcactaagaacctttgcgtaaaccttcttggcttcctaggtatatatggaaagtcgaaagatacactggaagcacgtaatgatctgaagcatatggaacagcgcagcgaccttcacccggaaccaaaggagaaaggcagccattacttaagtccagccagctacactcttagcaaggcagagaaggaaagtatgtttcaatgcttggagagcatcaaggtaccatctggatactccacgaatataaagcgaataataagcacgaaggagaagaagttcacaaacctaaagtctcatgactgtcacgtgttgatgacacagcttctaccaattataataaggggtatcctcccagacaatgtccgggcaacaataacaaagctatgttctttcatgaacgcaatttcgcagaaggtcatcgatccggataggttagaagcccttcagaatgatgtggtgcaatgtcttgtcagctatgagttgatatttccaccttcatttttcaatataatgatgcatctgctttgtcacctagtgaaagagatcggtattctcgggcctgtgttcctacacaacatgtttcctttcgagaggtacatgggcgttctgaagaagtatgttcgtaaccgtactcgtccagaggcaagcatcgccaaggggtatggaacagaggaggtcattgaattctgcgtagaatttattgaagaccttcgcccaatcagggtacctgaatcacaccatgaagggagactatggagaaaggggactctcggaaggaaagcaataatgacggtagacaacaatttattccgtaaagcccatttcactgttttacaacaatcttcattggtggctccttacatcgaggagcacttggctctagttcgcgccagaaacatcggtaagtccgatgcatggattacacgacatcacattgatactttccccgcatggctgcgacaacatctcatgggtaacgagacgattaaccagcaactggccttcctggcgaggggtccatctggctcgatcgcgacattccagggatatgagatcaatgggtacacattctacacacgagcccaagacataaagagcacgaaccagaacagtgatgttcgtatcgatgccatgggacacgatggtacaactggcacatattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaattgtcggagtagaggacaagactgacgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggacaatcgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgttaattagaatttttaacaatttaatatcatgcatatgctaataatatatgcttattagaatttttattaattttaaatcatgcatgtggtatttacataggttaattagaatttttaacaatttaatatgcatatgctaattatatatgattattagaatttttaacaattttaaatcattcacgtgcttattatatattatccacttaatttactacagacaacaataatttttcgaaggttttgtcattaatttttcgactttaaataattttaatgcattatttactattttagaaacacatatgcaatgaaattcaatattcagtgctattatctttagtccggttcttaaccctaaccgggtttaaaaagaatttggaaatagcgggaaaatatctttactcccggttggtgagaacaaccgggagtaaagatatctttactcccggttcgtaacaacaactgggagtaaagatcatctttactcccggttgttgttaaagataagatctttactcccggttgttgttacgaaccgggagtaaagataactctcaccaaccgggagtaaagatctgggggtatatatattcccagtgcgccctcgtcttctctaccaacacttagacgtttttcctccgatcggcttctagctccttcgccgccactgcctaggcatccccgtaccgacaccgccgtcgtctctcgccatcgtctcgcggtcctcgccgcctccgccgccgacgccgccgccgccgcatctctcgggtgagagccgccgctgcctccctctcttttgatctcgatctcgatctctctctctctccaaaccgccaccgcctagctcgttgccgacgccgccgccgacgtagacgcgccgatgccgacccctcctccgcctgccgccgatgccaaccccgacttccacgcagccgccaccgacgacgccgccgcgtccacgcggctgccatagccacagcaccgacgcccccgcctcgagctcgccacgccgccgcgccgccacgccgcgtccacgccgccgcccccgcctcgagctcgccacgccaccgtgccaccacaccgcgcgacgccgccgcgacgccccgccgccaccacgccgccgcgacgccccaccgccaccgcgacacgctgtcgccacggctgcccgaacgtgtacgaggatgtgaccgtggaggatgcgctcacgtggaggatgtggccgtggcagccgtggcgaacgaatgcgaacgaaacgtgaacgaacgcgaacgacgtgaacgacgtgaacgaacgcgaacgaacgtgattgaaacgtgaacgaacgcgaacgaacatgaacgaaacgtgaacgaacgcgaacgaaacgtgaacgaacgcgaatgaacgcgaacgaacgtggctgaaacgtgaacgaacgagagtgttagtgaacgaacgcgaacgaacgtgaatgaaacgtgaacgaacatgattgaaatgtgaacgaacgtgaatgcacttgaactaaaagtgtgagaacgaacgcgagcgaaacatgtacgaacgagataaattaaactattgttgaacttagcatatatatatgattatatatacttgaaaacgtgaaatacattatatgttcctttgcgtttagactaatacatttttttgcatgttgcagagaagacgtcgtcgtcgtcgtccctcaagccgaagtggtagctagccctcaaaggaattcacgcagacaagtgatgtaaagatgtgattgttaaatatataatataagattgttagatttctaatataagattattagattattagagttagcatatgtgagtattagagattattagattattagacttagaatatttgagtgttagagatagttagagatttaatataagattattagaggtttaatatacaaaacttaattagacttagcatatgtgagtgttagagatttaatataagattattagagatgtaatattcgaaacatatttgattgttagaaatttgatataagattattagagatgtacaaatacacgacacttagacatagcatatatgattatttgagttttaatacaagattagtagagtgttaatattacgcttagcaaatatttcttctatgaacagatagctgatcgcgatgaggaacagatactgtacgaaacaatcgtagagggaagcagccagtactggaacgaaaaaaaggggaacgaggatccaaactagtacttgaatgaggaggagaacatggagagggatgaagaggggaacgaggaggggaacgtggagagggatgcggaggggaacgacgaggacgctagtggaagtcatccctccgctggacagaagagggcacgcggacaacaaggtgccgcgaagaagatagagggtcagcacatcataactgaggtggacgcagacggccgacctagtgccccggcaaaagcagcgaagaattttgtacgccacatcggttgggttgtgagggataacgtgcctgtcagcaaggtgtactggcgcagaacaagggcacgcggggataatgacagctttgtcccggaatcagagaaagagatgctatggaccacaatgctcgagacgttcacgctccctgcgggtacggagaacatagtgaaacagtggactcttaagaaaatggcagaagagttccagaccttcaagggagatctgtaccagaaatacatcctgaaggggcagacaccgaacttcgacgtattcccgaagctaagggatcactgggatgagtacattgcttacaagacaggtcaacaagggcaggcgatgatgaaaagaaacaaagaaaataccgccaagaagaagtaccatcaccacttgaggtcaggcggctatagcgtcgcgatgccgaagtgggaggagatggaggcaagcttgcttgagaggggtatcaaaccggccaccgctaaatggcctgatcgatcgaagttctggtactatgctcatggtggaacgctcaacccaattgatggctccttggtctttagcgatcagatacgcgaggctgcgaatcgactaacggacgcagtggaagcctcttctcagggcacattccgacccgacagagagaaggacgagctgtcactcgccctacagactcccgagcatccaagacgaacacgagggaaaggcgtgattccctggaagatgggattcaaggaggacatccacacgtacaggagtcggatgaggagcaagagagataccgaggcgaagattgcagatcttgagtacagggtatcgagctaagagctcagcatgcaagaggaggtggcccggaaggtggatgaacgcatggcagcacatcggtcacacgatccccagccgtacatacctcctccaatggtcagcccatcaggcaatcgtagcagctgcgcctcaacagggcaggtaggatcacatagcatggacgccatgcaaacccaggacgaaaccacctgccccgttgatgagatcacgcaacggacaccatgtgagctgcatattcccttcaagaacttatcaatcaaggtatgctcgatgtaatatatgatttttgactcgtacgttccgcaagttgctgcttaggttgattactaatagataacctctcgtcatgtgaaggtggtgtcaggaatggccatcccaacagacatttcagggacttaccactgtaggccgattccagcaggatactcgatggtcgaagttgagctggtggaagccgtgtacgaggacctcgagttggactacccaggaggagacggtgagacgcatctacgagacacaagccacgccattatactatggcgcaagcggtacatcatcctccctaggcgacaagcggcgtctcgtgcaccatctcctccggctctgccgtctcctcctgcaccatctcctccggttcctccgccacgtcctcctgcaccatctcctccggctcctccgccacctcctcctgcaccatctcctccggctcctctgcctcctccacctccaccgtgtccgcctgcacctcccaagacaaggtctcgccaagctccacctcctgccagcacaagggcaacgaagaaggccaaagttgacaccaccaaaaacaaggagccgccatacggttgcagtcaagaggagcttgacgcttatgtggcaggagaagtgaagaggcaactcaagcctcggagtcctgaaaagaagatagctattgacccgagtgtgaagaatttcttcaagggaatgtccaccacaaacaaggaggccttaaagctatcggattatgaccgaacacttaggaaagcctattacaagaagtccaaaccagttcctcagcttggagaacaaccacaccaagtgttcgagccgttggtgaccggcgaacactttggcataacggatttcatttcggacaccggtctaaccatggctcagttggttggaggcgcaccaatcccgaaggtggaagtggcatacaagtttgaactcggtaaaccgcttgtcaggcctaagcagctgcagtatatacatatatgtgtgtacatatatatgtgtatatatatatatatatatgtatatatatatacatatatatatatatatacacatatgtatatatatatatatgtatgtattctatatacatgcataatatatatattacaatgcatatatatgtattttgtgtgtgtgtgtgtgtgtgtatatatatatatatatatataatcaaccatgcagcaaacagggccatgcaaataaaaaaatggtacatagatctttagttcaggttggtaacaccaaccgggactaaagatggatcagccggccacgtggctgatcgatctttaatcccggttatttcacccgggactaaagatcgctatctttagtcccggattcgtagtttcggttggacaaccgggactaaagggggttacgaaccgggactacaaacgatttctccaccagtgaaagaggaggtcagtaccttgtcccgtgccttccatctagctatagtattttaacttgttaacatcacgattatttcagtagattaatcatgtgcatgcttgaatgtaacattttcctctagagtgcttcatagagatgcacttgatagtgcagtggcaagagatgtgtggttttaaccgtaaggttctgtgttcaatccctaacacactcacaatttcttcttaaaaactatttggaggtacgtctcttcctctatacagtggcgccaggaagcaaatagcgcgactctgagcattcatctctaaacaatgagtaaagaaattacttctatctctgccctaatttgtaaagggagtaaaaaaatcactctcgagtaaaatatttttcacatcacttttgatcagttaatggtcaaatatttttcacatcacatatagttaaaaattaactaacttgttcaatgtcagtcgaaaaaagaacatttgatttacaaaaaaattaaaaaatcatagacatttaatttttcaaaaacataatgaaacagaagaaaaataataataacaagaaaatactaaacgtttatcatagtaaataactcaatatgctaggtcacgtttattatagttgatgaatcacacatagttaaaatttaactgactaaacatgaatatatatggtgcgctatatagtagtaaaaatttaactcgtgaatcaaagtgggtggagtcgggaggggagtggggtggtgtcacgcccagaaattcactagtaatttctgaactaatttgtgcataaaaccctcgtccaggaatcagccgaggtacacaaactgacaatttaatatacaaatccatcaaaataataacgttacatacttacaaaagaaaagaaaactgtagcggaattacggtctagcgaagctccggctccactcccacaggcagctcaactggggtataagccaaatatcttctccttcgcaacttgtcttcaactgaggtttgattgattattgcaaggtgagcatatgacatactcagcaagccacacagcaaatatgcaagtgcacaaggatactaaagaatggcatagtatagggcttatttgcaaaagcagcatttagcaaacatttgagaattgtaaaacagtagagcaattaatcatcaatattaatcaacactgtacaacatacccatgctgcacaggcccaaccatcctgaacaaccatacccggctgcacagatctatctccaaaccaagaatataccattccaaaccaggagctaaattaattagcatcaattaccacattattattaatgaatagtgtgggactaatcacgaaagacattgtttgacccgcccataaccgcgggcacggctattcgaatagttttactctggccaaaggtgtaccactgtacccacaagacacagccccacgacatgtcaccatgtgcctcaataccaccacggtacctcggaaaggagctgtgacagtacccctcgcacaacacaatccaccacaacgcaccgttcctggatcataatcacccccttataaacaaggcatggactccccagcgacccccgtgggcttatctccgccacttctcagtctggtgctccgcaatgaaccatgctatacaaaaggtaaagccgttgcccatggtggcttgtggttggcacggttaatgtttcacaaccgaaactcgtgaaccggtccttaattgtcatgagcacgaccatcaaaaccatgtgctcataacccacctttatcaagttttagttggcatattaattaattaaccaatcacgattaaccatcgtgagcttccattaaatatccataagtgatagtgaagcatgatttatcccattagtgagctattgtttctaagcacggctaagcatctattataagcatctagctgaaccaaaccaatatataaggttctagctaatcaaattataacccataggtaaataaagtcatcttcggccataattaaatgggaaaggctcaccacccggtgacattcgaaaataaatgcacaattaaaataaatagagaatttaaatgtaggatcaacatgctcaaaggaattatgtttgggatctgtgacttgccttgcaataaagggtcttcaattaatcttcttgaatacttccgacgcactcacgaaccttcgaaacgacggaaacgacaagctaacatgcaaaacgaggaaaaagactaagaaactccaaataaacagtacatataaagtaaacaaacatgtagatcatgattttagatgaatttagagacttgaacgacctcattccgatttcatatgaattaattacaaattttacaagattaaattccaattaaacctattaaagaaaagactattccaaattaattaaacaatttacaaatgatttataattgagagaaaagattaaagcaacctccggaaaagattagattatattggtagatgacatatgataaaaagaaccaatatgccattggaaagagaggaaaggatttatatggctgagattaatcttgaccgagtcgaccaagatcggatggcttagattgatctggcaagcaggcctcacgggataccaactcaacgagtcaattctacgtgacacgggatcacccaaatgatcaaccgaaaccggcgaacggaaccggcggctctgaactaaaggacgactcaacacggacgaacgaacgaagcacggggaacaccttattcgaacgaacgagcgaacgattcaacaacggctgcaactaaaccggtcggctagaaacgattcacggtaaagccccggtacgacaaacgatagaccggtaggaatttagggatacacctacggctagacaacttggctaccgagcaacggctaaagcggcggctaggttaaagcggcacacagctgcgacatggcggcactagggcgacttggtttggctaggcggctagcacaacggcggcaacaagcaacaacggcacaaccggtagtgacggtgcacagggcagccggcaagtgacgcggcagcggctgcgctagggttagagcaacagcggcggcgacatgaccgagggattgaaacctaacccgaggggacacggatagaagtctcaccgaaccaaagcgatcggagatagatgacgacggtgaaccggcggcaacacatggagacgacgacgatgctagacagacaatggattagattgaattaagaccctagggataaagtacaccggtgaacgacataggagcggcggttgccgacgaaataatgcaaacggagggcaccgggagaaagaggagatcaaagtgaccctagccaccacttatgcgacgacgaacggcaacggaagatggccggcgacgagctttgaagggcggcgaggtactggccacggaggcgacgactttccggcgatgtgcggcgacaacggaggggtggccgggcttcacttcgcagctgcgaatccaatggaggcagcggcgaagcttggcgatgacgggaggagcagcagggcttcgccggagatcaaaacgcgacggcgaacttcgggttgacggcgacgatggagctccggtggattttggtggcgacgaaggggcggacggggtgcagctccttcttgcgaacctgacggaggcaacggcgagcagcagcggcgaccacagcgacggcgcggggcggctggagacacggcggcgacggcggcgctccggttcacgacgacgggctacctccgattggatttggcgcaaaacaacagcggccggggtagggctcgacgttgcggagccgagggaggaggcggcgctgaccggcgacggccggggcgacggcgaatggcggctggagtggcggccggaggtggagagagagggagctcgcggggagagcgtttccggcgacggcggcggacgggacttgaggggatgaggagaggacgactagggggtcctttatataggcacgggagctcgggtccgggcccaaatcgacgagaaaaaaaatcgggaaagtctagggttttcgccggtaaaaggaaggatttgatctgcgaaattggaaagaatttccatagaaaattttggggatttcttggggaaaaggaagaggagattgaggggattccattcccgcaactaatttggaaagaggagcaacggggaggtcggattggtgggaggaggcggcggcactgtgcacgagcacggctggctcggctctgtctagaggtagaagaaggagcactgtagccacagggaggaaaaacagacttctatgtgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatccagatcatttaatgataaatttattatttaaataattgctaaactgttctttgtattattaaaattaggaattgagctctgaaaaatctgagaaaattccagagagtataactaatcatggagaatttaataaaaattaaatccatccatgctttatatttaggaaattttatttcccacatttaacttcacttgtaaattaatgaacatttaatataaattctattaataatttattaaatgatttataaatccttaaacgaaaatcaggctgccacaggtggtgggcagtgggtgggtctggtcactatgtcaggtgccgtttaatacgtagacgtttaaattttgcaaaaacattatgaaacagaataataataataataataataataatattaataataataataataataataataataataataataataataataataataataataataataataataataacaaaaaaaaattaaggcatgagcaaaaaaaagtttcctttagttaataaataactcaatatgctaagtcatgttcattatagttgctgaatcacacagttaaaatttaactgactcaacgtgaatatatatggtgggctatgtagtagtaaaaatttaactcgcaaatcaaagtgggtggagttaggaggggagtggggtggtgggcagtgggtgggtctggtcactatatcaggtgccgtttaatccatggcacgccacccagccccacccgctgtgcaaccataatccacagttaaaatttaactcacgacgccccacacatgcgccactcctccacacccataatctgactaaaattttaagttgatattcccaacttttagcatatatatacatgtgttgttcccccaccctgcaaccaaccacatactgatcctatttttccagacatgagagaggcgactgagggcgcgacgtcggcgggagggagacgcggcggctccacctccactgccgagcgacggcgggcacggcatcggcggatccagcatggcatggcacggctacaggcgtggcggcgacgggcgatggcgtgagggaggtgaggaggcggcgtatccggccaccgctccgtgccccacgcatgtggatccggccgcggtcgggcgaatccgccgctgatctggcactgggaggctagcgtagcgtcggcggatccggcacggcacggctgcgggcgaggcggtgacgggcaacgatgagcgggaggcgaggatgcggtgcgacggcggatccggcactgatcctgcacggggagacgcggcggctccacctccaccaccgagctgcggctggcgcggtgtcagcagatccggcgcggcatggctgcgggcgaggctgtgatgggcgacggcgagcgggaggcgaggatgcggcgcatctggccgctgctccacaccccacgcgcgcggatccagccgcggtggggcatagccggcgcggctgtgacgggcgactggggcgggaggcgaggcggtgatggatccggcctccacgccgcctccatgcgcacggcggcgacctccgtggtggcgagctcggactccgatggataggcaagaccagtggtgccacctccacgacacgccgccgtcgatgtccggagcaagtgtaaacaaaattttaacttttgctcataaattgtgaggatgtatatgttgagtaaaacttttattgtcataccaagttaattttttacttagtaaggataccaagttaattttttacttagcccgccctccaatgtttttaaccttattcagctgcatcccgtgtaaaatacggttttgtaatgaatacgtgaaaacttatacgtgttgggatgtattttttgataacaacaaattacaaaacaatgcgaacaatcctctgaattaaagaaaaatgtcaactctacaacgatatcatcgcaccctaccacacaactgtatctcggttaaattttaactccgcgagacgggttggttgtctcggtcatggggtgtcacgagttaatttttaactcagcagtgaccaggttcaatcacatatcgttcaaaattcaacaacaactaaatttttaactccaaaaccatgtcatcgtatcgcaccacccaactgtgtttaagttaaattttaactcaaaccaactgaattaatgcataatattaactcctcaacgatgtcatcgccccccaccactcaactctatctaagttatattttaactacacgggtggtttggatgcctcggtggtggggggtttgtcgctgtgtgtcgcaccatggagttttcctggcgcacagcgcctatgtgtcgtgccgtgtagcgcgaccgtgtctataaatatatatatatatatatatatatatatatatatatatatatatatatatatatatatatatatatatatatatatatatatatatatatatatatatgtatatatatgtatatatgtatatatatatatatatcagggttatggataccacatatctaatagtagttgattgaatcttgacaggacccaccacttgatgaaaccatgagcacttgagcaggagcatgaagtcacatggaatttcttctttaaaaatgcatggagggacacctctccctccaaatctccttttttttcctagagtgcttcatatatgctatatatatacatcacttgatgaaatgatgagcacttgagcgggagcttgaagtcacatggtttgtctttttttttccgcacttgtgacagcatgaacctaagcttaatctatgtttttttaatgtactgatgtacaagcacaaaagattacagatgggaggcttgtgggtcagctgctgaacctgaacaatggccccaagctcctgaaccaactgaaactcaacagatgcagcccattgggatctattcctcaacaaagcgagctgttcactgatcttcgttcgctcgtgatttggtgttgcagctgggactccttaccagataacatggagcgtctcaagtcactcgagaaactagagctatttctttgccctcaaatcttgctgcttccagtgctacccctgtctcttaagacgtttcgactttatcgctgcagcgacgtgctcacgagttcgtgccaaacaattggttatgaaaactggcaaaagatcaagcacattccaaacaagcatttataagcatccatacatgttcaatgtaaagtccatgtgtgctcctccatttcttttttttttatttgaaaagttatgctctacggtgattatactgttactcatgttgattctgttttgttgatcaggaagtaattaagcctgtcaaatatactaaatgctgggggcggatcatggtgtgcacatgcacgccaatgcacggcatttggaacacagccagagaagaggacgttaagcatggtggctgagatcagtaagccaaaataaaactggcatggccagattgtgaatttgtgatctttggattatttcttgctaatttcagtataataccgtacattctgtgtttattcattcatttacctgtttcatgtttctcttattattccttgtgttggtcaagcgcatggccgggcttgtcggtgcagcgccctttgtgtttgtggtgttcctcatgcgtgggatgcatggcccgcgtcgcggaggatcatgttgcatttccacagatttcctgttcttgcttgctgttaaataagagaagaaaaactaagaaaagctgcacagttctggtagcacaaaacattttgttcaagtgtttgtctaagtgcttgcttaagtacaggagcgtctcccgtcagattgataattactacctccatattttaatatataacaccgttgactttttatccaacgtttgaccattcgtcttattcaaaaaatttatgtaattatcatttattttattgtgatttgattcatcatcaaatgttctttaagcatgacataaatattttcatgtttgcaaaaaaaattgaataaaatgaatgatcaaacgttggttaaaaagataacggcgtaatatattaaaatacggagggagtatattttctctttacatgtgacttaaaaatatgtgcagtaaaaacgcgtacgaaacgtacaatattttcacattaccaagaacacatgcgtgttttctccctaacatatttaattacatgaaattattggaagcacaccggatgcgttcaaatggtcgatagatatttcttcattcattcatgagggcgtcgggccgtcgcctcgcggagccatgcggagactccggacaaaagacttgtggagtcattggtcaacggcacgtcctgttgatctgttgatcgtgccgttgaccaatatgttttgtgatcgttatttttgacgcatcattttttgtcgctgttgatgatatatagaggactatatacaaaatatatataaagactcgaatatcctcgacgcatcgctgttgatgataaagaaaatctcaaatatagacgacaaagacttgactacttgagtacgtaggtactcagtcatcggcacaatcgagatgcatggataaaaatttaaaagcgcgagtcaaaacttgttctgagtctctcactccctgcagtatgatatatttttcaatgtcttcacgcgggcccttggtacaattttatcgttggtattagatcttcgatagaggaccgtaaaatcgatcataactgaagcgtgtggagttgtgggtgcgtaagtattccataacacacgcgtacatattccctgaattcccgtatgttcgtttctaacccatgctcacatagacggttcatgtttgccgtcatcaccataatttttgaaagcatgtccatgtgtgtctaatatttatgcacactaaaaaaatagcccgcgcattcgtggtggacatgcgtattagtttgtttcgaaaatagttctaacaaaacaaattatttaaggtaaggtatttttgatttttttaattgagtgttcattatatcttttttccttgaataaatctcgacaaacttttattgtttttgttggtaagaaatgtattttttaccaccctactaattatatctttaattgcttcacatatatgcaaattcgttatgcatgtgaaccaataaagatagaaaagttctttaaaaaatatttattgtattttgaatttagtgattgagtgattctaatttcgaatttatattcaaatcaaattattgttttattctaaattgtatttttaggaatttgaaattgtacttaatctcgtaacgtgttgtatttggactcttctaattttaatacttattttattattccaaatttaagatatttataacttatacttttatatagactcttgatattttatattctacatagtatcttgttatgttttttagttttaatttttattttatttttaatgcgtttttaatcaaattgcttgttttaatttttttctgaatttaattacaaactccttgtagtaatccagctgtcaccatcggcctcgcggatcatcttgtcggccttctcattagtgagcctctcttgatgtattggacatgatgtggcaaggctcggcggtagagatggaaccattttctagtctttgtcaaagacgtggaacgtctccctctgcctctcctctcagtccttgcccttcacctaatcatctagtacgctgttagacctaggaactcgtggaagtcattgatgtcactgtcgtcggtgtccatctctccatcagtttcaagcccaaggcatgcatcatggttccaagctccttggtggtgattgaacatggattttagactcacatatttcatcgctttcgaagtgctattatgctcaaatatttgttgtcagaatgaccgcactatctaacttctatatagcaaaatatgggtaatatggatcttggattatgtatttacttataaataacacaacaaatcaaataattgagaaaagtacatttaacttgagagtcatgattatttagctattcttttatatattatgtgttagctaatagtatcctagaggtgagtaggagagtggagggagtacgtacgtacgtgcgtgcatgctcacataggtatttgctcagacttttaaaaaacacacacacatatacaatatctactcagggtgcggtataattaaaacacatctaatgttagtaatcattttattgagagtggaatcatcataaatcttcatattaaatctaacagttttactatcaaatatttaagaacatataacgtgtagtaaaacatttcttttcttttggactaagcatttcataaattattagaatactggaaatttaaaagttaggccaatgttatccaatatactataaacaacttcaagggtcgtttatatttttttcattgcaatggaaaacctatatgcacatatacatgtgcgtaattttacacacttcttggagcatttacttttaaatcaacaataatatagatataatgtttaaccccctaactatattttggttgtcattttttttggcctgtcagccttgagtaaacaggcacgtaatatgttagaatcaaatgagctagacccaatttaatcctaataaattttatagacctacaattaatgttaacaagattaataccatcttgaaaaccaacgagaaagaacctcaacttaaatatgctgctatatgagagcacttgttgagcgattgaggtggtggtgagacttccacacacgcgctgggctagtccatgagcgagggtgaggcgtgaccagcgggcgtatggggacttgcctgcctccctaatgctaccttttgttttgatgaacaaaggcataaccgacgggtgacattacttgaagtattggacgataacttaatgcgcacacaacgttatctccgacgggtgacattacttcaagtattggacgagacctcaatgcgcacgcaacgttatctcccctactagcatgtacaaaaacctctcttgattctaagcactttgagcacacgagtgttcaggacaaggttatcttccccattgggaaagacataaacctctctcggttctaagcacttgcgcgcacaagtatttgggacgagcaggcttccagaactccattcgcttgagtacgtacacaggttagacgagcgatcaagtttttgaggagcacgttcttcacacggctgctctcggcactgcatctccttccactacatcaacatgtcgcccgtaacctgaatggcagcaacggaggtggaggcgagaatgacaatgacaacggcaatgaaggcaacaacaccaaccatgcctcatccagtaccagaacatacactctctgggtatatcactctattcaccttagtattaaacatgttgctagatgatgctattactgttattagcacgttcatgtttacatacaactgaatcatcctattatatacatgttttgcttattatgtttttttgattaaaatataccgaatcgtaactatatttccaatgtatagtaacatactggtatatatttcacactaccaaacaatgaaacacgcatgggtgttttctctgaacataaccaattaatcattgaaacaccggatgcgctaagaaaaccagccgcccacagctaagccaaaatgctggagatgtcattgttccaaattgacaattttgcctactaagcacgtgggccctgcaaagactctggacagaagactttagatcaagtcaatcaacggtgatggattcatgtctccggtctccctagagggatttactcaagtagtctaaaaagttataaaaattaaaaaaaaaagtagtaatagaaaattagtaagatcacgacgagactacggatcatgcaccctattctttttttttctaaaaaaccgggcgcccatctctagctagtaaacctgcacttcactccctgtcaactgtccacttgtacgcattccattccctgggatggctgagcactactttttttttatctgacacgcatgcaaaccgtatactcccttcgtcctatagagaaccaatctattattggatttaatattttctactacaatgaatttggacaggagctaaacaaatctggacttgttcctgtccagattcgttgcactagaaaatatctcatctaatattaggctggtttttttgaactgaggaagcatatgtgtctttttagtcgcatgcaataacattcaaaatgattgttattttaaactattcatccaatctaaagatctaattcaaccattgtatttatcgcaagtaaatttttataacaatatctcgcatgactattttctgataaaaatattattttatatttttagcaaaggttctgttttttatgttgcacatcatattctttatatatttcgatacgtacttcctgatgtttcactaggacgtttgcagttgttgcatgtgatgttctaggtgttttatagtaagcattttgtgatatttcctacaattaaattttccaataaatttaagtatttgaatacatataatatgttccttatgaattctttttaagtttcattagttgggattcaatgttaatttcctgcggtgctttttgtggttgttgcagtatgacgtcatgaggcatttttcacccttctctgttggttgtaggagcgagaggctttggcaaccggccgcaatatgcctatttcaccgggtgccaatcccatctatgtcttggatgagatcacctaagatttcataattggaagtaaaacaggccaagagcatgcggtaggcgccggtagggggtttggtggcgatccaacacatgtacttttttttactagaaaaaatgtccgtgcatatttaacaacaggtgaagattattttatttgtattgttgttatacggtctagttaagatgaaattcacttagatatatatttttttagaaaatcataagctgcaattagaagtccgatcgtcttagcatgcaagtctttttaaaaagaattcttatatgactctttctatattttcaaaagcgaacgaacttaaaaaccgacttaaatacggatatgtatttctaaaaacgatcgaacttaaaaaccgactcatacacgaatgacttattaaagtaccggcaaaaatatttttaatttttataacagtagagatagaaatagagatggagatagagatagagacacgtaacagtacgtaaaaattagagattaggtgggatatgatttggcttttttaatctaatccaattagaggatttgccggttatacctttttttgacatgcaatacgtacatatgcgaattacgtacttacgtgttagagataggagggtgtgattagccgggatgaccatgaggagtgattagtaggattttttaaattctaatccaatggtcatctattgatttactgaaaaatccagggatatgtactttttttgtcaaaatttttagaatttctaggctttgtatttttagaaaagatagatctaatggtctaatacatatttaagtgaaaatcgatgaacaaataattttattaaaaattacgtgaaaaaaaaggtaggtcaatatttgtacattcgttcctacttaacagaaggaaagatgagactatgtaaggaaggagtttggttcggttttttttgagaaatctaatctaatatagtttataatattagacccataaatttaagtgaaaatcgaggggtatatgttttgtttttttctcagagtttctatatatgtttttctttaatttattagagtgccaagtgatggcttgagattgttttgagaaagtttgatagactttataatagatagactaagatgcatgggtgttaccgcactctacacacacagtattgccccgtttttaaatatacgcactagttgagtctatgtacttttaaccattcatcctaattaaaatttataatacaaatataaaaaagtagaagttgtgcttaaagaacctttaaagataaaataagtcataataaaatatattgtatttatactaaatttctgaataacatgattgatcaaacgtatgtctaaaagttagctgtattactctctccgtttcaaaatgtttgacaccgttaatttttcagtacgtgtttgaccattcgtcttattaaaaaaattaagtaattatttattcttttcatattatttgattcattgttaaatatacttttatgtacacatatagttttacatatttaacaaattttttttaaataagacgaacggtcaaacatgtgctaaaaagtcaacggtgtgaaatattttgaaacggagggagtaaaagttacaagcactttaacacatacatagaagatacactgcactttaacacaatagagaactatagagcataaagcttggcaccggatgtacgtagtaaaggctattggtgctcatacgttttgagctggaccagtgggtcgctccaagatgccaccatgtgcaagcaaagcccagagatgtgtgatgaactctcctccccttggcagggtttccaggtgcgctttggcatcattcgaaggtgcaatgtacagcatcatctctgcccagaaatcacacagcaccttccatctgtcccccgggtgttcgatctcgatgagattgtttgcgagccgaccgcccacaacgaggagacggttgtcgccatggtcctggcttcttagcgcttccttccgctgctgcattgttttcttacccttcagcaattcgcgggcttcctcgaccagggcgtcaaatatggattcggagacgaagctatgatccggtaacaattccggagcaaaggctactaggtaggcacagtaccttgacaagctacaagctacgtgctgattagtagtagtagtagtactgtctattccatgttgatcttcgtcttccacctcgcaaagagtagtggcgatgtgccaagccattatgatatgtgttgtagttgggagtgtggtgcatgaccatgaaagttggtagtatacctcgttagcgtgcagagatatgacacagtttcccagttggccaaggcctctattcttcttcagggtttctataacggttttctttacatccatggataatctgacacgcttatcttccttgcggcccttcttggtcttattgaccaaggagaaggtagcatggtacagtatgttcatcgatttgtagtcaaaacttttgagcagtgtgtactgaccgagtttatcttcccagctccggaagtacctgaggctcgtgatgcatccaatcaacttggagaacaatacgctactgttccatgaatctgtggtaacatatttcgatatcatggctactttgctccaggccgaggccaggtatatgtacacctgtaaaccctcaagcagagcgattgcgatcgctgtcacggaggtgaagagagcgtcgtagttcctgtggttagcattgacgaggaatttgagctcatcttcatcgggtacccggaggaaatgctggaacagcttgtaggcaagccaaccgcaggtcgggaccatggcaaaagacaacgtgacgaacagatggtgactgctatagataaggaagtacttggtgtagaagtagtcgtgcacaaaggctaattctacctcgatgaccctgaaggttcgttcgacgcacctgtcgccatggagcaggccaccgaagaggaagtcgcgggtcttgtggagatttgattcggcgagcacctgaaagccggcaaacctgcggttcagcatcttggacaaggccatggagaggcacacgtccttgagcctgccgccattgccaccggagagcagactcccattgcagttccagatatcttgaacggtaacgagctttgcccggtcatcgtcgttgtacctaagatggtactcgggaggctccaccctaggattctgctcgtcctctcctgcaaccacatagtggtacccttgcatgtcgacggcgtctcgtcgttggaccccgtcgccggcaggtcgcaggtgctcgtagctcatgtagtctgccacccatttggtactcttggagagcatggagcttctactggctagcttgaacgacgcgacccgtgtgccggatttcaatatgactatgcagtatatgacccatagaatgtactggaaatccgagccaccagaggaaaccaccagccaacccacccagaaagactcgatgagctgcttcaagtagaacctcttccagtcgtcgttgtctagtaggctataagcagagaaagaatcggcgctgccgaggaagatgaagaggatgatggcccagacggagaagaggctgttcttgtaaggggacgactgcatcagccccagggtgtagctcaccatggggatggaagcagcgtacgccacccagatggtcattttgacagcttcacagctggaccgccggcggtaggagccgaggatgaggagcacaaacagcccgacgacgcccaggaacacgagaacctcgatgcggatcaatcgcaactttgggctgttgagcccgtgaaccatatcgacgagtgccatatatacgtaaatatgctatctaggcctaggtgttggtgtactggttaatatataggcagcagttgcacgaaggatgatagccctaccagctgctgctaggtagctagctaggtcatcgataattatacactttatccaaccatcccccctgccttgtccagaccatctgacggtcggacccacttacacataacaactccacttacaatttcatttttattttcattctcgtttcgtacaaaagggttaatatagttgaagggacaagctcttataagttgattccacttttactaaactagcaatgtggtatgaaacatacatacacagcttacatgcatgtaccacacatttctaattcaaattgggccgtgatgtcacactgtcctaatcgatctcttaacttttgcccgatgttataattaggaactgaagacttgacgaagtcacgcgaggatcatttccgaccttgcacactgaccctcgtttgtacctcagttctattaattaaggggcaaaacgtacagtatagtgctagggtataagtttcgcctcgttctttttaatcactagctctattagatttttatggacacgcttccattttctgaacacggtacgtaccgttgaatccaacttcttaactagttaattaaaaaatttgcaactttccgttcgtcacatcaattattttttatttgtaagtgcgaccgagcgatggcctccattcccacacacgtaagtaacacatcgcgtaaagcggatacaacacaaattcaatagatacaaaatctaattggacaattcatatgatatttcacactattgataatatattataaaaaataatgatcaaattataaagtttgtttaaaacttagacaaagtataatattggagactatgcagacacatattgtcacgccccgaactagccccgagcggaactagcccgtgacgctccaaattaacctgttaatcgataccagtcccaggaaacagtgctggtatcacaggaagacagaatatcacagcaacagatgtctctttattatagagtaggagtatagtcatgttgggctgcggacagatcccgagctcacaactgcattacaaaagggaagcagaagccaagacttggaccaaacatcacaggcgcgacttgggaactaggccgaaaccctaaaactcatcgtagccgacttgctcctagaagaactcctcgtcagcgggatccgcttcatcttcttcagcaactagggaggattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaaggtatcagttttttatgaattgatcaaggttggcatccggccaacagctttcaaacggccacccgggcctggctgatcccattagccgcaaattttccaaacatcgaacccaaaccacctcagcaaatttcacaaagcagtagtcaaacaaaactacactaggaatcacctcacattcgcccatgaccatgggcacggctattcgaacagtttaataacctctgcagagggggtacactttacccacacgacattactaacctggatcatccagcccgtgcagaacggccacgactagagaccttaaggctttcatgacaaggcatttcgaaagccgacacaggttcaccatatgccaacaagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccaaccatgtggtcgcacttgtcttatgttcggatgaaattccaaggaaacggtccttaagtgcaagagcgggaaaccgtacacccggtacgttccccggtccccgattttttggaaattcatttagttcgcaagcaccgacccaggtgtcgggttttccaagtcttttgtaaaacccaagttttacccatggttggatattttatattttgagggggggtgttccgatgcgcgtacccgaaggcccgttaacaaggaggtttaagtgttcaataattcaaggagggtaattgcagcaattaggattggggccggcaggccgtctcgcaagccgcggccgaattacttgtgtaaatcctattcatgcaatatttgcagaaaagaaatacttagatttaaattataggtgcaagatgatcaaaggtgacttgccttgctcgagatcttgaacttgatcttcgaaatcctcgcactgcgggtcttcgggctccgaaactacacgcgaaatgggacaactcaacaaacggcgaaaataaagccatattattgacctctaggcgtgtcattagatagatctcgagatttgaggagttttggaagttgaacggagtcaaacggacttacggttgggaagattttgaatttctaagtttattcgatttttggtctaaaggaaaaggatttatttaaatcctttttgagagaagaaaagaaaagaaaagaaagagggaggggaaatagacttccctcgggcggctagggcgcggcccgagagaaaggggcggcttggccaagcttaatgggctggccggtccaagaaggcggcccaaggcgcgcgcgcgggcggggaggagagagagagagccggtgggccgggtccaccttgcgtggtcccgggtaggacccgcttgtcagcggctcggcttaccatgtggagggagtacgcggcgcggcgctagggtgtggagcggggcgcggtgcatgcgcgtggctcgcgggggtgcggatgcagcgggcccacgcgcagcctcacggctcgcggtggaccgcgcgcgcgagcggggcggagggaagcggcggaccggggtcagcttgacccggtcgcggccgaggtggcgccgacgtggcgcctacgtggctgccacgcgggccggcgggaggtagatgacgacgtcggccggaacggacggcggacggcggcagcgagcggcggagcgaaccacggcgatacaggcaaaagcgagcacaccgggaggttgcacgggacgaggggagacgagccaatgactcggattcgccgggggttgctcgactgcggtggattgcggcggcggcaaccggcggcgagagaaggggggaaacggcgacggcgcgacgggagaccaattcgggcaagctagagcatctacgcgactccgggaatccgttgctagcgtcggattgggcggagctacgccgagcgaggccggcgacgagcggcgctacggagcataggcggcgacggcggcgagcacacagcgagcggcggcgagcacacagcgagtctaaggggaggagatggaacgaggagggaaaacagagggaggcgagcacacaacggtcggggcggcgccagctagctacggggaggctactcgtgctactacccgagtctaaggggaggagatggaacgaggagggagaacggagggaggcactaccgtgcggggtgatggggagcagtgacgaggggccgatggcacgggagtgatctctccggcctcgggccggggaagaggaagaagacgagcacccggagtccccttccgcgtcctagcgcgcaccggctcctccggcacacgcgacggcggcggtcggcgagagagacagagggacggcaatggcgcgggcgaaaaacggggaagattgggagggaaaaagggaagggagggcgcctgggtttatagggcggcaatgtcggtttggaaaccgaccttgggcggtcaaggcgcgagctggcgctcggcgctcgcggccaaaacggcgacagaggcggatgacgccgacggggaagagggagagagggagagagggaaaaaggaagggagaaagggggcttgccccttgcctctttgggaaaagaatgagggagagagggcgatgaggaggagccctgcctcctttccttggaagcacgcgcggggagaggcggggccgagtcgatgacgacggcgatgacggcgggggcggtttggaacggagcggcgacacgggcggcaggcgcgggctcaggcgcggcaggcgctgacggcggcggcgtctggccggtcggccaccatggcgcgcgcgcgcgggaagcaacgggcggcgccgcgatttcgcgggcggggagctcgcggggatggaggcggggagagggagagcgagggggaggcgctcggcgcggctcacgggcagagcggggagagagggagagagagagagagagagagatgaagagagatgggccgagaggaattcggcccatcgaacctgagggaggcaaaacagacttttgcggagggatttgatttgggacggatcgagattcgggatttgaatttgacgatagaacggggatttgagatccggactgactgcaagcgaagaaacaattttcgcaattagggtttttagaatttaattttcccgcaatgcgccacgacggaatgggcgctacacatatataatatgccaatatatttttcaaagtgaggttgtatcctctcttactataaagttataactcactaacttttaaagcttaacatgcaaaaaatactacatcatcatacactaacaagatgctatatcattatcatccactaacaaccattaaatttaaacatcatgcaaacatgctatattatctataaacttatatttaacatgtgatcatcatttcatataattcacataatatttcaatgtagattttcattatttttttataatatgctatgtacctgttgacagagtagatcacaactaggttatttgcagaatatggagatcgttgttgctacgatatacgcgagattgggggtaaagatacagagacaaggatgtttatacaggtttgggccccttaactgacaggtaatagacctactcatattggtcgaagccagtattgctcttcttcatcagaatcaaacaagtacaatatttgggataacatatctagtcatcattgacttgacggcatggaacaccacacgtagtcgacgacggaatagtcttcctgctcgaatacaaactcgatgacataagagatggcatttgagtctgtctaggcttgtctccgatgtctatgtctggtgatgtgtattggtatctattctcactgagcgtgtttattatggttaggcttggcttgatctcccccctctcctcctagggggcttgtatttataccacagatgtcccttgtccaaatagaaataggaagacaaaaatggatacgatccgagtagtccttgtagtttccatgtagaactctgcttctccttctgtataaggaatattttccatatatgaggcatgattccatataaaacttggtatatggtgggccccgctaagctcaacctaaggctattgggtttgccttatccataacactggcagtacctacatagttcatcctcacgtagttaatatttttttctcttgtttcattaagccatatcacatcaattgtttttagtgcttaaatgattaatctatggtccaaattatctctctcattttcttctctcattagtccatattacctcaattatctttaccctttagatgattaatctatggtccaaactatctcaatacttttcttctttcataaagtcatatcaccttacttttacatttgaatcatcattctatttactatttaaatttaatttatcataaacctcattaacttacgtaattgttaacggaattttgcatctgattcggagaaggaagaagatcgatcggcgaagaagatggcgaagccggcgtgcacgctgatggcgagggaggccgagaacggcatccatgatccaatgaaaggtaggcatcgtaccttctgttgtttttctgttcgcttttcctttagatcaaaagcgatgggtttccttctttcacttcgcgatgtacttcgcgagagcgaaagtgctcataacgtgttgaaagtggataagattgattgagcgagagaaagaattgaatacaatagagcgaaaaacaatcgttaattaatttatattaattaagttagatgaccagataaaaaaagaaaagtgtgtgcatgcatagagggtatcgaactttggagttcgatagcgtgtcaaacaaccgtagagttcgattgggttgtttattagataaaataattcgaagtgcatacatgcatttgcatgcaggtcctatcgaccaatgtctgtcgataggtcctgcacacccacatgcaacaacaggccatttactggtctatgcgcatgcattgtacttttaatattttttcaccataccaatccctatcgaacatacatattgaacagtgtttgtttgatatgtacctaatagaacatcagtagcaaaagtgggaccagcggaggggcctgtcaggtgatgaaagggagccattgtaggtggggccgatggagaagtaaagaaagagagataagaggaagagagagaatgacatgtgggcctcacaggatgactcagcgggatagaataggtcaaagcgttacgtaagtgaaatcgtgttttacatggctactgtgtgtaattctttttcttgcaaaagattcgcctatgcaggtgtccaatcggatgttacatgtatataacgtgattttttttctaaaaagaaaaagaaagagtccttatctacttcaaattctcatattttttattttattttatttcaattaatatgagaatttatagaccttgagagctacagtggagacttttttttctattactttattaagttaattaattaataggtttatgcatctcataggaagacatgagccatcgagcccattagccttctgttttccgcaacgattgatacttctcgcaagtttcttcttgaagatgacgtcatgacggcgaatatattccagcgataatcagctgcggttaatttgttctggcaggtcggcaccttggccttcagtagttcagtgtccgagggagattccaaaaccaagttgatcacggtggaattacggacgatgatgagctactagctcttgattgttttctgctttgtattagtggatacttttgctgatatactacgcgaaagctgtcaactttgacgccggatttctcaagtagcttagcatggaactggacaacgttttgtctcaaggtgctgagatactaaacatctggacagaaaaataaatgactactagtgacatgaacatttaaaaattgcaacttcccattcacaaggcaacatgccaattgtaaattgatgtttgacaattggtttgctaaagaattcgagttggcgatggcacttcaagttgggacaactctgtccttataaaactgatcatcgagactgtaccgttatatgaacaagtatgttttttcccccattgactacaactcatttgagtctgcaagtcaaatactgctgtgagcaatcaagaatctgcattctaccctcctgttatgaacttttttagattgtaaagactctttcctgcccaaaaacgattccattagttgagatgctcttacactcatatattaaattccttacccttccataactaattttgaactattcaacaatatcctcttcatacattggtgctccccagccattcattgccccttcacagtacactgatggtccctcgagtcatcaatctgaatgtaagtatcctcctcctcacggccaccgaagagctccgccataaaaatcgacgatcgtgcggcgagcacgtccgctggcgaggaggtcgcggagatgccggtgcaagtccggtggtggcaccaccacggacgacgatgacgccgcctcgcgacggcggtggagggcactcagtaaccacggcgatgtcacacctgataccatagccctaacgttatttgtagccatggacaattaaaggagaaaggtcaccggcgacgatgggggaattttcatgcggaccatgtggccgctcccgtcgggtatactgaacacgtattctgcggtgacgacgtcggcggcgtcggccggtcgaggtagaggaagacagatacccagtcggcgaactcccggcgatcgccgtcgggtagtaggcgacgtatatatataccaggtgtccaggtgtcacccctccgtcgtggaacttacaggagttgatgctcttgccgacgccgatccctttggttctactgtagccggcgacctggatggtgactgacccggtttccattgctctcttgctgtcgatggccgacgacgacgtggttttgccgccgtcgccggtggcagacttggaagttgtgagacccattagattttcaatcaactttgctatacgtccgacgcatgtgtccgacgcttgtacgactgaaacagtggaaaaacgagcaatgacggcgtcagatatgactacgggtcgctgggcctcgttgttgtttgcttgcgtactgggctttctgtacactggggccagtctggctgagaacatgtatcagcttaggttgctattaaaatgattcactccagatgttagattagtttagacctttaggatgtgaaaccaatatattctcacagccataacatgcaagtcctctaaaaaaagccataacatacaagtaaaaaatgattgaccagacctgtgaaaagcaacgcaccacggcttcaatttccatattcatggccaaaatcagttcattaaacagaatacaggtagagtgacattcaaaatacaggtagagtgacatccaaaatcacaagcatactgtctaacattgaataataataaactagcaaatgttgtttagttcgtcgattgagatcacaagtaatgcaagcaaaaaatcattctctctttcatccattcatatgctgggatagaagctccgtcaaatcaccatttccctgcaaaagtaaaaggaacagagcaacaagttaggggaaagtactatgcactgatatatactagaaggcaacaatgaaaattagcacctgaagaagatccatgtaagaactaatgtgagatggtggtgccgggtgatttgattggagtccctgtacaacaatattgtcaaatcaattacagcaatgcaaaattatgtatggcaaatcagtcacacaaattacctgaaactcatttgcagcaaactctgcactgcctgcctcatatgctccaccatagcaatgatcaaaatttacctaataatgaagtgcatatattcagaaacgatagagagatgaaatatttcaagtacttaatactactgaatagaatatgctgtacacattttaataaatatattacctccatttgtctagagttctgaatattgataagctgtttatcttttgatataacatttttggtccttgtctttctccttcttcgactttgtacttcaattgtagattcttgttgcttcttcattctcaatctccttaccacttgatccaattttgattgttttctcagtgaaggaggacgacctcttctacgaactgatattgggcttagcaccatttttccttgtttcagcaccatatctttattcttcccattttgctgatattcctgaatttccttgctgccatggtgtgcatcaatctttatttgcaattcatttaggccatccatcactaaattgcacaatgcatctgaaactgaaccattctctgccacttcattaaaacgcttgcacaacgtatcaaaacgcctaacaattggcgtgtcaagctgatcatcataggagcatttaataaatgtgtgcttgcgcttgaaatcctttctccatcgttgtagtatatatttggaagggactttttctatatcaacaagagggagtattgaaaggatatgtctacacaagatccctcggaattcgaaatgccgacattcacaatgcaagtcacaatcctcttggttgaacaaaacaagtaactctgaaacaaccctttgctctccaatttttcggtcctctctgacactgaaagtatgaaccaacccttctgtcttccgaagagttgcatagtagtagattttgcctcttagctcatcctgaaactctttaaacttcttgttggtatatgccacctgaaattgcctctcaaattcatagtgagtaatgcaaggaattgcctcttggaatgatttacaatcagacttgttttctttctctactttgtctcttagtgcattgtcatattgctccacaaattgcttaagtgtggttctagcattaacataaccatcaaagaaggcattcacactctcactcctttgcgacgaagacattccagcccaaaatgtgtctttcacataagccggcacccataattccctgttatcatataacccagcaagccattcattatcctgtaagctaaattcatcaatcattttcatccatcccttatcaaaatcatctctgtttaatgaatcatacaccacattagacaatgtagagctaataacttcatattctaagtacccaccaagtttttcaggaatcttcttcatgatatgcc

SEQ ID NO: 74762 - DNA, 4228 bp, Oryza sativa
gcacagatataaacgaagtggaaggctccagagtcgaacaaaattgtagcagggatggaatggatgagaaccgtaccaacgatgacgtctggagttgtcagcacgtcctcggccgtcacgtggttcacacgaccccgaatgacatccttgccaccgttgttggggcggggaggcgcttggccttgctgacgccttggcttcgggcatttatccgcaaagtgcccgggctcgaagcagttgaagcacagacgctgctgaccttgagcgtccctgcggacttgaacaggctgcacagttggcgtaggaggacggggtgcacgagtccctggttgattctgctgctgctgcggctgtgggacgcgcaccacgaattgaggtcggggcgcggagcgagattgctgctgctgttgttgctgctgtgaggaggatccccctgggtagggattggtgtagcggaccctttgattagcaccctgttgattgcggaagttcgccaagcggcgcttgtgcgactccagctccttgtgcttggcctccaagcggatgctcttgtccaccagacgttggaagtccgggtagtccccagagactagacgaacggacagctcagggtccattcccgccagaaacttctcttgcttctcctcatcttcccgcacatcctccggagcgtaccgggccagattgttgaactcatgcaaatactccatcacggagcggttgccttgcttcaactctcggaactccctcttcttaagagccacgactccggcgggcacatgggttctccggaaagcggcggtgaagcgagcccaagtaatcggttgcccttctggctgcgtagcctggaagtggtcccaccataaagatgcgggcccctgcagctggtgggcggcaaagatgactttctcttcatcactgcactgcacagtgtccagcttcttccccacggcatgcaaccaatccaacgcatccatggggttgttggagctcgagaaggtaggtgggcggatgcggaggaactcggcgagtttagagtgttgtggaggtggtggtggagcattctgttgtggcggattttggaggtggtggaggaaagcagtcatcatgttggcttgctgggcgaggatttgggtgagaatggcgttggtgtctggtggtggtggtggtggcggagggggaggtggaggtgggttgccctggtggttgtggttgctgccttcgggttggttgccatcaccggtaacagcggttctcctggtcgtcaccatctgaaaaccccacacagaaccagcaaacagaaagagctaacaattaaaactaaccacccacgactaccataattcttgaatttattactgctattaaattggttcattaaagttcaggttgcttaagcaaataaaataaagacaggctccgacacagttatgccacacaccggcataaccatgccccacacgactcaaaaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcaggctcggcacgaggggtctcgacgaagcaagtccacgccagggactgacgaaccagctcgggcctggaggtgctcttgcgggcagtgatcttctggctgcggcagacgcggcgacgcttggggcggcagtcctctccctgggcgatcttgagctgctgcagctgcgcctccaccgcgtcgaggtccttcttgagctgcaggttctcttgacgcagctccaggatcttcatgttgttctcgaccatcccacggtgcaccatctggtggaagtcgatacgagccgcgtcgtacgcctccaccatgcctgccaggtgcacgatggtagcgtcattctccgagctagcatcccggaaggtggcgtagtcgcgggctcctccgcgacgagggtggtagcggtagggcgagtgctgcaactcgtccgggtagcgctggcgaagagtgccgatggcgaggagagcggcgttctggcaagcggcggggaaggaatctccacccgcggtgactgccagcgaagtccgctcgggagagccggagaggatcactgtagtgacctcccaaccagcgtggggctctgcatcctcaccctcctgctccgggagcggcctggcctggtaatccactccatgtggataccccaggaccacgcacatgccccgcagctccaagacgaaaccagtcatgtccaaaccacgacgggtgacgctgccggccatctacaaacaaaacaaaaaaaacaacatttcaaaggtcagatttttggcgataaatgaagcagcaagacagagagagactagacaattttcacaaataatcaaagatttttatttttgaaaatattgctaaggcttgggatctacggctcgtcctagggtcaaatgtggctctgataccaacttgtcacgaccggaaataacccaacgggcgttccttacgtgcgtgcattaatccttgtcccaggaggcaaggtacaccaacagttgatacaaatcagagtttaacaagcggaagcgtaaatatatttattacacgggcagcgaaggcccagcacacaaagacaaacgggaaacaacggaagactagggcgacgaccacaggcgcttgacggcaggcacgagctagacaccaaagccttcatctccaaggagctcctcttctggacttgggaaaaattgagcaagactgagtacaaccaccgtactcaacaagacacacccacaaatgcagaataaatgcaagggagtacaagggaatttataataagggttagcgttgcagtaaacagcatttaaagacgtttagttgctcaaagctattttgtaaacgcgatcctagaactatacaatgttattaatcaaggccgtgaacccacacgaacctgccttaacccaaggcctatgatgattcagaccgaactggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacaataaaccaacaattccaaagtgtccaggtgatgagaatatcccaaagtctagagttgtaaaaccacctaatgttacctaattaaacagcgaagcatctacctaaaatcatactagtggtaccatgagtagagtatccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaatgccggcttcaacttccacgaagagcggatcttccgaagctgcagcgtctacacgaccaacggaaaagaaaaggctttaactctaataaactccatataacaagcagaaacaaagcacaaaaatgggttcttggcttcttaagaaaaaattaaagacttgaacggtccaatt

SEQ ID NO: 74763 - DNA, 1813 bp, Oryza sativa
ccggcgagctctccgtcccgagccggccgccgtcgctgacgtcatgccgacgtcgtcatccagggctgacgtcattatccttagggctgacgtcatcgttcccttttcttttcctttttccttttctctaatagtttaaatctttggaaaatcatatctaaataaccgtagatccgttttaggtggttcaagtttctaaatttttctaaaataaagatctacatattaaaattgtccatgaattgaattaaatttatttaattctttttaaatgggctttaattagattcaatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttctgtcgttgcgaaggttcgtgagtgcgtcggaagtgatcaagaagattaattgaagactgattattgcaaggcaagtcacacagatcctaaacacaatcctttgagcatgttgatcctatatttaaattctctatttatttcaactgtgcatttattttcgaatgtcactgggtggtgtgaacctattcctttgttatggccaatttgaattgaatatcctattccttgataccttgggtaataaattgattagcttgaaccttatgtattggtttggttcagctaaaagttatatatatataattgcttagcaatgcttagaaacattagctcactaatgggatgaatcatatatactacattattatttatggttatatttaatggtagctcacgatggttaatcgtgttatgataattaattggtaattaaaatatgattaaggtgggttgtgagcacatggttttgaaggtcgtgctcatggcaattaaggaccggttcgcgagctactgttgtgaaacatttaccgtaccaaccacaagccagcatgggcaacggctttatctcttgtatagcatgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacaacctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaatagtttgcttagctcctggtttggagattagatctgtacagccgggtatggttgttcaggatggttgggcctgtgcagcatgggtgtgctgttcagtgttgattaaaatttctgattaattaatttactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaagaattcagaaggagaagacgtttggcttatacctcagttgagctgcctgtgggagtggagctgaagccctcgctagaccgttaattccgctgctgttttcttttcttttgtaagtatgtgatgttattattatgatgcatttg

SEQ ID NO: 74764 - DNA, 804 bp, Oryza sativa
acgcgtcgaggtcttcttgagctgcaggttctcctgacgcagctcaagaatcttcatgttgttctccaccatgccacgacgcaccatctgatggaagtcgatacgagccgcgtcgtatgcctccaccatgcgtgccagatgcacgacggtagcgtcatcctccgagctagcatctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggaatctccacccgcggtgactgccagcgaggtccgctcgggagagccggagaggatcactgcagtgacctcccaaccagcgtgcggctctgcatcctcaccctcctgctccgggagcggcctggcctggtaatccactccatgtggatatcccaagaccacgcacatgccccgcagctccaaaacgaagccagtcatgtccaaaccacgacgggtgacgctgccggccatctacaaacaaaaacaaagaggagagcaacatttaaaaaggtcagattttgttgataagtgaagcagcaagatggagggagaatagagggttttcacaaatacgggggatttttatttcgaaaatactgctaaggcttgggatctacggctcgtcctagggtcaagggtggctctgataccaacttgtcacgaccggaattaacccaccgggcgttccttacgtgcgtgtattattccttgtcccaagaagcaaggtacaccaaa

SEQ ID NO: 74765 - DNA, 646 bp, Oryza sativa
tcgtgacggtttggatccgaatcgaactcgttttgttttatctctaaaaaccgagttcgttttcttcccgattcgattcctcccgtttgcggcttgatctcttcaatccgagctcatataaagcttcctcgtgtcctcctcttccgtttgccccctttcccgtgctctcccgtgccccgtagcgtcgccgccgcgtgcacgaagtccgccgccgccgccggccatcttcggcatcgtcgcgccgccgtctccgccgtcgcctttggtcgccgccaccaccgttaggtgcgccgtggtgtggagaagttcggccgcccctccgttttcgccgccgaccaccggagcgccgtcgtcgccactaacccgagccgccgccgccttcttcttcgtcgccggccgccgtcgtgcatcctttgactacgtggtgagtaccaacgggttcgcctcgttgccctctacgcgttgatgccctccaatcccgccgccgatgtccctagcgccggcgagctcgtcgacccgagccggccatcgtgctgacgtcatgccgacggtaaccctagggctgacgtcatctttgccagggctgacgtcatctctctctctttttcctttttcccgattttctaatagattaaaacttcggaaa

SEQ ID NO: 74766 - DNA, 20938 bp, Oryza sativa
cccttatatgaggagacagagggagtagatggcactcccatatttcaaaacctgtctaggaaaatgtagttgggatgtttttagaaaataaaggaagtcatacccttttgtacattgttgtgccctgaaccagggctggaattaggagatccacttttgcaaaaagatcttgacttcaggtctgccacaagctgatcaaataaagggattcaggaagaaacattataaagtctgtcttttttggtaaaacatgcacaaaataatagcttacttgttcccaagaactgttgaccaaggaaagtgtctcattatgagtcctctgcttctcttttagcccagcgaatttattttcaagagcacgatactcaaacttgtgggcttctagttgctctgagagcttttggtttttgtatttgagtacagtaaaatcgagctgccaaacaagacaatataagtaggcagtgtgcgaaatcaaaactaaagatatgtgtttggcaacaaagagaaatcactaattcaagcataaaaagaaaagctgaaccaacattcaagtatcttttatttacaacttgaagaagagcagagccaaaacagaacataaacacaaaaggagccgtactgatgatatcaccaacatgataaataggttcatttcatgctacaggacaaaagaaaaaaaaggttttgtgcatggatattccatattggaccaaatacggtaacacatgagtaaacgcataaaaggtatcatccaacatgccattatacccttgacctatccctcccaaaatttaaccaatcttttcccatatttccctcttgtaaaattaaataacaaagtaggcgaataattgccagttgtcaccggtagtaacagcgattaattgtcagttgtcaccagtagtaacttggtgacaaatttcattaatattaatttaacgacccaatttagacctttatctatatcaaaaaacaatagcatatgctatggaaaaataaaaggcgctatgattgtaaataagcattggcacattatggtatcattgccagcaagaaaattaaatttgtccaaagcagcagcggagctagggcccggccaccacgggcaggtgcccgggctccaccgtattagccagtggattaccacttaatgcccctgcttaatctgcttcttttaatagaggctaaatcagctatgcaagcaacaaaggagtcaagacacagcctcacaccaatgtttgctgccatcagcctaaggccaaagctacacagttctccaacagccattatctacttttgacaaaaaaataatacttattaatcctataatctagcccattcgtttaggtttgcccaagctcaagagaacttctagatccgctactagtccaaagttaaccatttcaatatccataaatgtagccacaaaaaactaagatcatttaaaaaactcaaaatacgaaggtttaccaaggaattgccactttctgctatcatgaacacgggaaaacaagaatgcaatgtaagtcaagtaacaatttcacaagtcagcctcccatctatcaccgagtaataattatagaatacatcaattgctctaaagaaccataaacaatcgtgcaatagttgcagaatccgaaacggataatgcatagctcattcctactagtatttttgttttcactctgacaggaggcaatatacatagggcttcttccactaacgaccacaacacagcaagacttgcaattgcatagagctcagcataagtacaaaagcatcaaacacttgtcaagaataaactcatcgatctatactcaaacagtccacaatagatcttttagcggatgtatggattccatgacataacaaaacagctaaaaatcagtcaccatgccaccatctagctatcatacaacaacatatcaaacagtactaccaccataaacatgaactcaaacaaacagtactaacacggtaccaccataaacattaactcaaaacgatacagagctggctcgagatgcgcaaataccttcttatcttcggaggtgggtgcaaccgccagccgcttggcaggagaaacaggggccccgccgccgggcgcgacggagctactgagccgccgcttccggtcgggctcccccgtgctccccataaccctaaccctaacctctcccaggtcctccgattctccacatgcggcgggtgaaaccaaaccccgaaaccacaagggccaaccctcccggccacctaccggtccaatccaccacccaaacccccgccccggcgactcccgaaccctaacacgcggatcaccaaaccaatcgcacccaaaaaaacaatcgcaaaaaaaacaaagagcggatgaaggacggaattggagcgcgggacgagcggatcgcggcggaggcggaattcggctagggttgtaggggggaagggatcggatcagggaggtgtgggcgagaggtgggagttagcggtggttttggcgtgtgcactgtcaaggggggaggaggtgagaaccgtgaggagaaagaagagaagggggggaggagagctaggcgaacggcgcagagaggagagagaatatgcgtgtggggaggcggagtgagttatctcgggcggaggcggctgttcgccccgctgcacggactccgtgcttctgtggacagtggacaccagcgggcatagggttggacctccgtcagtcggccttttaacagccagcccagaatggtgagaacgacaatgttcaatatagattactgtcacaaattatttattttgttatatatatgataaaatattgtttttaaaattaacaggtactccctccgtcccataatataagggattttgacttttttgcttgtactgtttgaccactcgtcttattcaaaaaatttgtgcaaatatagaaaacgaaaagttgtgcttaaagtactttggataataaagtaagtcataaacaaaataaataaattccaaaaatttttgaataagacgaatggttaaacactgcaagtaaaaagtcaaaatctcttatattataggacggagggagtagcgtataagcaagtactggcacctgaacctaggacatgcattatttgatcttcatgataagtctttcatatgaagttctttttatacggtgtgaatccagtgtattacaattttcaatgtaaagctttgattatcagtgccatacaaggtcatattactaagcaatagtaagttgttggttcatgtggttgcaactcttgttaattaactcagatagcttgtttttaagaaaaggttaatatggttattttgaagtagtcttggtctttttcattttaaattttgttttaccatagttgaattggtcatgaatatagagaggttagccaataatctattgcttaatactattagttaaggtttcagtgtttaccacatgacggacatgagcaatactctggtttctacatgtgataatatcggtcgatcataacattaatgtggtaggttggtaacggaaggttaaagcatgataactgtcgagaggcaagatgaaaactaagatgttcagaaatacaaagatacatatatatgaaccatttggtcgaggaaaagtagtcctagagaagcataccacgtggggaacaggggatgaaacatgatggtatgaaaaaaaaaacatgtcctctatgcacacacatgatgtatgtgattgtcgtattggggataaagttggttcaaatgcacaatgcttgttagtaccatattttctacttatttttactcaattacaagtaaaggcggatggtgtatggatacattgagagtatctttttgttcttctaatattgcatgaagggatgttaacgtttagatatattagatcatatgcatggattcaataaaaaaaatacatagtacatattcaagcaagataatactacactatgttatcatgtagtgcacaaaatgaccgatttctcgcatctaaaacatgacaaacatgtaaaaaaaacaaaggttagccaaactaattgcattagatatttagatgggtcttgagcccttgacccattttccgtgtcattgaagtgcaatctatttatgcgttcgcgaaaaaaaacattttccatgtcacaaggtaattgaataatctaaacaatacgttatctaacagtagctgctaaaaagttcaaataatctagttagattttgaaataccttaaccgcatttgtcagctatattaaggccctctttgtttaggcttataaaccaacttataagtcgaaaagtctaagcctaaacaaacaaacagcttttccgtttggcttttttgaagccataagccactctagcactattaagccaaaagctaggttggagaagtttttttggcttatgtgaggtagatatatgactcaactactaaacttaggacattaaatccaccggcttataaatcatataagccaataagctgacttaaaagtctagaccaataagcctaagcctaaacaaagagggcctaacatgcggaaaaggctctatgcacataatttttcgtataaaattgttacaaacattgacatggcatgatgcaaggaaatctggatttccaattactcctatctagtaaatcaagaggttgagaatttcgattgtaataaaaaaattaattatgtccagcaaatgctcttaaaaaataatgaaagttattgacttgtcctaatcaaactaaatttggatttgctaatatctatattgtttttagcatcgaagccgcttttacccaacaaaaagggactatattgcgaagtcaatctaggagtaaagaatttatatgctaatccatcgaaacaaatgttgggattccactaggattgatttgagggatggcaggattttgtgcagcgctagcaggaaaattgtttactatgacccgatggagcataatatttaacatgtgtattcaacagatgaaattttgaatctgttagataaaaggaaaatgcatccatctttagttaaaatgaatacgttccaatggtttgcaatgccaagaggagtaaaaagaaataaatactatagttattcctttctactcctacgtcttatacggagatagtctagtttattatgaacagatgaccaaaatgagaaagttacataagtcttttaaagtccacttcccaataatttttccttatgtaacttactcattatagcttcggtcatttacttcttattaaaaaaaacatggagctacttggttccttattatgatgaatttaaagcatctacgatggctattgttattgatgattgatgaataatgttactcgagtgagagatgctagatggctgacggaaaccactatgctctaggcaagattaaggatttgttcgtctaaccctcatctaaagggattgagatatgaagttattcccctcaaattctcctataatcattttcttgtgaggattaaccgaacaatttatgcggaaattggtttcgagctcaaacatgttttcattgaagtatttttgttatcttttcggtataactctattatatttttcttcttgtgttgtgtcaaaaacatttctgcttgtgtagtggttcttgtggatagatcatgtatgatctttctccggttttgtgtttcttttgtttcggagagctgatctggatagttcactctttcgtttgaatcaagtagtccagtatgagatgtgtgacaatcgtcagactttgaatccggagacagtgtcagacaaaaaaatcgtgttcactggccagcctcttctacccttcttctgatcctctcccgtatagccatttcgtcgaacaccttcccgagccgactgccgccgccgccgccatgctcctcgcgaagccccacctctcctcctcctctttcctcccatccacgcgggtgtctagccccgctccgggtcccaaccacgcaaagcccatcgccgcctctcccgcccctcgacgctgcctccgtctcgccgtcacatccgccgcggcgccggctgcttcgtcggcggaggcggcggcggcgctgagccgcgtggatgtgctctcagaggcgctccccttcatccagcgcttcaaggggaagaccgtggtggtgaagtacggcggcgcggcgatgaagtcgccggagctccaggcttcagtgatccgcgacctggtcctcctctcgtgcgtcggcctccaccccgtgctcgtccacggcggcggccccgagatcaactcctggctgctccgcgtcggcgtcgagccgcagttccggaacggcctccgcgtcactgacgcgctcaccatggaggtcgtcgagatggtgctcgtcggcaaggtcaacaagcacctcgtctccctcatcaacctcgcgggcggaaccgccgtaggtctctgtggcaaggacgctcgcctcctcaccgcgcgcccctccccgaacgcagcggccctcggcttcgtcggcgaggtctcgcgcgtggacgccaccgtcctccacccaatcatcgcctccggtcacatcccggtcatcgccactgtggccgccgacgagaccgggcaggcctacaacatcaacgctgacacggcggccggcgagatcgccgccgcggtcggcgcggagaagctgttgctgctcacagatgtgtctggaattctgcccgaccgtaatgaccccgggagtctggtgaaagagatcgacattgctggggtgcggcagatggtggccgacgggcaggtagctggtgggatgataccgaaggtggaatgctgcgtgcgtgccctcgcacagggcgtgcacactgcaagcatcatcgatgggcgtgtcccgcactcgttgctgctcgagattctcacagatgagggcactggcactatgatcactggctgaggtgattcatcccgtcgtggtattctccggtgcctctcttctcatactgtaatgtaatttgcatttgatatgcctcatgattgcaataagaattgtattcctcacacctgtagctggttgagataggttctgccatccgtttgttctgtgactttgttcgcaatggtgacatttttgtagtttgtgctataaatcgaatcaattcaggttaaactgtactcaagtaaagttgttcttttactgttgtttgggaataacatgggcatgattcaccagcttcaaacctgagtgctgaaagagtatgggtgtagtagtgttaggttcataaatatggaatgtgtgagctgtgagcttgtgactgagataaccaattcaactttagctaacactgtcttttgacccactgatcgtagaaggtttatattaatcaggaataccaacttcaacaaattatgtaccttatccagttgtttgctattagccaatgagagtattttcctccatgcctctactgccctttatcatcttatcccattgttgagatatctgctacatctatcatggaatttttgtgagtcatacagcacttctgatcttagtcaagaaagctccaatgatgaaagaagcaaatgaaaattctttagttttgttcagcctcatcatgtttgtatttaaaatgcacctagtatgcagtgcactatcttaaaaaaataacagattcaaacattcactttcatttgacactatgccagtacttcctctgtctcacaaaaaacaaattagtataggatgtgacacatcctacctgttcctattcgtagtactagaatgtgtcacatcccatactagttttttttatggggtggagggagtataacttccctgtcccgtcgcttcgtctttagatttgaatgtcagcagctcgttaacggtatgacaatcgattgacatttatattttcacttattgttctatttattgtattttgcattattttttattattcatgacttctatgaaatcaacctgcatatgtatatctattgtagcttacatatattttttaagtattgaatattgacatcaaggtcttagtttcctctttttgtcttgatctgttttaatcatatcataaatgcaaaggtaccagcatggtgtggtcaagagtattatagtttgcaaacaagctgtctatttcttatggccaacatagcacactggctatttatatacaatacaatttgctttggtattgcttggagttcggatcattgttcaatcccagtgtccagtcggttactgatggtacacataaaactttgtccaaaacatgcatcgcaatggacaaaatagattctgagttactgtggcattccgcctatggttatttatgtctgaacttggaataatatatcacattcactgttccaaatactttacatgttcatacgtctaaaaattttcgtatcttgattggaatcatggatgctgcatccatactgcttgaacatctttatgtgaagttccaggttcacactcaacttattttgttccaggtttttgtcattctttttggagttggcctggtgtgatatgatagattgaactgtgaaccacaagtgaatggagaaaatgacttgatttggcaccactataccaaggttctagctgtgactcatgaggtttggagaaactgatggcatggagggctggactggtagagctctgggtccttgcagacatcattcctctgttctttccaccaccatggcatggtcagagcaaattccacttgcatctaatggaacggtgccttcttttccgtatttaagtactgtattagtggaaactttcagtctttcattgtgccattcgtcatttctgatctgttgtgtgagagaaattttgagaaaagggaggaaaagctctaccccttcacttggcgttacagaatctattcctcattatgttgtctatttactttttgtgcgatactgatacggtaagcatatcgtagtgctgtttagtgtctgttgagcacttcagccccttagaactgttgtgcttagcactacaatgcttgcggctatataataataagacataccttcagatttaaggggccatttctgtttagcttgatttttttccccaacatgttgttctgttcattcctttcggtcagtgtttgtggtagccatttgtcgttgcaatcagtgtttgtagtaaccattccattagcgaaacactttgctgtcccttaggtgctacagtgtcgagacttgccagtgttcagcatgtatcacgtttttaggactttcagagttcatttagaaatcatactacaaaacgaaaggacgtcctatctgctgcggatgagttgattccgttgtcgaatttgtctgaatcattggctagggatgggctaatattgtctgaatcattcgacaacagccgatggctcttggggactggattgtgacttgggagaagtttcaaactttccatccttttccaagattattatagctacaggttctcagataaaaaaaaaggattactgttactgcaactagccttgtattgttctaacaggcccgtttatatatcttttaaattacgtagagacactgcctcactattattattgtttgtcactgttcgatataaacagtgtagacgcattaccgattattccaatactgcaaacagtccttggattccattccttaaatgccaacgattcctggtccaaaacactccaaaacgaaaccgaaagaaattcagatttaagcaggtcatctccactgcacatactactcaaagagatgcttaattatcaaaagagagtaaccatttccttcttgttaaatagattaatctgatattttagaacaactttcatattgaaaattttcgcacaaaacacaccgtttagcagtttgaaaaatgtgccatcaaaatccaaaacgaacggggcctataactgcatattctccggggaaaaatattgaactggaattagccattgttcaaacaggcccatttatacatctctttcaaattacgtgggcacactgtctcactttgttttgtcattgttcgatataaacagtgacgtattaacgattattccaacactgcacacgatccttggattccactcctaaaatgccaatgattccatttccaaaaccatccaaaacgaaaccaaaagaaacacacacaaccaaatctgtaccactaggcaggtcatctccactgcacatactactcaaataaatgcttaattatcaaaagagaggaccattttttttcttgttaaacaccaatagtactagtaggtttatatttgtagagtactaggtaactcccttcaactatatacttgatttaaagcacgagaaacgagccaacgaccgaaggaggccaagtccaaagatggcaacacaagcgattgcaccgatgcacgccgccgtcgtgcaccgccaccacgttctaccaccccgccgctgcgtgcgccgccgtggcgtcttcgtccgcgcctcggccgccgccgccgccgccgccgccgagacggacacgctgtccgcggccttctgggactacaacctcctcttccggtcgcagcgcgacgagtgcctcgactccatcccgctccgcgtcaccgagggcgcgatcccgcccgacttcccggccggcacctactacctcgccgggccgggcatcttctccgacgaccacggctccaccgtccaccccctcgacggccacggctacctccgctccttccgcttccggcccggcgaccgcaccatccactactccgcgcggtaagtcgcgccgcgcgcatgcagcagcagcaggtttgtcagtgagagcgacagactgacagtgcacgcgtgagtgacgcatgcaggttcgtggagacggcggcgaagagggaggagagccgggacggcgcgtcgtggcggttcacgcaccgggggcccttctccgtgctgcagggcgggaagaaggtgggcaatgtgaaggtgatgaagaacgtggccaacaccagcgtgctgcggtggggcggccggctgctctgcctctgggagggcggccagccgtacgaggttgacccccggacgctcgagaccgtcggcccgttcgacctgctcggcctcgccgccgccgacgacaacaaggcaacgaacgcgtctgcagcacgacggccgtggctgcaggaggccggcctcgacgccgccgcgcgcctgctgcgccctgttcttagcggtgcgtgacactgtaccggagcagcggcctccacttcgatcgattcggaccgaactgatatgacgctggtgcgcgcgtgcgtgcgtgcggtgcaggggtgttcgacatgccgggcaagaggctgctggcgcactacaagatcgacccgcggcgggggcgtctgctgatggtcgcctgcaacgccgaggacatgctcctcccgcgatcccacttcactttctacggtcagctcgccatcgcctcgaccaaccacgcattttccattcgctcctccaaaaaaaaaaatcacattgaacggcgtttccatggcagagttcgacgcccacttcgacctcgtccagaagcgtgagttcgtcgtgccggaccacctcatgatccacgactgggccttcaccgacacccactacatcctcctcggcaacaggatcaagctcgacatccccggtaaggaagagaaaacaaaagaaaacttgtccatggaatgatggaatcgtgcgcgcactggcgtctgatgctgacgtttggtatgcttggttggtgccgtgttcgggcgtaggatcgctgctggcattgacgggcactcacccgatgatcgcggcgctggccgtggacccgagaaggcagtcgacgccggtgtacctgcttccgcgctccccggagaccgaggcgggcggccgcgactggagcgtgccgatcgaggcgccgtcgcagatgtggtccgtgcacgtcggcaacgcgttcgaggaggcgaaccgccggggcggcctcgacgtccggctgcacatgtcaagctgctcctaccagtggttccatttccacaggatgtttggtaaatttcaacgccacaaaaaaaaaaacagtaatccatatttgctcgttcttgcatttgcacattgctggaacacaacgatcatcgagtgatctgcatcacaggttacaattggcaccacaagaagctggacccgtcgttcatgaacgcggcgaagggaaaggagtggctgcctcgcctcgttcaggtggccatcgagctcgacaggacgggagagtgccggaggtgctcagtcaggaggctgtccgatcagcacgccaggccggcggacttcccggcgataaacccaagctacgccaaccagaggaaccggttcgtctacgccggcgccgcgtccggctcccgcagattcctcccgtacttcccgttcgacagcgtggtgaaggtcgacgtctccgatggatcggcgcggtggtggtctaccgacgggcgcaagttcgtcggcgagccggtcttcgtcccgaccggcggcggagaggatggtggctatgttcttcttgtagaggtaagacggagtgcccgttccatcaacatgaagtacgagtgttttgttttttcttaagatttagtacaaatgtttactactgaattaacatcaagacatgtgatgtctctttgcttcttgacagtatgcagtctccaagcacagatgccatctagtggtgctggatgcaaagaagatagggacagagaatgcacttgtggcaaaactagaggtgccaaagaacctcacttttccaatgggattccatggtttctggggagatgaatgagcatagagcaagcatcagatccagtctaactctggagagaaattgtcttgaaaaggcaagaattttgcctcgtgtattgataaaagagagttttgtgataatctgtacatggtggagaggaattatcaggggaaccaaataactactgtacatccagtctcggaatgaaaattcgtctcaccaattcattaaaatcctgaaatactaatgttttaaggcaataattcatagtattcccatagggtaaacatataagacctccactgagaatcttgatgtcttggcaattttaaaatgaaagttcttgaactgacaactaagaatgataccatccatgatcttaacccattcgacaagaatttaaaaggctagaacatatcctgtacacagctaacagaccaccaaatgtgaagtcgacgaatttttggcatcacttaatgcgagccacagtcaccacaatgaagacgaacactgcgagcatgaaggacattctcactgtatcgtcatacaaatcatagtcctcactctgagcttgaaagagcatgttcacaagcttaagtatgctctcaaggaattccttgatctttgcttgggtggtttccatgacccacttcatcactccaggagaagcagaagaacttccattgggatcagcctccttagctgaacgaaagtaccaaccagattaatatcgcttatccaggcccaaattgatcttttattttattattaaaagatgtacttaaaatgctaaagctaaaagccacataccatcctgaaaggacttcctgaattcttgcaccacctcatttttcatcacggcatcccatacagacttatcagttgacaaggccataaccattttctgcatgttgggagatgaatgttaggcaaagaccgaaagaataataggtcatctctggaaaataatatttggtgctaccaaacaaacaagttcatcattgctatacataaataggaactgaatcaaacccacattcacctggacagaagaatctacttgcaataggtggaatgcatccagcacattccgatgttcccttgtcaaaagagcagttgagttaaggacaagcatagcaggttcaatacattcctctgatgcagtgtctggtgtagagtgttctaagctggctaattggtcaatcttaacatcagatggagtagaatcctcaatcttaatatcagatggtgtagaaccttcagaaaaataattaacaaacattccagatggaggaagtcctgagatgggggacaatgcaagtgcttgggcaggtgcatcagaatccaatccaggatggttttcaaataccctgcatgcaacagaaaacagtgtgtgtttttttatataaaatatgtaaaaccagattgcataaaattaatcaactgaagagctgataaggtctatcaataacagaggggataacaaagcaatgacgagcatgtgtatgcagttggagaagtactacaaaaattgcttcttttagcaggataagttgaaaattggagatccaaccgcattgtacggcattccacatctagacggtgcatacacaacgatttcaggaacatacaaacatagcttgaccgtggctataggcataataacttccacgcaacaaatttgtaattaaaggacgattatcaccgataacaaaacatggaaaacctccccccccccctttttatattattatagaagaaaatcaattagcaagtaattaaacaaggcagttccgatcttttctagataatcaaagatcaaaacttgtaaacctaagagcatcaagtagaatcttactcttggatgctagcaacggcggcgcggacttcctggtcggtgggcggggccccgaacgcctccgcgtgctcatccgccgcctcctggacagcgtcgaacgccccagaatccgccccgacggcgtcatcgccctgggcgacgaccacctcccagtcctcatcgccatcaaggcggagcgcgcgggactcccagcacccgacggaggcgatggagcaggccgggggaggcgaggcggcgcgcagggcacgggccccggctcgcgtggcagggcggctcccgctggagatggagacggcgggagacagggcggcgccaccgcggagcgaggaggagccggcgaggcggacgaggtgcttgccgccggccgggttgctcatggcggcggcgccctggtggagcctcgcggacgtctcgccccctctccaagagctctccctcctcctgtacaccacgtggacaaccatggcaggggcctcgccgtcgccggctcgcagctgatgctcctctgcctcccccgccgcggtttgttcctcttcgccttccggcgaggcggcgtacgaagtgggagaaccggcagatttgtttgggttccggaaccaaatcagtattcggtttattattaagatgggtggggtggtttgttaactgatgatatatttccgcaggggaagtgtttgaaagtacaactagtaagttattatctctatctctttctaaatgtaacttgtagcatatagataaataaaagaattaatttttatagggtgtagctatatttatagcgccatatttttcatcaaaaaatagtcggcatgtatttacattgtaagtccctaaattacatatgtaattttagtgtatttacaatgtaagtctcaaaattacatatgtaagtactaaaattacatatgtaaattcaaaaattacatgctaattgcatatgtaagtggggtgtaaatgaggtgtaactactgtgtaagtggctaaaaaaaatcgactgtagcatatggcgccatatttctagcaactccatttttatatctatctttgtgaatgtttaactattaaatgaaataatggacttttcatatctactttgttaattgtacatacgctagtttttattttttttagcaacatatgtagtgacatactaatttttaatatatcacattgtgtttatttttttagcaatatatgtagtgacatagtaatttttaattgtaaatgtgcttttaatatatcacatttgttgattttttgtgtaatatttgaagttctacatttgacacatgcacttgtatttaggctaattattctttaaatggtgacaacgtactcgtagacaagggggtgcccgcgatgtctatgtcaatatcaagatttactagccaaatatttatgagttgcttttatggtaaggtgtgcgtgtgaatgttcacgagggtgaatatgcgcgcattataagtgtctgtgtttatattatattttttaaaaaatatattatttaaatattagttcttatttattttatcattaaatatacttaacattgacttatattttttatattagcaccaaatttttaatgacaccaatgagcaaatgaaaaatcaacggtatcatatatgagagtatatgaataattttatggcttgcctctccacataatatattatcagtaattttttatcttaatgtattgtagaaaaaagtttatatatttctgcaagaattcaactagagaaacttccgcccatcataattgccaaaatattttaaaatataaaaaacgaatctaaagctttttaaaaatgaagggatgtcctctttatttttccttctctcacaaggcatcgtgcaatacagttcgttgtttagatgtctattcggtcttatttactactagtagcgagtatctacgtcattttcgcttttagattagagaatgaagcttatccacgttgcgtttagcattaggttctgcaacaacgcatttacaatgcgtctatgcgctcgtatatattagtctcgatgctttctcactgacacgtggacacaaagaatatagggacgaatatatcatccccgacgtacctgtctaactgatcgtaagaaattaactcatttttgataaataaaaacaactgcgtgccgcccaaggctttggtgttgcttactctaatacttctactttattcgatttaggagtagaaaattttatcctttggtttgacacggttggcatgactgtaatgtatgccgcatttgctacacagcatattgctgcgacttcaggatgtcgagatcgaacatcatatgttaaaggggatttggtcgtatacatctctgtagtccctaaaaaaaaattgaacatctctgttacagaaaacgggttgggttccacgatcactgcgggcggggtgcgtacgcgattttgtggtataccatcacatcattgcaagaagcagtatggataaatagttttgctctgctccactaggattaacgagcctccactcttgatcatcgtattgattttgcgtgtaaccagcagcgtccgccatgagcagtgcttcgccctagatcgtccaagctgtatgctactacctgttggtgctcccagcgtaacgagagctcggagttgacgaattcagagaccaaaaaaagagacgtggggatcacagtatatcagacggcctcacgtcgctttccagatggccgggtctccgaaccgtaacgcgagaggagacatggtgcgcagcgccagatgagagagacggcgaagcaaaccaacccaaaggatgagatttatgttgagcacgagaccatcaagcaacaagcatacgccgatacgcggattgtgcggcgagatctcctaaccaatatgcgcatcgattcgacgggagctcacttgggttttcgttttgttctccccgcgacgtttagttagtttttcaccgtttagtgtcgtggattacgtggtgagaaataccagcgcgtttaaaaacgtgtgcgtcgatataaaagattacatgcgaagtttatgaaaacacttgtttttctttttcttttttcccttttattatgggcttccatcagcagcgtatcgcaagttgcaatttgcaaccggatacttatccatgacgctcgggctggtgaagaccgcggtttttgcgctgcttgtgcttattgttacagaaaaaaaatccaacattgattagattatcaaatggttcgtgagacacacagtagctacgagaaaacagaagaacggtaagacgtcgtttctccaaacaatttgacgatttgataatatgtttcaattatgcgtagcattctcccttgatcaaattccggtgttgctctgctgccagttttttttttcgccggtctgctgctaaattttgcagttctacagtatgcacttctccggttctgcactagtactatcaggtactagtactatctacaaggccattgttgacttctggaccgtctatatgattagcaggagcccatttgacacaaaagtattcggccgattttgttgggcccttctatattttagatcaaaggaagcccattaacaaaagtactacccaaaccatccattagtccatcacaattcactaggatcaaactgcctactatactagattacattgctttctttccttcaaacatccacaaatccacaacctaataaagacacagatcttacacacatactacatgtaactacacgaaaccaaatgcaacaaagattctaacacgacaaacaaagatttttcgtcagggtgacagactgccagaatgatttcatcacacgaccaccgtttgcacgctcccatggcgcgccgactcgttcgtcgccggcgccggcgccggctccggcacggtcgggaagaccagggcttgatgcaccagcgccgccaccgccgcgccgaccatcgggccggcccagtacacggcctggttgctgtagtgcccgctgacaaccgccggcccgaacgagcgcgccgggttcatcgacgcgcccgtgagcgaccccgccgccagcacgcacgcgcccgtcacggccccgaccaccagcgcgcccagcgccgtcgccgcgggccccttcctgccgccgaagcctccaccccgcgggtcgccggcgacgtgcaccgtgtacaccaccatgaacgtgagcaccccctccaggatccccgccccgaacccggtcatctccaccgcgatcctcgtcgtcggcacggcctgtgtgtgcaaacgcgcgttagtctacgcaaagttaaggacatttcgatcggaagtgatcttgcctggccggcggagatgtagtggaggacgaggcaggcgaacgtggagccgagcatctgagacgcccagtagaagatggcgctcgggacggtgatgtggccgccgatggcgtaggcgaacgtcacggcggggttgacgtggccgccggagacgtcggcggcgatgaacaccgcggcgaagagcccgaacgcctgcgcaacggcggtcgccatcagggacgaggcatcggatgtttcatccggcgtgagcatccctggcaacagcgcgcggcaagttcacagagcgaaatcacgtatgagaccaacaaagcagagcaattcgcacgacatgcggaacgtaggttgcagtgaaacgcatgacttacgggcggagatggtggagccgacggcgatgaacacaaagaggaaggtggagaagaactcggcgaagtacgcccggagcgccggcggcgagaagcagcgcttcatgttggcacagatgttcgccattgcaagtttaccctgtgtgtgtgtgtgacactgtgtttacagagcagtgaagaacacgattacacgaattcgcacagttcttcactactcggggtgtcacagactttatatagaagggccatgggtcgcgaccgtagggtgaaacgttgctatacttcgcagcggttgccgccgcgcccgctcccaaactgaaccgtctccacgcgggcacgcccgttgcgcgcgttcgcacaccgcatgttagagaacgtgtacgtgcaaacttcacaacttacaatgaaccgtgcatatatggtacagatcaatcgagcagttttgctacatattcttttgtaggattgaatcacaataactaagccaaccagggaggtgaatgtttggtatacccaaaaaccaaaaacttttagtggaaataaaagttaccctcgaaatcgacggagatcggtttgaccgagattgatctatcggtctgactgagtggatgccgccggtctgaccgatgtagaacgatcggtcaaaccgccgaagtcgcctgccgctcgctgtcgccgccgccggtctgactgccgtgctcccgtcggtctgaccgccgcaatgccgtcggtctgaccaccggtgagttgccggttagaccgccgaaacccggtgaaacacaaatcgaagaactattaaagtagatgacaactttattgcttctctctgtgtttacaaagtgcaccaacagcactccttacaaaaatttcgactaaactcgaaaccctaactaaactatcaactcaattgctctcaaaagcgataccggaaagcctcacgctccccctctatttatacatgaggtaggcagcctaaagccacgaaccaaactcatactaagagtcctaaacaccttaggaaaccatacagtacaagacacaaactttacataaccaattgtaccaaatttggactccttccaaattcgactccgcatcccatacgtacacaatacctccatcgtatgccatatggaatcttcaccaaccacgtgcatcaactctagccttagtatcccgcatgatatctgaccaccacggacatcgtcttaccaccaagccgactcccggtccatcaccgcaaatattctcccgaggcatcgagtcacctacacatgaaacaaataaagaaaccatattctgagaccaagttatcaccaacttgactcattgttagcaaacaacagtattacatacgtatagtatccatctagaagccataaccatgaaacaatcacggatatccaaagaaacaacccgaaaccgaaaccgacacagcgtcggccggtcagaccgcgggccggccggtctgaccgctcgatcaccgctggtctgaccggcatacacagcccggtcagaccggtcacataaaatagcagtgaatccgatcatcacctgaaaattgattatctccaaaaccacttcgatgataatctccaaatatcaaaaccaataatcacagatgccag

SEQ ID NO: 74767 - DNA, 13209 bp, Oryza sativa
taacttggacttttattttttgctgcacggttttcttttttacaaagtttgagtaggactcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctatttggtgttttattaacagttttttatatgtcgtatcaaccgccaccactctactcctttataggcatgttacttaatttatctcgtcatgtgttttagatggtattttctttcaatagtttttatttttatcacaaattttagttatttataaattatattcctaattgaaatcttatttttctttctctaatttcagaatttatttttttcaaattttaattaatatcgtattgtgttctttttttttcaatttcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggtctagggcttaataggattaatagaatactcatatcaacaagttgcaacttcttttccggaagccaatctccaaagaactccagctccagggttaagcgtgcttggcgtggagcaatttgggatgggtgaccgacccggaaattcttcccgggtgcacacgagtgaggacaaagtgtgcagaaaagacatgtgttggtctgtgagggtagtctatgacctatgaaagctatcagacgtaagcgggcttggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactagacacatggacgtggccaagagaggacgttcctggcctagggttgatcgacaggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcatggagcaatttgggatgggtgaccgaccgggaaattcttcccgggtgcacacgagtgaggacaaagtgtgcagaaaagacatgtgttggtctgtgagggtagtctatgacctatgaaagccaattcatagcatagccgatcaggtagatctagcatgtatcggctaatactccgatactactctatactaagattttaaagcaagtaaataaaagtagttaaatcagataagatcggctgaaactccgatactaccctaatcagcaaccagaaagcaggctagagattgcaattctaagcacgactactctatactaagattttaaagcaagtaaaatatactaaacataagcttaatatacttatatgcgacaagatcttaacataaagggcagatttaacatgtcaatcaagcatatagaataaaagtagttaaatcagataagatcggctgaaactccgatactaccctaatcagcaaccagatttaacatgtcaatcaagcatatagaataaaagtagttaaatcagataagatcggctgaaactccgatactaccctaatcagcaaccagaaagcaggctagagattgcaattctaagcacgacttaatatatcaaacttaactgatgcagcattaagtatgaaaagaaaaacaatatctagacaatcaagccgctggaagtttcatagagtggtagatatatcacatagtctaagttaacatcattatctaacctaatcgactaccttccattaacagatgttagccgattataggttagatgaagatattatcaaagattatgtgagatatatgataactcgacgaattatatagacaagattagagtgtcataaagatggaagcactaatcttgagaacataagtcctcatgacaagttttacctcttgttgaagatcgaaaccgatgcagctcaacccgagagcacgaactcatcgaaataaaagtaaagcataaagggtggcgatgcgccgagattgtattggatgtctcctttttacatagggctcgggtctattatacccgagaaaagatacgtccataacagacatgactattatctctaacaaactctaagataccataagtctttacggcagacttttgcccaaacatatctctaaggaaattacatagaatatcctaattaatagatataattgccttcccatgactctatccatgcatggcaatcatcttgaagcacatcaacttgaacccgatgacgtacaccgagtcaaattatcggaatcggctgtatcggctaaccccgtccgactcgaactctgccaacctgaccttagccgatttggactgcagtcgattcttactctgtttccgcaacgatcttcatcttggattccactttgatctgatcttcacctccgatgccaatagtgatagaatttaccaaatttggttgttaacaggttcttgtatggattcttctttcaatattgcttatttttaattccgaatttcagctaattttaaattttattcctacttgaactcttcttttattttcttttgctaatttcgggttttatttttatttttatttttaattttaattaatctcgtattgggtttttatatggactcttcttttaatatttcttatttttaattctgaatttcagctattttaaaattgtattaactatccttttcttttctaattttggattttattttatttttattttgaattttaattaatctcgtattgggttctcatatggaaacttctattgcttggactcttctttttttttctaattttagattttatttattttaattcgaattttgattaatctcgtattgggttcttatatggaaacttctttcaatattgcttgttttaatttcgaattttagctatttttagattgtatttctacttggactcttctattcttttcttttctttttcttctattaatgtgggaatttctagtccccacagcgaatatggtgtctcttttcaaagctgttttaataatataatagatagatagataacctccgggccaattcaagcgagattgatgggggcagccgccgatcctgtgcggtgtgaagagtgaacgagctctaatggccaatggacgagcttagcgcggtggagtgcgaaggcgcgagagctcgtgcggcggccggcgggagggtagtattgctggcaacgcaaactcgagccacgttgggcacttgggcgtttgctagctgctaccgctagtgtagccggcgaccacagagagagcgtgcgaaagataatcgattgcggaagccccaccccctctgttctccttggcctataaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaacctcgcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctgttccttcgttttttctatacgatttaaaggggcccttaatttttagcaacaccatgtggtcctcaaactcatcagcagcagacaacaactaaagagccgtgtaaatatatcagacaatgcaattagtagggagaggcgcccataacacacagaagagaacaaggatcagagacgaaaaggtttagccttttaacgctgtgatctactcgccgctacaaagagaatggacggattgatccaaagtgcctcgactttactacttgcggcggggtacaccgtgccgcccggcgtgccgcgcgcctcccaacgcgagagggggtttcgacctacctgcacggcacgcacgcacatatgctctgcatgtgctgtgcaacgcatgggcgcagccgcgagagcaagcgcggcatgatgcgcctgtacgctaattcttggatcattcctccctgcgttagtttaacttaatcctaccggtacactgcagacacccagctaatcaattaggcttcttgcattagtatatatagtgatatatactatatactccgtaccttgtatatgtcgttggagtatcatgcatgctgtgactgtaaaagcctgcagctaaccgataggaaggtagcagagggatcgtactgttctatctcgtgcgtagtggtggcatctctcggtgtccccagtttgtaatctagccaagtttcacggcatattaatttgcagcgaagggagacttatggttggccatgcatgctctgatcacagttacgctcctatccatgtacacgccgtgtctctatccggtgttggcccacggtatatcaggaccatcgctctctcgcgtctagggattcggaaaagctggtgtatatgtccaacacatattttgatgcaatgttgatacgcgatgtgactcgggttttggtacgcagatatactcagatgctacggactgaaaattgtacttggggtatacacaaaagctagctgggcgacgacattttggagagatcggtaagtctattgtgtgtttagagctccgtcgatgacgttgcaattgttctatgacaagaaaaatgttaaaatatcagctaagtgcaggaactcaacctggtatctcagtgaataaacatatggacgaggtatccgtacattgtatgattttgatatatcagtcatcactcatcagtgtccgtaaatatctctctttttctgaaacattaacgcagaattattatacgttagctacggtagctaaactaccaggtgaaagctagcgatcgaaagcatgctagctagctgcatgcatgaccgttggcgtccgaccaaagcagaaattccaaaccggggccgcagcgccagcagctagcttagctcttggagtgttcccgtcgggcggctatagcttagctctctcctccattatttgcatggccgtttcctcccccctcacagccctataaattccgaacccctgcctcacagtctcggtctctctcaccacatattccgcgtgcatgtgaagagagagatatagagaggagagctagcgaaagtttgagtgacaaagacgcacgtacgcgcgaaaacgttgtcacgcttttgagtgatcgatacacgggggggatacacacgcaaaccgatcgatatggttcgtgagcgggtggtggtggtgatggcgttcgcggtggcgacgctcgcgacgagcctcctgccgccgctggcgtgccaggcggcgccggcgccgtgcgagcgcccgacgcgcgggcaccaccagtacaggcagccggtgggcgtgcggcggatcgtggtggacgcgagcggcggcggcgacttcctctccatccagcaggccgtcaactccgtgccggagaacaacaccgtgcgcgtcatcatgcagatcaacgcagggtcctacatgtaagctatacccagttagctcatgctcatgctcatgcatgcgtgtgcagagtttgcgtttctgacgtgatatatgtgtgcgtgcagagagaaggtggtggtgccggcgacgaagccgtacatcacgttccagggagcagggcgcgacgtgacggtggtggagtggcacgacagggcgagcgaccgcggccccgacgggcagcagctccgaacctacaacaccgcctccgtaaccgttctctctaactatttcactgctaagaacatcagcttcaaggtgagctagcaaacaccgttcgcgcgccatgccatgcattagccagtggtccgtctccatggacccggccgccaacgtacgcgactcacaagacgcacagggagatgcggtgcagtacagtgccgactgccgaggcagagaggcagacaaagtgacaaaacccttcagtgtcacgagccacatcttgcaaatttgcaaatgctgcatgccgggcgtctcttcttctctgtgtatcccttgttcttttgatattttgaatccgtttgtacagggatgtattttcgggttcttggagcagccaaagcagatggcttcttccggctacggcggagagaggctacagcctgatcgacgcggccggccaactttttttttccagtgaattgcatgcatgtaagtagcaaacaacagctgacgctgggttcctgaatcctatggcttggcagaacacggctccggcaccaatgcccggcatgcaagggtggcaggcggtggcgttccgcatctccggcgacaaggccttcttcttcggctgcgggttctacggcgcccaggacacgctctgcgacgacgccggccggcactacttccgcgactgctacatcgagggctccatcgacttcgtcttcggcaacggccgctccctctacaaggactgcgagctgcactcgacggcgcagcggttcggctcggtggcggcgcaggggcggcacgacccgtgcgagcgcaccggcttcgccttcgtcaactgccgggtcaccggcactggccgcctctacgtcggccgtgccatgggccagtactcgcggatcgtctacgcctacacctacttcgacagcgtcatcgcccccggcggctgggacgactgggaccacgccagcaacaagagcatgtacgtactgcttcagctagctagctagcctgatcaacttgataaaaaaatgaaactatattattcaattcccagccagctaacgcctgtgcaaatgttgtcgacggcgtgcatgcgtgcaggacggcgttcttcgggatgtacaggaactgggggcccggcgccgacgcggtgcacggcgtgccgtgggcgcgggagctcgactacttcgccgcgcgccccttcctcggcaagagcttcgtcaacggattccactggcttacacctgacgtctgaaagccgtttttcggcaccacaattaatttactggagacaagaacgtacatttgttagtacagcaaaagcgaagaatagaacattacgataaatataaagtattgaagtgactagtgcagtatatagcggtagattcattcgttcattcgttttgtctgatccggcttataatgatagctgctatagaattcaagcacagctctttacaagatctatagtagctatgtagtactgttttaaaagctttgtcatgtagacatgtacccatgcatgtgaggtgaatagtgaatatataattgattttgttgttactttaaggaaaaatccaaatttgatcccttaactatgaccttagtagattttgatccctcgactataagatcggtctccattatcaacttttgaaattgaccatatttcatctatgggcgccaatcacttctaagagttccgatttggatcagggatgaaatatagacagttataagagttgggggatgaatagtgaacattttaatgttcttctaattgaaggacaaagtcaaaccaaggccagataaaatacagacttttctctcttcataaagataaagattttatcttattttccgttagcacgcttttcaaattacaaaacggcgcgttttgtgcgaaaactttctatataaaagttgttttaaaataacaaatatatctatttttcaagtgttataaaacttgttagattttgtatatctcatatttatttattttttttacatattttccgctatctctctcaatactgttgctataaatcggttgtggagataacggaacgtacgagcctatatgtacaccgctctattggtattacaatcgattgcgctgagtcctatcacactcttatgatatcatattaggtttcttattttcgcatctcaaaccctaacctggcaggccgacatctctcgccgccctggtctcctcctcccaactccctatagactctgtcctcgacgacacaatcaagatcatcgccaacgcagtccgctcctccttatgactatgatataaaacgcattccgctcctccttccagacggccctaggtttgcaggttgatgacaccgtcattgctaccatcatcggcgatactgttgattgtgtcacaacaccggtaccctcttcactactcacagctccaccgacaataccccctctcatattattgttggcagtggctgtcttctccctattacttccgttggacgtgcttacttacactatcctacactactatagatccgggcttcagtgacgggtcatctgtgacgggccaacgcaactcgtcaaagataagtaatctctgacgggccaaaaaaatatcctcttcaatatatggctaccagggaggacccgtcacagatgtgaagtcatctgtgacggcttgcacttgtaacccgtcacagatcgtctgtgacgggtcacaaccatggctcgtcatagatgacatgtcatctgtgacgggtgtagtattatgaaccatcacaaaagagaccactcatctctgacgggtctttaactaacacacgtcacagataatgttatctctgacgggtggtagttatgacccgtcagtgatgagtgaaaattcaaatttttaaattttgcaaaaaacctcgaattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaacatcggatgaagatattttctatgtaaaagttataaaacacgataagatctataactacttagttgataatattttcatttgaagtcatttagggtgttaaatatatgttaaatgattcagacaagcatagacaaaataataacattggatgagtaatcaatatgtgttgagtaggtgagttggtaagggagctctatatggaggttgaggtcttgagttcgaatctcacgtgtagcatacaagttatattgcgtgaaaaattgtgaatttgtaggtagtgatgtgtaaccatgtataggatggctagtaaaattcaaaatattttttttaggttttttgatacgtttaaaattcaaaaattgtatttcttgctttgtcatcagtgacgggtcgtaagttacaacccgtcagagatgagtcatcagtgacggttaggtagttacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgttagagatgacctggtccggcgtagtgctaattgctgctttgttcttaacaatgttctaatctctcttgacattattaagagctttatttctgcacaccatttttcttatgataattggtgttccattgaacttgacccgtttggcctctttgtgaagttctcaaaattatatatatatatatatatatatatatatatatatatatatatatatatatatatatatatatatatatatatatataagcaatacacgtcctatggaattaaaacttttctatagaaaataattaaaatgcccttagcttagaagcgagacgtcaagaacaattatagttcaaaaatatctaatcactacagatatcttaatatcaagctaacactacagaaaattctcacccatcatgccatcatgggaaacaccttagttttgaaaaagaaaacaaaaacctatggttggaccttcaagggggtaaaatggaaaaacaatctattattgatagtgtggcgccaatattttctacaaaaaatatattccctattgtcaagtatagaaaattaatcctatcccttatgagattatttttttatcccccttccttatagttatgtctttgagaataagataaaacccatatgaaaagaaaaattgtattcaccctagatgttcaaaatatactattgttatacaatggcttagagaccaatgatgcatagtagcactcagcactatgtacctcagtacatggcaaatactacctctgtccctaaagccctaaattacacacgctgtgttcgttagtgtagtttgaaaactaataggttgtttggtttggtgccacacattaaaatagagtaatggattagcacataagtataaatttattagtttaaaatttttaaaaataaattaatatatttttaaagcaacttttctatagatattttaaaaaatatattatttagcagtttaaaagcatgtgtgaaaaaggagaaaatagttgagaaggagcaaaaaggccacaccagagagtactctcgttatatatttactcccttcgtcccataaaaaccgaatctaaaaccggatatgatatatcttagtagtatgaatctgaatatatatatatattcagatatttagattcatatgtattatattcggttttagattcgttttttataggatggagggagtacactagtactactactacatccacgagttccccaatgccaaaaatactgcagaaattggatttcaccttagtgaattatcaccgtattgattctcctcatctttgctccaaagagaaaccgcggggctgcagaggatgcaacagctaggatcatgcggcgaagcagagcgcagagcggagggtagagtgcgtcattgcgaacctttggggattaacctcgccgacgatgaagccttcgaccgtgctgcccgagaccgagagcatatgccctcacggccgcctgaggtagagacgaggccatggaaggcggccggcggccgctgcgtcggacgcgttgaggggctcggggatttggaaatttgcgtttggttttcgcggcggagagccggagataacacagagaaactaaccaatagtgttgccaaatcggcatcaatgcggatctgagtggtggtggtggtggacttggtggttgcccccacccccacccgt

SEQ ID NO: 74768 - DNA, 2561 bp, Oryza sativa
ccattgtgcccgtctgtctccgccgcgcccgttcgtcgttgccgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccacgtggtttccacgtgtgcaggccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatatataacagcattaaacttcggatgatcatatcttggtcatacgagctccgaatcgatccgttcaagtctcctaatgtttgttataacctaaagaaccctgtgctttgttttttatgtattgttattgcttctttataggcttgaagctttgcttgtgtgcttcgcgtagctttcgtcgttccggaggttcccaaagcgtggttcgtggtcgtcgccgaaggttcggaaggccgttctctctgagcaaggcaagtcacatcatccttgagcatattgaatcccagtttataaaattattttagtttaaattaatgcattatcgctttatttaaaattcccgcgttgtcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaacattaggtggttttataactttagactttgggaatattcatatcacctggacactatggaattgttgggttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatgaacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtttatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttggaacgagctggaacacagggtcgggttgccagttcggtctgaatcatcatagaccttgggttaaggcaggtccgtgtgggttcacggccttgattaataatattatatagctctaggaccgtgttaacaaaatagctttgagcaactaagtgtcttctaatgctgtttactgcaaaccctaaccccccctatattatggctcccttgtactcccttacatttattctgcacttgtgggtgtgtcttgttgagtacggtggttgtactcagtcttgctcaatttttcccaaccccaaaagaggagttccttgaagatgaaggctttggtgtctagctcgtgcctgccgtcaagtgcctgtggtcgtcgccctagtcttccgctgtttctcgtttgtttttgtgtgtgctgggtcttccctgcccatgtaataaattaactatttatgattccgcttgataaactctgaaatgtatcaactcttggtgtaccttgcctcatgggacaaggattaatgcacgcccgtcaggaacgccaggtgggttataaaaggtcgtgacatgtgtgctagttgaactaagcatggctaaacaatccctaatccaacatctaatcaagttacattccaagctagcaaaggaacatgataacaaataatatggctgagacagtagggtaacatcccatggtaacattataaaacaatgtaatatttaaggaaaacaatagagcatttgcaatctgggatcaacatattcaagtgacaagcacgacttgccttgcttttgggctgaagaaacctcggcgactatctcaaagtacaccggagcgtccgaagagccatg

SEQ ID NO: 74769 - DNA, 652 bp, Oryza sativa
atccgagggagagagagaggggaaagagggggaaacgggggaggggaacgcggggagtgattcccccctctttattgcgcgcggggccggcgggatgcggcggaattcgcggcggcggcggcgctagggcacgggcgggcggcgggcgcggcgggaggagggagatgacaggtgggtcccacccgtcagcgagagtggcgggcgggcccgcctgtcagcggcgcgcgcgcgcgcggggagccgatgggccgcgggggagaggagagagagggagggaaagttgggccgagccggcccaagaaggaaaggggggggaaagaagaacttcttttagggtttttctttttataaaccatttcaactttgtttatttcttttcaattattatttgtgctctgaaaattccactaaaatttatttacacattttaggcttttaggaaatatacaaaaatcctccaagcctcatttgacttttatctttgcacattttaattgttggaggctttcacattgaattttaattattctttgcacaatttcgaggatgaattttagagtcgttttgggacgcgacaaacctaccccccttaaacggaatctcgaccccgagattcggaagaactgccgaaaagatcgggatgggctgcctt

SEQ ID NO: 74770 - DNA, 668 bp, Oryza sativa
cccgcgggtaacgtgaaaaccatgtttaccgatgcagttacaacactcttccctttggccaaactttttgcttcattggctacaacctcatcggctgttgcaacctggcttttaacatgccactcttgcctgggctttgctttttccagccgatggttgatttcttgctccacctcttgaaaacgttctctgttcctcaatctctgaacccttctcgtcttattcctcgtgaaaataccagaaggacaccattgagtctttctatcctcattatcttcttgatcacggtcttggttcaccgggcccaatctctgatgaacaggaactcttgtctgcctcagccgattgcttctattgtaggatcagcttgagctctctgcggcatcactgcatccagggcaatcttcaatagatggcagcctcataccttcgttccagcagaatctaaaaaactcacagtcccaatgaggatcaaaaccatcatcatcttcttcataatgcctctcctgttgcttgtcgtattttctctagtacttgttgataattctagccgaattcatctgaaagttgtcgcgaccgggaaaattgccttttcccgaacgcgagtgtattaatcccagtcccaggaaaagccggggtacaccacacaaacatgatataaaagacac

SEQ ID NO: 74771 - DNA, 1145 bp, Oryza sativa
atatattttagggtcgttttgggacatgacaaaaggcctatagtttgggaaaacaccacctggcagatagactggccctgtagcttgatgctgagctattgtgccatcaaccaatgacttcaccatttttgttaaagtattgactaagactcctgattgattgatcaaagcatgttgcacagcgtagtcaatccgatcttggaagttgttaaactgaggttgtaatccattggcatctggaccaagatcttcaaccattccctcctgaaaaccatcacatttgtcgtgtagttcaccatcagtacctttatcaccttgagatgagcttgagccgacttcatcggcagcaactacttttaccttgtacttttggtaaactttcccacgggtttctacgaaagacttcatgaattgctcctgagcattcttcatcattatgtcgaaaatccttcttctgttctggtgagagcttgtccatagtgattggaacaatgttcccttcatgaacttcagacccagttggatttggaggcctgttttgaggatctgtcgacttgcccgtcgaggacggagattgcttttctactgacatgcttgccgtctcccactgggcatgccaaaagcgtgttgatgcgaaaacacgaggcctggaagatctgcttaacttcagtgcaggtccaaaaatcttgcctttaggttcgtgagcgtgccagttgatttgatcctgcaataaaagagaaataaagacaaagaaactacggttaaatccataaatggtagccgatcggccagccgccgatgacgtatcatttatctttgagccgatgtcatatgtgaatcgatcggcaatcatgaatcagtaagaaagaactaaatctactcgatcggctgtatatattaacaatatataatccttatgttgatatatacttaaatcaagtgattgggatagatcggtcgccatgccgagacagtataaatcacttagatcgaaatatatattaacaatgagattatatatgttcatagcatagccgatgagatagatttagcatgtatcgtctaatactccgataccactctactattaagatattaaagcaagtagaatatatcaaacagaagcctgatatactttgggggat

SEQ ID NO: 74772 - DNA, 1239 bp, Oryza sativa
tgttgttgtattacatggggttcgggatctatttataccccgagattacataacaaaatatgtccatatcggacacgactcttatctctaacaaactctaaaataccataagtctttacggctgacttttgcccaaacttatccttaaggaaattacatgaaatatcctaattaatagatacaattgacttttcaggacttaatctggttgaattgttgtttaacaatttcatctccaatacttgaattaccaaatttggttgttaacaaattgttgttctatctttcaaccgataaaggcaaggagaagtagtgtctcgtgggaattaggggtaagggtaagcccccgtgctaaagattatttaaactaagagagaatacatataccttgcacctgtacctttgagatatatagtataatagcaactcttgatcaacaaccaagtttttgttcctttcgtccttcactcgggacgagcaaaagtttacccttgggggttttgttgacggtcattagcgatcactttcgaccgttaatattacgaaaatagggggaactagttatgcttgcaatacatatatatgttagaataatatattccactagtattaggttcactaaccttttgcagagaataaacataaaagtggagcagaatcgacatcaactcagacgataaatcaatcggacgatgtcgaaaatcatacttatgcatgaatgggccaagaactcagaattgacacgatgaattgggccaaaattcacaagtctgcataaaggagcaacagaggaggccacctgtcgagtttgggccaggtgggcccagcccatggttcagccaaaacccgccgaacttcccgtggcgcctatgaatgcagtgtttggatggacggctgggactgttccccaatgacggttggagggtattaccgaccattccaaccatcacaaccgtcattacctacgtataaaaggagctcctcttctcacttcactcgtacacctcaagcaaagctctctcatattctctcaagtttagtttagtgttcttaacctaatggaataggaatagagtagaaatcggagtccggtagccttcggaagagttcgggtatggctctagaagctattctcttctcttttgtaagcttgaactttatttaaaacactcttctttatacatttatggtattgaaatacttcctgagtatatgaatcccaactttacattatgttaa

SEQ ID NO: 74773 - DNA, 1096 bp, Oryza sativa
accacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccttctggccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcacccctagcccagcccaaaaccattttaggggttttgaaaggaaggagcggtgtgaaaccaattccacaatagtccaccattccaaagtatccaggtgatatgaatatttcccaaagtctatagttgtaaaaccacctaatgttacctaattaaattgcgaagcatctacctaaaattaaactagtggtgtcatgagtggagtgtccactagttggggttttgtttgtctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgctttcccaaacgtcggcttcaacttccacgaagagcggatcttccgaagctgcagcgtctacacgaccaacggaaaagaaaaaggctttaactctaataaattccacataacagcagaaataaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaactcatt

SEQ ID NO: 74774 - DNA, 10626 bp, Oryza sativa
tatagggcgaattcgagctcggtacccgtgaataagcggacttgcatgcggtacaacgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacaagggtcacgtcctcgccgtcgagggcgcttcgcgggccacccgaaaggggaggcctgcgagcgacaaaaagaaggaggccggcgcttccagcagggagcgcccgaccggcaagtggtgcaccgtgcacaacacctccctccacgacctcgcggactgccgcgcggtcaaaagtttggctgagcggatgaggaagtgggaggaggagaggaggcaggagcgccgtgagggcaaggccccggcggctccctccggcaaccggcgaagtgaggccaagcagaaggcccccgccgaggacatcgacgatggcgacgatgacctagggttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcattgcccggggaggacagatcgcgatggtggtttcccccaccgtttgcaacgtgaagttggggcgtgtcctcatagacgggggtgcagccctcaacatcctttcccccgcagcctttgacgccatcaaggccctggggatggtgcttcggtcgtcccagccgattataggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccaggccccggtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggaggttgccctgggcgacggcccgtctaagaccacacgaatcggtggtcttctggacggcaaataggaagacgcgctcgtctccttcctgcgggcaaacgccaacgttttcgcctggagaccggcggacatgcccggggtccccagggaggtgattgagcaccgtcttgccgtgcagccgggcgcaaggccggtccggcagaaagtgcggcggtaggccccggaacatcaagccttcatccgcgaggaggtggcgcgacttctggaggccggattcatccgtgaggtcatccatccggagtggctggcgaacccggtcatcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatacaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccagcaagcttagggatgtgcaatgcgtcaccggctgcatggccgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgccccggagccagatgagccgctgctactttacctggcggcaaccccgcaggtggtcagcgcggcgttggttgtggagcacgacgaggacaaccctcaccccgcgcatccccaccctgtgtcgactcgacccgggagagagcagggaggagaggcccccgagccgaacggcggcccgaggcccccgacggccggagctggccctccgcctgcttgtcagacggtgccaggcgcccccgacccccaggatggccccggggccactgcgggaaggccgcgcctgtcgccctccgaccccgaggtcgtcggcacagaagccgagtgcgccccgcacgacctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttatcccctcggccaaatcttgcataaccgagagggtactggacgggtggtgaaatgggcaatcgaactctctgagtttgatttgcactttgaaccacgccacgcgatcaagagccaggccctcgccaactttgtggcagagtggaccccggcccctgagcccatctccgtccccgagaccagctcgggcccctcgcagctgcctcccaccgcctactgggtgatgcagttcgacggctccctatctcttcagggcgccggtgcgggggtcacgttaacctcgccaaacggagacgtcctcagatacctggttcgcctcgacttccgggcgaccaataatatggcggagtacgagggactccttgcgggactcagggtggcagctggactggggatccgccgcctcctggtgttaggcgactcccagctggtcgttaaccaggtctgtaaggagtaccggtgctctgacccgcagatagacgcttacgtgcgccaagtgcggcgtatggagcgccaatttgacggaatagagcttcggcacgtgcccagacgggataacgcggtcgccgacgaactctcgaggctcgcttcctcgcgagcccagaccccaccgggcgcctttgaagaaaggcttgcccagccatcggcgcggcccgaccccctagaggagacggacgcgcctgaacggcccccgaggcccgtcggagtccaggcctcgggacccgaggggagcgctcccagctcccttagattgattgcttggatcactgagatctaggcgtacctcacagataagactctacccgaggaccgcgaagggagtgaacgcgtccagcgcatctccaagcgctacgtgctggtggaagggaccctctatcggcgcgcggctaacggagtcctcctgaagtgcattcctcaggaacaaggcgtcgagcttcttgccgatatccatgaaggcgagtgcggagcccactccgcctcacgcaccttggctggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcggtttcgagtatctgtatgtcgctgtcgacaagttcactaagtggcccgaggcttacccggtcatcaagatcgataagcacaccgcgcttaaattcatcaggggcattactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaagaagcacggcgactcgtggatcgaggagttaccagcggtgctctgggcgaaccgaaccacgccaagccgagcaaccggggaaacgcctttcttcctcgtctacggcgcggaggcagttctcccattcgagctcaccctgaggtcccctcgggccaccatgtactgcgaggccgatcaagatcagctttgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtactacgccgcgtccaaacgcgtgctggactgagcaaactctcaccaatgtgggagggtccgtatcgagtgatcggcgtcccccggccgggctccgttcggctggccacggccgacggcacagagctgcctaatccgtggaacatcgaacaccttcgtcgcttctacccctagtaggggtcaggtgtcaggtctcgggctcgggccaaccccgcgccctcccaggcgtgcagagttggccgggggctaccacatgcatatccttatcttttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataatcctcggtcaccacgttcccggcctggccagtctcgacacacggatctccccaggcactagccccgacccgcgccatttgaggctgggacctgggcacgagccctcgttcaagccaagacacagaaggaccgcggcacagaccatcctcatctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcatcgctgtcgtccgcaccaccgtcaccgccctcctcgtcggagtctggcctcttcccaagcggcttcctcagcctggcgagcccggacagcctcctgggcagcttcctcggcttcccggaggcggtttgcggcttctcgccggtcagcttcccgcctccgggcctccgtggtcgccgtctcctcggcctcagaccggccagacttggaatggcgggaagggcgcgacgggatctcgctgaggcagaagaaaaaccagaagacgaaaaacgggtgagtgaaaacttgccttgggagatgggagaatgaatacggccgcagtgggcgcggggatgaacctgcgaggaggtcggctaaacgaccaccttggggggagatgagctttccccggcatggttcggtcccccctatcttgcggagccgcttcttttttcgctccccctcgggctacgacgtcggcacagcaccctccgggcgcctgctgctggcacgcaccaccccgccccctcggggaggagatggggagggggtatcctcctgtttcctcttcccccgggcgtcggcagggcggctgccccccgggcccccgtcacggggcccagaagcacgactccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgaagtcttcagggacccagtcccatttgaccccctggtgggtcctcatgtagtcctcggacccggtgtactcccaggcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcctggccggtggcagattccggcatgaatcggcgcggcagcccggcttgcctctcgctcacgatgcgagaaggcggcagcacgctaccgtcgagcggtgcggagccccgtgccatgacaccggcggaggaggggtttgagagcgagtgagtgcggcgagggtagggcacaggaaacgagaagttagagcgcaagcggcgaaggcaaggggaataatggcgaagaggaaggaaacgaatctcttcctcggcgtctttatacccttgccaacgctatgcccggctcctcgcttcccgcgcccactatctcgccccctcgtttctcgcgcccactcctccactaatcccgttcgcccgtttgcggcgcacgaggcggatgtgcggccgtggcagtcgagatgggacatatcgtgcgcgcgttaactacgctcgccgaccgatgcaccatcatcacatctctaggcgaaacgaaccggttcgtcccgattcgcgcgctactcaagtaatgtagcggtcttgaagaggccgctcattattgtcgatcggtttctcccttgccgatgcgcgcgatttgcgaccgttgggtttctgcccgcctgtggggaccggccccacctgtcaccgggcctaaggagtggcatctcgcccgatcgcctccctcgaggggggcggtcgccctagcgtgacgccggcggctactgtcggtgacatggggccaggggtatcgtgactagaggcttgggtagccgcgatcactcacgtggcccgaccccctcgggggggtcgggcccaacggtgacatggccacccctccctctgtctccccgaggggtcgggccgctcccgtttcggccccgagggctggggcgccccgaccccctgtggcgtcggcgccacgtgtgtgggttaggtgagcaaagcggccctcacctaaccacatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgctccgtcccgtcggaatgatgagagcctctaggcactcgtccctagacggagccggcgtgggaactcctggagttagcacatcggtctcggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaataaccgtgctcccacgttgcacctgcttccggcggagtggaggttggtatgacccatcccatcggagggtcattcggacagcagccattgcaaatctccgcccattaatgaaggaaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagagaggggactggaggaaaaagagagaagaaagggagaagaaaagaaggagagctcgtaaaaggaagagcggagctcgtagaggagagaaagagtgagagggtctctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacaaatcgagggcttagaatctcacctagcgcccccggccgaaccggcaaaggggggcccgcgcggtctcccggtgaggagccccacgctccgtcatctggcgcgccaggtagggggcatgtgtgtttttctaagctctcgtcctctttcgtgtgcgccaagcttttcccgctcagcccaatggccgaacgggcagtggcgcacaacctctctccgagcgctagcggtgacgacggggagcagaacccacgccgtcgagctcgtactccaccgcccccctctcgccgaagtcttaggcgggaggaggcgctcgagggggtcgaaagatccgcgacttcgccgcccacgagcgatggagaaggacggcgagacggggagcgtcgccttctcgtctacggcgatggtagcacgccccagggcgcgctccaagctgcgggcgtgctcttgtgtcacccgcccgtcgtccccgatccagagactccagcccaacgttggctggatgacgtggccgacttggtcatgacggcgtagcatcgcctaggcaccggtgggcggtcctccgccaccaaggcctctggcgctgctaccgccggctccgtgtcgtcgaggcggagggcgcggcgagcggcggccgttacccgccgttcgtcagccattccctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggttcgggcgcgggggccagcctcctgtgcccccggttggtggtgtcggctgtcgagcctttgtggcgagccttcggaacgtccgttggcccccaaggttccggcccaccatcaccgagaaatatgacggaagcgtcaaccccgccgagtttctccaggtctacacgaccgggatcgaggccgctgggggtgacgacagggtcatggcgaacttcttccccatggccctgaagggacaggcgcggggttggctaatgaacttgccgcccgcgtcggtccactcttgggagaatttgtgccagcagttcaccatgaacttccaaggcacatatccgcgcccaggtgaataagcggacttgcatgcggtacaacgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacaagggtcacgttctcgccgtcgagggcgcttcgcgggccaaccgaaaggggaagcctgcgagcgacaaaaagaagaggccggcgcttccagcagggagcgcccgaccggcaagtggtgcaccgtgcac

SEQ ID NO: 74775 - DNA, 31851 bp, Oryza sativa
atgacttacattgtgaaacggagggagtacctgtgatatgtatgatctgacccaattatcaaccaggaattgatttcaaagcggttggtggaaattaagagattacatgaagagagaattgaaattttgaacaaaatagcaacttttcaggtttgttgattggtcaagcacagaatgcatccttgcttagccttgaaggcccatgcttaatatttattgcatgggagaattttttagtatcagaacctgtatgactaactttgtgtgtgtgtttttaatctcctccagaatatcttgatggatttcaagagcattcgttcttcaaaagcttttcagcttgttaatgatcgacttcagaagtcacaagcagaattggatcactaccagacattattagagaaattacaggtggttactggtcagtggatttgttggattccagagttgtatagcaaaaatgtctcgctagagcatttgatcttttgttgaattcctatttgatatgtttcaggttgataaggataagtttgtgtggcaagaaaggcaatttaatttgaaagttgatctggctgagattcctgagagggtttctacatattgtgagtctagcattgctgatctcaagaaggatattcagaaactatgtgatgaaaaaaacatgcttattctcaaacttgaagaggcttcaagagaacctggtgcggtagttactattcactttaccaagagtaactttcaaacttgtcttgctaaagcaggtaataaggaattgtttgcacttgtcaggtcggaatcaagttattacaaaatttaaagctttagtgtcatcgataccaagggaaatgggcgcgatgcagagtgaaatgaccaaacacaaggaggcttccttggagttgaattctttgcgagcagaagtccattcactttctcgcattctgtccagaaaggtaaattgcttgttattggcttgcacatatgactcgcaagtgttatggcattgattcgccaatgtgtcaggctgtttattttgttttataggaacgtgataatgaagaagcatcatgcagatctgcccgtgcgggatctgatataacacaacttcaatcagtggtatcttgtttgtttagactcagcttattttttctcttcattaaggtgttttgtttagctattgcaggaatttgtcctcccatgataatttgacatattgaaaccaaaaccctgtagatttctgatctgaagcaaactaataaggagcttaagttgttcgcggatatgtataagcgtgaatccactgattccaggtatttcaattttatatcatatataattctcaacacaacttttttttttggctaagacttgtgatattttgtagagatagatgcatctcacttcttaggacagagtgcagtgtaatgccgtgtttaattgtttacctatcatgtatttaattcattgcacggtcactctactatggccatgacatttcatcactcatcaccagtaacttaagtttatttattttgtgatggaaataacctttttttgtgtgtgtggcagggaaataatggaatccagagatagggaattccttgaatgggctcatgttcatgccctgaaatcatctcttgatgaaagtaagctagagcagcgtgttaaggctgccaatgaagctgaagcaatcacacagcagaggctagcaactgcagaagctgagattgctgaatcagggcagaagcttgggacttctagaaagtacagaattatgcttctgaacattgtttctcttagaactgttgaagtaggggtcacttctcttttagggttactaaaggaaattgatgcttactgctgaatgttcactgtgttcagggatctagtcagtttatcccatatgctgaagtctaaacaggaagaatgtgaagcttacagagtggaggtcgaggtgtgtgccatcttttatgcatgcagttcaagtatggctttaaacatatattaaacattgtcatcctgagtttgaaacttttactaacctattccagtgtatcgggcaagcatatgaggacatacaggcacaaaaccaacaattgctacagcagattattgaaagagatgatgataataccaaggtagtgactcaatgatttctttaaagctattatctcagataatcctctcccaagcttatagttttataagagttcccatttaccactgtaccaaatctggttgcacaaatagctttcatgtttctgatatattcataggatgttagatttggttatattgttaatttgattgttccggagactcagtacttcattgaaaagctgtttacttgcgttaagttggtgatgcggaatttcataaaataggccaaagttccaaacccttgtggacagcaactactggttgccaaaaaaaaatccttgtggattcctggatgagtattgcctgccctttatttagatatctttttgaaaagaaagttagaacatttttctaaatgaccatcaacagttttttttttgggtaaatggtgttgtttcaaggtcaaagaaccagagaaaatcaggacgactgcgccttttaatagtagagataaattgaaaatttttagccgtgctatttgtaccatagctccttactctttggagtgcccttgataatccaggcagcctatccaagggtcctgaactcctgataaatctacagttccagtgattgtgtatgttttgatccaaaattttagtttgatgttttattgaaattttactgatagtaaagcttgtttacttcggatgtattgaataagaaatgtgctaactctgcatttggtatttcaatcccattgaggaatggaagctttaggatgaatcaatctggtagtaaactattttttcagtagtcgtaacatttttgtttggtgaaatctacactgcagatttttatggagggtgttaaagcaaaacagacacaagatgctttgcatttggaaacatattctttgcgcagaaacttgcagcaggaaagctctttgatggatctgtacaaccagaaaattgtttccttagaagatcaggtaggttgaacgcaaatattgtataatccaatacaatccttccaggaggtgctgaatattattttcccctgattcccagcttaaaatgtggtctgatcgggttgggaaacttcaagaggatggatggcaacaatctgtttcattgagtaattaccaaagaaagctggttgatgtgcacagagatgctcaaaagcttatgcaatcattggatggaatacaagcgaatgttggaagcagtcgtttggaagtcgctgatctgcttatagaacttgagaaagagaggtgctctataagaatattttacatttctatgggctaattttttccaatagctgatctaacgagatgagttacattccaggtttagtaagaagagaatagaggatgatttggaggttatgtcaaggaaagctagctctcttagagccaaggcacgtgaatcagcagtcctggaaaagcttcgtcatgaggtcaaggagtatagggggatattgaagtgtggtatctgccatgataggcagaaggaggtaaatgatcttgatttcgttctttgacactcttgacaatataacctgtccttttaacaatataacctgtcaaaagacactttaacagtgagcaatcaacattggatattcagatctaatatattccaattgcaggttgtgattaccaagtgctaccatctcttctgcaatcagtgcatacagaagtcccttgggaaccgacagaggagatgtccttcatgtagcttgagttttggggctaatgacgtgaaacctatctacatatgaggttgttaatttcaagatggtatcgcaggcatctagatcaagctactttgatggtcattacttggtcatatggttagatgaccatgcgagttgaagatatgacaagtactagcttgtacaaccaaacatataagcagaatgtagtagcctaatttggttggctacatggaattgcaggtgtctggcattcgtgatgctaatgtttattcctgctcccttgtatagttcgggattctcctggagtagttaagtcgctagattagtctgacttttgctatatccattctgttcttttggggaaaaaacatccaacaaaaggggtggtgcttcccgccatactgaaacattgtaccatatatagcttgtagttccattgttgtagcagacaataagaatgtaggtcttacgggttttccagattgtacatttcaggagattggcaatagcgaaatttcagttggatgcagtttgtttggtcttacctgaacggctgagtacctgaattttagtttttgttttggggctattaagctaaacctatgctgattgtttggttcgttgtacgcttaaaccttgatatgtcctctttttggcaggcgtgactgttaagcacaaagcgcacacccagaaatgaatcagctgtcagtgcgaaatcccatttgtgcactcaattttcaacctttcacttaaagtttgacatttgcgaaatcccatttgtctgggataggaacgctttacggtcccccaattccattggtgattgcattcaattgtagagctgcgtaatctccaccagctcttttccaacatctcctatcctctaacctttgcgacatgtgatgtgatacatccattttgtcttttgatgtatagtagcttctgacttttggcaacgtgacgctccgcatgtatgaaagctgacactgatcaccaagctcgcggacgatgcttagctttatccgtggagacaggttggtagagatggcagaagcatcctcttcttttccctacctatcgccgttctcttctttctttcatgggtgacgctctctccccatcgactctcatgtggcatgttgttgaatactagtaccccgtagttggttagcaatctgccttcgctgattcatctgataacaagctgaaacgagtagtcgttacggagaacggacgctcaagtgaagggtcacgtcgtgaaagttgcctcaatccggaagctaggcatcactcgcatttgacgctttgaggcctccacttctggaaatgcaagtgtccccctcctggttccctttttgggctccattccttgtggaaaagttgatgaatgtgtgtacctgtaacatgtgttcaggtcaatactgttctctgcgccttctacgacgtacagctagtcagcacctggagggttccactcagtcgcattgcattgtaatcatgtaaagccggggcgagtcctgactgcactcgatcaatcatcgcatcgtaacaacagagacatacccaaattgagcatttgactcgtggatagtgccatagtggcatacccccttcctgaagttgaacaaacaagggggcatcatccggcatgtggtttgtccttccagaacgttggagcagaggcagaggcgcagagcatttgctttgcagtttgcacagttccgtcgtccacgagacccacgcggtgatgagacgccctcgtcctcgtgcccgaaggctgtagtgcgggctgccaccttgcctcaccttcacctacccacctggtccttcaccggaacgaaatcacaaggagagggactgagggagtcccggaaaacggcgaagaagaacccagccgcgtgccgcgcgtgatgagccacgtctcgctcacgcccgcccgcggactcaaccgcgagctgattgcgtaaggtgacgcgcgccagcagttagccgggagcggatccgtggcaaattaggacgcgtgggttgttggtctgatgactctggcttcgtcggtaccccgcgggcgggcgatacggtgcacgcgcatgcgtgcaccaggccgctcgtggagaagggggatcgcacggcggatttcgcgtgcggcagcttgctcgggccgtggcaggaagccgagaaccgatcgtgcgctcgggctcgtacgcggcggcgcacatgtttctcccaccggcacactgggtccgacaacgaaggtacgcagtaggacatgggagggatcgttccggttccgggcgggcacatggctaggcgtaccgcgcgccacatatgcttcagcccgaccggatggaccgtctcgctcctctctagtgaactgcttgccttttacatctttcacaggctctctcattgccacggtataaattagtggggcgctttaacatggcggttaaggctctgtttctttcagtttgggattattataatctaaattattgagtaatctagattgttataatctgtagtaaaataagcggttagttgtttcttttctagattattagagcctagattattgggtttgcaagtctaaatagggagtggggtggtatggtgggtaatttttcatccaatattctggaaaaagctcacctaaatgaggttatcagattataataagttgggctacagattataataagctacttcaataagttgtctatttctttcagcttactcctaataatctggattataataatcccaaactaaaaaaacagggcctaattctcgatcatctgagttagtgagttacctcaggaattatatggctgcatagggaatttgcagtactactcagagagaaggcacattaaccggcatttccaattaagttccaacacatgagaaaaatgtggcagcgcgaatatgcggcagcagtgtccggtgtccgtacacgaacccagaccatagtaacgtcgttttgctgcttggaatgtggggttcaggaccacaaagctatagcacacgtagtaacgtctgtatggtccaggccctgaaccaagggatccgcccgagatccatcgcccttgcttgccccgggcatccgagacagcatcatacgggagtacatgacaacgtgttaatccattgtaccgccacatgacaacaccggtagccccagtttaaaccccacaccgatgggaatacgacagcttttaattacgcaccgcactctcactgcctgatatacttctgtggtgtatcgtgtgttctttatttgcttgctattgctgaaccgtcggttcctgtctaaggttttccaatttattttaatcttttgtggtgttatttgtgtcccctgcttttcatgttgtttatgcggatctagagattttttttcatatgtatacagtcatatgtctgaatgtccccacgtaaattgcttgtgctgatgtgcatgtatgaccacctctatatatgcgtgggtttatctatacacgttcaagtgaaaaggattgacaaagagtgaaaagagcaaaaaggcaggtaaaaagtagtactacatactattcgtacatagtagtaagatttttctttatcgtgagcaaggattcggattacccctctaatcttagcttagctgtctgtgatcatgcctacttggaatcgccagacgaaacccgcgggccgcggcaagtgtcgacagtcgaagcaggaatggacttcatatccctcacatcatctaccctagtacgtactactactggtactttcaaatcttttcacgcgaagtttcatatcgcctccctttctcttttgctcttttgcaagagcgtataatccagcgtacaacgtcatggatgaaccccgaccattggccgatcgggcaaatctcatggtgtctaatccctgcacgcgcctttgctccacgcccagttgtccactgtcccttttaattattcaccatgtcttctctaaatagtcgctgcccatcaaatcctccggtgggtaagacgttcctgtcagtctctggagctagctaacagcagctgcggctgtgttaggtcgatcgatcgatgcaacacgtgcacgggcgccacgcaaatctccttccaaacaagccagtcacgctgattagcggatggctaagctgtgtgtgttggtgccagatggtaataataacaagtggccactctgcagacgcatttccctgtctcttaaagctgggtgtcgatatgctcttgatcggtaaaaaggacaacgtatcttaccgtgatggagatagacggcctaactgtcccccatctccgtcgtttcttccattccggcgctgtacttttatcaaattaccattagctatcaccatttgtctacgtgcgtgcacagtatctcgcgtgacttctacgactcttatgttcggtctgatactctgatgagtgatgagaataaaccaactgctcatggtagcagttgccgccctcgcattgcatgcatgcacacatatgatccgtgcgtgcgtgcatggcatgacaaaaaagtatagcacaccgcgtctgcatgctaatggagacgttgatgagttgctcggtcgatcgatggcgacctgctgcatgcggacgtatgtatctggatcctagtaaaaaaatattctacgtgccgccgaacacctgtcctgctaatcacaacgatttcttaatttaatttcacttcttttgcctggccacttgttaacctatctgccctgttttggttaaaaggaatcaacgccctcggataacatacttatatggcggcctgcaaacctcaaccgttgtcgttttacatacttatacgtataattgtacgcgactaaacgggagtaggcatcatggatcagctggactccatgcgtagataagccggcaattagaatcgtcaatgttattaggactagtactagtgtcatttttttttaaagacgcactatccattaattgctatctgaaagacacagttttctttttaaaattttgaataagaatgtactagttcgtctataaacttgtggttgctaatgggaggtctcatgtggccaactttagtttggaaattctaaatcaattcatgatgacttgatttgtgcagactgaagcagattgggtgcagggtactgtagatatactgcaagtcccagtcctccaactgtacgtacacactgcatgtcaagatttcggcgatcgacgatcggttcatccccgacatgacgcgcatgaaatttgtgggaattgatttggacgtgatgcaaaatcaacgtcggggacaacgacggcatcggaaaggaggcccgcgatattcttctctacacgagcaccgctttcacgtagaatttcttggccaaaagctggtgtcgatcgaaggctcgatcgctgcatgctagctaagatctcgtcgcgtcgctctcagggtgccgatccgatattcaattccagtggttggttgccgatggccatcagcgtgacaggcacccccgtgaaacctcctccactggagacaaaattatattcaggtgatggcgaatttggcgtcgacatggcaacagcacaagggagaccagtgcgtttttcagttgcttctttttaaccagttgggctttctgcattgtttctgcgaacgagcacgtcatattgatcgactaatagtagtttatattgcacgaagttagataaaaagagaggccacgccattactgtggaattacagcgagaggtgtcctaattggcacgataatgatgccaccaaaaggtaccatatatctctgttagaaaaagtactaatactatatctttggcaggttaagcgttagtagtacgactttaggcaatgtgtatatgtggacagttcatattcagatacagaatactgttcgaaccaggcatgcaccagccgttaccaattacacaaacaggggcaggattggaaggagaatacttggagagaacgaacggttttaagaagataatgatttgtgttccagggattaaatacacaagtttaggtaggataaacagaaactaaacagaagtcaatggtttttttaagcttttgttaaattttcttctttattattcaattgctcaagctacttacccagggctggttgactcgatgcaaatgcttgtctagttgtcttgcaaaaaaatatcagggttagttggacaggaatcattcgatttgatttactcctccctttgattcctactacctctgtcttaaattagcagtcgctttaacttttttcttgtaatatttgatcattcatcttatttgaaaaattagtataactataaaaacagagaagatatacttaaaatacttttgataataaagcaaatcacaaacaaaataaataataattctataattttttatataagacgaaagattaaaagttataaacaaaaactcaatgacaagtattctggaacgtagtcagtagctgccttttcccaccatcaccaatctgatgaccaacgcaatctgatgaccaagagagcatcaggccattctagtgcatcacatttggcatcagaacagaaacacgagtcaaagaccaaacagcattatacgtatgcggcagcatatgttcttgttttcgaaatccaaccaaaccttactacagtactcttatcaaaaagagtgaattacgctttggaccacattttattacctaagttttactttgaaccacccttaaacatatcttttcattttagaccgaataaatttgctattgttacgatttggaccaccacgaacaatttttttaagtacaattaatgacgttaaacacattagctctagtatacggccgaacttctctatgtgtggttcatatgtttgccgaaagggaagttagacatgacgagaaaagttgttcataatagtccaaaccgtaacaatggtaaatttacccggtctaaatttaaaaaatatatttaagggtggtctaaattaaaacttgggtaataaaaggtgaaccaaaagtacaatttactctatcaaaattaaaaaccgcaccgtgatgtgcagatggggggagggggggtcgaggaaacttgaaacgcgccaggaggagaacgcggcggggggcggtgcggattgaccaccggccacgcggcggggagcgcacaccgatgcgtggacgcgcgctagctgccgcctgcgcgatacaccgatgcgtggacgcgcgctagctgccgcctgcgtctgccgcctgcgccccccatcgcgcaggcgacagcagcctttcgcaccccccgcgtgtcgatgaaactccatcaattctccgtacactagcgatcgggcgacgtcgcggcctctctctggccatccgtgtcgctagccagccgcggccgggccgcccaacccagcttttcacaatccctgtgctgcgtcgggcgcatgcctgctgtacggaagaagagcacggcgacgcgctgctgctgttgctcatgctctttagcgccaggcagcgttgctcatgctctttagcgccaggcaattttcattttgaccgagcaacgccaaactcaaactactactcttttcgttccaaaatataaacatttttaacacagtgacaaattaaatatttttaactttgaccactaataacaaaaaaaaataaaaaatcaatcatataaaattgatgttactagatattatttaaaacatctaataacatcaattttatatttataaatattgttggttaaaatagtatctcggagatcatgtaagagtttaagggggtgtttagatggggctaaaactttttagcccatgtcacatcggatgtttggacgctaatttggagtattaaacatagactaataaaaaaactaatttcataaatgagagctaatccgcgagacgaattttttaagcctaattaatctataattataaaaagtttactgtagcatcacattgtcaaattcatgacataattagactcaaaagattcgtctcgtgaattagtccaaggatatggaatgtgttttgtaattagtgtatgtttaatactctaaattactgtccaaacatccgatatgacatggacttggaataagtctctggaaaccaaacaggccctaaaaatatttatattttgtgacggacggagcagtagtactaccgtggagtacgagtactctacttctactgcctccgtatggtccaacgacctcgcttcagtacgggatgctactagcctagattacgagctactactaggcggcacataagtgtaacacaccctccaatctccgtgagtgctttgacttttcttttgttggtgaaactgcaatcaatcatatccatgcctatgccatggccataccaccaataatcaggcacaagcaagcacaaagatttggttcgtagtgtcccccgcgtatgccaactacacgctcatcctgatccgaaaccgaaacatagtcagtactagaagtatgaaaggggttgcatctagaagaagatgcactttatgcatgcattcctactacttctactgctacactgtttagttctttagctattgtagcatcacattatcaaattataacgtaattagacttaaaaaattcgtctcgtaatttacatgcaaattgcgtaattgatttttttttcatatttaataaatcatacatatgtctaaacatttaatgtctaaacatttaattttatatttttaaccaaaattttttggatccaaccaagacctgcctaatgtacaccagccaggcaacaaacgggctgctgctagtatgctccatcctccaattctactcgtaccgtcaaaagacccagctcccaagagctgagagacttgaaggggatgcccctagacagtgacaagatgaagccaacagctcctcctctctctctctctctctctctctctcttcagtcctcacagcagatgcgcagctgtgtcccatggcgagcaagagagagcgccgtactgccgtcagcgtgcgtgacagtgcctccagattggtggtacgactcgccagcctgtaccccaagcatctggtctcgccagttggacctcattaccacgaacttgccatgggatgggacacctggctcccccccggcctgaacggctgaacctggtcgccgcacgcagggatcgtaaacacccttctcgccgtattaacaaaccggttcgcgatctaacaacggagaggccgagaccgtatgcacgttggggaggagacgaaaaaagggacgggaaaagattagcccgtcgctgcacgtaacgtgtccgatactccaaggaaattggcagtggcagcacaacacacaccatatggccccgatcgatcagtctttttttttttttgagttgccccgatcgatcagtcattcagcgatggatggcatgcacgacgacggtctttattctccgcgaccttttttcatgtggttttctcatcactgttgcttgaggagcagagcagtagagaagcatcaatccatgttggtctgcgtctctgtgccttgtcgtcgtgccgccatgctcgacagaatcttccttttccatgccaatgcgagccaaatcaagagctcctgctaatgcacggacagttggatactcattgcaagtggttgcacggatcgatcgacgtaggtgtgccgccgtgattttagacgtattctccgagcacgtatctccagttctccactggctagttatggcgggaatgcatgtatgcagtactctgattgattctggaacgtactacgactagtatttctatagtactatactaatagtgatacaatccgtatacttaaccccaatatagattgaaattggacagcggagacttgtgcttaactcaagtgtcgtttccgacgaggatccgacacctgcctgaccgcggaatttataaaagcatagcaggagtattgatcaccacgaaaatcgacaggcttacgtgcacaacgtcgatttgggcaaaggatttggggatcgcagaaaccgcgattcccccatgaatgcgcccccactgcaaagctatgagtattcaatttgtgcctcagaccatcggcaacgacgagtcagccggacctaaaggaaaattgttcacgcaatccatccacaaggaccgagttaaaagcagggtgggtgcagtgggagtaggactaactggtatagtacgagagtaggagtactcgttaagatgttaaccccgggacaagttgttggtaggcaaactagcggccaggttaggctagttaacccagcggatcaagccaagccatccgtctaatccgagccagccttcccccacaaggatcaaatcgttcgcgcgccggcacatggtctcttgcacgaaagacaatcatcgggccggcagcgcggactggtcacgcaccgtctcgcaggcttctcgagcggccgcattggcgtcttccggagctcgcccatcacccacgcgcacgcacacgttcctccaggctgacgcggcgcggacaggcgagccgccgtggccgcgagcgacgacgtacgtacggcgggcgaagcgtggcccgggctgtgcgacgacgagacggcattaactttggcgtagccgggaagccgctgtctttacgcggaaaccgtcgctttcggggcctttatgcgctcccgctcactgccgcgccacacgtcgccatcgcggcgcagctctgaaggcagtgtgcagtgcagtcgtgcaggtccaggacgacgacgagcgggaggagtcaatcgattaatcgctagcgcgtctcttctcttttcttgtttttttgttgttgttgttgttgtgctgtggttaaggtggagctggaaggctgggacgattttgaatggcgtggacgaatcttaccgtggcttccaaggccggtgacgagctgctaaaacaccggaaaggtgcaaatcggatgcgtcatgcgtgaatatcacactgtccatttggcccaaatcttgctggatcactttttaccactaaacaaaacaagctagaaaagggatagtcgaagataagatgcttgttaattatacatattcttgtcccccaaatcaagcaaggcgaggaaaaggaactgactttatacaacctcgcatgctagatttggcaaagaaaagaagaaaaaatggaaggaaaaaaaacaaaatacaaagggagaaaagaagaaagagaacagagcagaagcagagtaaagaagaagaaaagaagcaccgccatgtacaagccactgatcgatctaatacacggaagcatgactggctcccatgagcagccacattgatcagtaatcccacagcatgggctcctcgaggcggaacacgacgccgccggccacgtcgtcatcgacggcccacgacgccccgcacgagaggctcgaggacgtctcgtatctcaggtccaggagcaggtccgggaggtcgaacagcgtgctgtcagggtccgcttcggcgtccggcggtggcggctgcggcgaggcggcgctggcgacggagcaggtgtcggggctcttggcattggcgtcgacggagacggaggggaagtcggctgcggcggcggcgagcagcgccgccgcctgcacgtccttgggcgccgcggtggccgggcgcgggagcaggtgcgcgaggtccgggaagttgaggtgcgcggtgcggcccttgatggcgagcgcggccacgtcgtgcgcgcgcgcggccatctccgcggtggcgaacgtgcccagccagatgcgcgacttcttgcggggctccctgatctcggacacccacttcccccagctccgcatgcgcacgccgcggtacgtcgggtgccggccgtcgttgcgcggccgcttcttcggggcgacggtggcggaggacgatgatgtcgacgtagacgaagacgacgaggacgccgtgtcaggggaggtcggggaggccaggtcgtgggagtcgtccatggctgccgcggtggtgcgggtgtggactggagtagttggaggcttggaggggagcggagtggagagggcaatggggttttatggtgtggcgcagtggcgacgtggcacgggaagataaacaaagggccatacctggtttgtgggccaggcctctttttcctgttttttttttcaattttctgtttgagatgattagtagtagtatgacacggctggaattaattttcttctactccctccgttccacaatataagagattttgagttttttattacaacgtttgaccacttattttatttaatttttttttgccaacataaaaaacgaaaagttgtgtttaaaatactatagataataaagtaagtcacaaataaaataaataataatttcaaaaaattttaaataagacgagtgttcaaacgttgcaagcaaaatcttataatcccttatattatggaacggagggagtatataagttcaatgcaaccgatctacccgtgttaatcaggtttatggcatccaggtcagtgtggaatggattttttttcggccaaaaagtgtgaaatggatttattgcattgtgcacagcaatgtggtgcaaagatatttggaaacgtggaggcaagtgttatctctaaactgagatttactattttgtcatggttcaattacctggatatcacatatttaaattctaagctagacagaatatgctttcaccctgtcattttcctgagtaaggggacccaagttcaaatattctttcgtgggccatttatgtgtatatatgttgaggactcgagaaaatcgtcatgactatcatatttcttttgtagtttaatgcttcccaacaaattaaaacatgttcaagaaacgtttttttgttggtttccaccaaacaccaaatttgcaaaagagaacaaaaatactactactcattttcatcttataagtcattttaacatctttcttaatcaaacttaaccaagtttgattaagtttatagaaaaatagtaacatctaaaatatcaaattagtttcactcaatctagcattgtatatgtttttgtaatttgtttgttttgtgttaaaagtactactatagtttttttataaattgtgtgttaaatctagaccgtgctatgtctaaattcgtagttataaacgtcatgatttaaaactccagcagatacatgcatgtacgactctataatcacataaatgacaaatccacataactcagttttagcattataatgcagattttccgcagggacacgcgaaaatttcatttagttgagcaattctaggtgaggatccttggtggaaacaagccctatggtagttcgtgtttttttttttgtcaagatatcctataacctgtcccagatgggaaactaacaaaactggttgttggtagatcactgctatataaacaattttttttacgagaaccatacaatttgcaggcggatagtaagttagtaaccaatagcctctacaaaagttgacctgcattttcgcgtacggtttgttaagagacccgtataaaaaacagttttctcaagtgggtctcttaacagagccacatacgaaaataagcttattttcacatgcagactcttaaacgatctcacgcaggcgaagcctcttaaagctatgtctgcaagtctaatcacactcatctcttccctcccaacaacttcaaattttactaaggcctagttctatttctcaactacaatcttcaacttcctcattttccgttagcacgcttttcaaactactccatccgtcccaaaatataaacatttttagctatgaatctggacaactgtgtgtctagattcatagccaaaagtggctatattttgggacggaggtagtattaaataatgcatttttttaaaaaaaattatatatagaatatatttaaaaattcatataaattcattttaagtttataattattaatacttatggcatgtttagatcccaccccaaaattttacaccctattacatcgaacgtttaaccacctgcatgaagtattatatataggcttaaaaaaactaattgcacatattgcgactattttgcgagacgaatcttttaaacctaattgctccatgatttgacaatgtggtgctacattaagcatttgctaatgacggattaattaggcttaataaattcattctcgcggtatactgacggattctgtaattatttttttattagtgcccaaacatcccatgtgacaccctatataatatccgatgtgagacgccaaaactttacacccctgaatctaaacaccccttaattaatcacgtgctaatgggatttctcgttttgtgtgggtcaaaaatatctctcaaaacaaagagatcgaacgcagcctaagcctcaatccgtatctcctcaacttctctcccacctctcattcccctaatccctccccactcattttctctctccccacacattttctctccgtttcttctcctggccggcctctctaccaacctctcctcaacctcctcctcctcctctctctctctctctccccaacctcccctcggtggcatcggcagccccaagcggcagtgtgtcgatagcatgggtcgtagccatcccgtcgccacagctggatccggtggcgtgcggcagccgtcctgtcgccaccgctggatccggtggtggtggccctccccgcacagccccgtgcggatccggtggacaacataagcacccgtacatgaaaatcggattctcgcacgcaggtgagtcatccgcatgaaaaaatagtgatttttttagatattttcgaacagacgtgtggatcaaccgcacatataaataggttttacctgtttggaaacatacttttttaagtagtggatgttgataagctatgcgtatctacagagtcctgtattttatttattttttaaatatgggaagctaactatgagcaacttcattgaagaagtataagactgtttcacctactaataatagaaggaagctacagctggacgtttttcgtatactcttccaatatagcattgtgttctctctaaattgtaagaggttgagacgtggttttttcttatatttcgtgatggagatagtagtagattattacggatgacctcagttgtagtatggtgctaacaagaatacggtgggcttattatgattagattgagtcaaggactgctaaacaaggcccccgtctgcagtgccttactgccttgagccttcttaatttccaccatagaacctacgtatacgcacatcgaagcgtggcgatcgataccccaaggaagaacatatcgtcggacaaggcgaagtccatggcgccgccggatccccacccaagtttttacacgggcgccgccaatccgttcaggccatgccgtgcgttgatcgatcgatcatcgatgcacgcgccggcggtcgaagccaccacgcttcgtcgaccgtggccggcccgctgctttggacttggacgcagagttgagttgccttgcctgggcatggcgcgggccgtgtcgtgtcgcaagccggccgcgactttccacgctcgtgggcctgtgaaagtggggacggtgtgggctcaaccacgcaccgctccgcgcatcacgcaaagtcgcaaaacacagcttcccgtaaaactacttcgggcgacttttggttgacctgctacaaaaaaaaaaaaatcctgctccttccaccgatggcctggttacagatttcagcctttcaggtgtagaatcgcatagaaacggaagtgagatggaacgagatgctccgcgtagaacggacaagtcactcgacgatgagatggcacgcgacgcgagcgcccccgcggtctcacaggcagcaacgcaccaactctcggctctcgcacactctcctcctccgtaatccgtatctatgctgattgatgcagaaatagctaagctacaagttacaaccaccacatactgcaggttgcataatcgtcaaacagtacatatattcctacactgttgccgtaccatgattgggcgagtccgcattctgttggactgctgcgagcgcgagcacgcgacgagtatcacagtgacacgggaacgtcgaaacggccccgcccataacgctatcatttaagaacaaacgtacgcttccaatctccatgtctcctcattcccgcgtcctgtatatgaccatgtactactgtactattctcctctctgctcttcacacgctgtaattctaccggccatatgagacataagaggaggcgtaccactgatcaatcgaacactgcttccgtttggttatgataattaattagggtgagtttgaggaataggggattgagaagattaggaaaatatgaaaaatgaggtgagccattagcatgtgattaattgagtattaactattttaaattgtaaaaatggattaatatgattttttaaagcaattttcctatagaatttttttgcaaaaaacacaccgtttaatagtttaaaaagtgtgcgcgtggaaaacgatatgctatctcactcattgtctatggaactaacgcacccttagagcaagtataatagtgagctataagcttactgtaaacttatgtggaggagagaggtaacaaaaaatcaaaggggttggctctcatgcaagagctagcttaacacaatctccaagacaaatacattaaatgtataagtgagagataaagagaggagaagaaaattatagccaaccttatagctaatattattatatatgttggctttaagatgaggtgagctatactattatccttgctcggatgggggagatgggaacccaactcctgcgcacggaaaacagaatagtccattaacgcgtgattaattaagtattagctaatttattttaaaaaaaatggattaatttgatttttttaagcaactttcgtatacaaactttttttaaaaaatacaccgtttaatagtttgaaaagcgtgcgcgtggaaaaacgagagagaggggacgggaaaaaggtgcatgcgaacacagcattagttaacctgtcgccgatgatgatgtaacatgtgtgctacaggtagccgtgtgtcctctgcaaacgtactgtactaccctcgctaggctccggcttgtgcattacacgctgtgatgactgatgagtaacccgtctgcaacgatcgtcgctttaccagctgtatctaaccgttcatcccatacgtctgtttctaggattcttgcaaggaacattgttgggtagcccagcaattaatgatggtaccatgtacttggagtagttttgatttaaccccgtgtctcaaagcttcaaaaggaatagcaaggccaccatcttctaactcgagtacatgtgtaaatagcttcctcttttggtttgtcgagagcaggattttctcagcatgtcgacggtaaacccagcattttcaatcacgaaaacttatagctgtgtttaagaagggacgaagggagtactttgtagcagatgatcatataacagtatagtatgaaaggaagagacatacaagaccatgaaaatgtttcggaaacacatcaaacaatagcgtaattatggcaacactgaggtcgaggagtggaagatggagattggaaagggaggtataaggttgtgggcatgtgtcgacataacataactcgacaaatacccgctaaagtctatgagctctcacttcatggtatgtggagacccacagcctcatcttttcgcttatgcttatcaactaaaaattgaattttcaactttaaatataaagttgatttcggtgttttttatcgaagtttatttttcaacatttacgtttatatagttaagaacatatatataaaaattttattcataaattattttttgtttgtaaatatatcgtttggcttattccccgaataagcgtaacgagggatccctagccaaaaattgaaaaacgaaaacgacgaagatcatctctcatctagaacttggacatgaagtaataaagggagagtagttttaggtcttaaagaaggtattggatgtatcttaattttaggaggaaactccaaattagacatccgattttctgtaaaaaaaaaacggacggtcaaatatttcagttgaccacccgtgaaacattaaagagagaatccattatatgccactgactttgttacacctctacgatttaccactggctttgtcacgttctataatatgccatcgactcttgcttaacttctacgatttaccatcaccgtctggttagcctccgttagcattgtacaattttgtccaaataaccaaaatacccctaggacaaagacttccaaaaattggataaaattatcaaaatatcatattataaatataagattgtaaacatccaaaatttggccaaaaatttaaaatttgatattttagaatttgtatccgaattttgaaagtttttgtctcaggggtattttggtcattttgacaaatttgtacagtactaacggagactaaccggacggcgatagtaaatcgtagaagttaaataaaagtcgatggcatattgtagaacgtgacaaagtcagtggcatataatggattctctcaacattaaattatacacgatgaaaaaaatagtcatttaaacatttttatttttttaaaacacaacaaagatatacattgaaagatgtcgcaattatgtattcaacttcgagcgttaacggattgaaacatacggttttttttcatcaaaatataataatgcaacatctatttataaatatttaattacaacaaataaatagtgtgagtagatcgtagattgaataagtagtttataagaaaaaaatatttaaagaaaggagaagagaataagagaagaagaagagaaactagctagctgcacatgcgtgtaggggagtgttagggggttcgatttgtttctcaatcgggcgcccgagggtgagaaatctccaaatttttaatgtttacttatggtacattttgtcacttgacatactcccttcgtcctaataaaaatgaatctagtactggatgtgacacattctagtacaacaaatctggatagaggtatgtctagatttatagtactaggatatgtcatatcatctaaaagttactatattttaaaatggaggaagtattttaagagctgaggtagattataaaaggatctatggactctggcccattaccacccttaccccgggtcccttgcctcttgagtattgatacccaagtctctgcaaaggtagagctactgtttttaaagatcaagaatcgtagaaaatctttttgcatgacgtgcgtgtgtaactagtttatactcccaatgaatctaggcgctacatcaactttattagaatattatagtactctgtaaaattacttgtaagaatcttaatgtacggaaattgtatatgcttagaaaaaaattatttaggggacaaggggcgaatatataatggcgtgttagagcataaaacttgttaaggatcattaattctggtagctccccacaggcccacacagaacatactccagcagggaaggacaagaggttggcagattaaactaacggaaaacagagaagctacacaaattggcttgtcttattttgtggcctttactgtccagcacttaattatagcttctattctcgttgtaaactaaacacccagttgatcttgatggttctcaaataaggaaatgggcacaaaatcttgagatctcttggaaagatatgctgtggtatttcttcccttccaatcaaaaaataggcacctaattaaactacttatacatattatactttacgttgtaccacttgtcatgcataaactacattttctttataattgcataaactacatactccctgcattcctttttacttatcatcttttctcaaaacaaattataaatattgaaaaagatgatgtattatcgaagtaatttgcatgctaaatatgattattatactatttgtgttcaccaaaacatcataatttaaaagtttttactggtcaaagataaatttacactggtcaatagtgtcaaataaaaagaatggagggagtatacaaaataaatacttgcatatccacatattattcatatataggccttcaaagaccgaaacgtgattattatctggcttcagcctgtaatgcagggatatttgctgaatccagatcgaagaagaagtttgtccagaatttaaaccaaatcgtactagtaatatgcccgtgctaaacgctacggtgcaattcgatttatctttaataattgttaaaatttcatgttagcggaaatttttttctatgatatgtgcatttgaactttaattcaattcatgtcgtacattaaatatatttattttacgtaaaatataataatatgatactgcatgggcacaataaatctttacaagaattaagtatatataatcacttcagtatatagtacgctattatgttacaaaagtgagttattttattatttgttgcggaaacaaaataaagcattatttgcgatctggaggaggtgcgggagagaggctgcagtggttggcgatttgacggaggggaaaggaaaccgagtggtgaccgcgtgcgcgattatttgtgatccctaatacattgcaggggaaatctgttatgtgctgcctactcaaaggcagaattttctaagccaatctcattgtcatccaaagtactactgtcaatgaactgacaaaagaattgatgaaccaaagcagtgacatacttctagacaaacaacttgggcgaactgagagagctcccatggttataacatatggaaactgatcctacaataaagaaaataatttacactgtaatataagaaaacaacttttctgctacttgaggtttagaaactgaacttgaggtgatgtgtttagaaactgaacttgaaaccatggttctggtttgatccacctgaacatctcatggttatccataagtacaaggcaaatatgagtagatggctaattcgctatggagcaaaataatactgaaagactggaggtggaggttaccttctgttgtttttatgtaatgaaatatgtgacacagaagatctcaagaaaagtttctatgtacggataagggctatggcttataaacatgttcatgttttttttccggtttgcaaattggtattctaacctggaccagaaacctaccatgagttttaatattaacataattgttttgcattggaataatgaatgttatgcaaacattatgcagtctcctgaaatgaatcatccgataataccaaagtaaatgaagcagcaccgcatttatagagaaaaaaaatgttttccctaagtagtcctacacttccagttgtaagaaggattcaaacttcagaaaaatcacccttccatttgtattcatgctttaaaattgtaaaattttatcttatattcttttctttttaccaatgctttcatacacttcggggacagacggcggagatgagacgaacatgggtagatgcatggcaacctacggagcggcgacagttagggttgggagatgccgcagcgatgtggtggtggcggtgcgtgtggcagtgccggttggtagtggccacggaggagatcggcgtggtgtcactggtgttgtcctcgactgtcggtggcggcatggagatgtcgagggtgggctttggcggcgccggtgtggccccccgaggtggaggttgccggatgttgtatcaataatccctaatcctatacagcaaaataagaaaatcaggaggaagattacggtggtgcaatgtttcatgaagcttattgcactttgcttaaaaatgaaccatcttggtacataattagccaaaagcttactgaagtcataagttcatcttgaccaaatctgtcaagaatccagaaacagttggattgtcctaacatatgcatggtgatggtgatttcattaatcaaggaatgaatctctactatactgataattgacatagatggtgcatcatcttaaatattctgtcactgccagtgaaaatcgaattttaaggtttgatttctgaaatgtgtaaaatcttaaataaccagatactatatattgttctttggagatgtttagacatgtgcagacagttatgcgttgttcatagacatggatactttagttatcattatctaaaaacatgaattctttagataccaaaacgatgctttcggttttctttcttttgattgattctggattatattaagaaccgtatgatcaaatcagcggcgactgatggggagagaggaaatatatataatactggattgtggattaaaaaaaggagagaaggatgatttctgtaccttaatttcggcgaatcagatcgaggatggggcgacactgttctgaaagcagagatcggtggttgcacggagacggtcgacgagccggagattgggggcggcacgaaggagaccggcgacgcggagttcctggtggagatcgggggcggtgcggaggagaccggcgagaagggcgatgaacggcggagtggcgagtagaggagacaactggcggggtgggagggcgggtgcggtgtgcggcgcgcgacggcggagtgggcgatgccgtctggacggcgggtaggggcgcgagcgtcgggagacgacgggggcggcgacgtgcataggcgtgatgggcgagagaactggcggaggagatggatttcgcgatcggaaggaaagtgcgacgatttcgggggtgcaggggtgagggaaggcggatgctattctggacgtcaaatctcttagggataatctggaccgttgagtgacgaatgaaagaatgagtgaaagtatttgttgaactatagggtagatgaggaatgaattaggggagactcatttaattcggactttactcagtacagtaaacaatgtatggcgacaaggatcattaactagcgaagctattcgctgggttaccctttttgacgttgctctgaatctaccttgggtaacaaacgtgtgtgtgtttagttcacattaaaattaaaagtttggttgaaattgaaacaatgtgatggaaaagttgaaagtttgaagaaaaagtttggaactaaactcggcctgtattccattcacttatagcaacatggagagtacctactccctccgttccaaaatataacaattctagcattcaaaatttatctgaatatagcaactttttcacctacattctcttctcaaccaattataatcttccaccattcaaattctccaccaactttctctttctcaacccatcacaaattttttccatttaatattatctatttttttaatactcgtgtccaagcttaaaactttctatatcttgggacaaaggtagtagctactatctacagggttacaggtccccaacttgtcacacagttgcacttttaggagtgtaaaatatgctggcgatttggtctacacacgtctccaatcccctggccgcacagaaatagtaaattaagaattatgaaaaaccgtcaattagaacgtacttacatcagactaaccccatgcatgtgtttgtttattctcgcagtcaagttgaagcccaataattggcaaacaaatcgacttatgtgcgcatcaaatcaagcatgttaacccaataatatacccacatgcatgaaagcacagaaggtgccatttccatggcgtcccgcaagccagtacaaaacggcactctagatgccgcctaaacagtaaacaattaactcttaagtctctacagcgacaccgatgtactgatgtactcataataatatgcgtgaattcatggaaaaacttggattgtgcatgctgtcgtcctacgatcccgtatgctccaaactgtcgccaacacacttctggtccctaaagctaattaacctcccaagcacatgtcttttttaagactcacatgccgattctttaatcgacgtaatgaaatcgcgctagaaaccaatggaaaggccataggtaccaggaatattgacccgactcaactaacctcatcgcgagaaatttgtgtgccggccggcgtgtagatttttgtagtttaattaattaggtgatgaggcgggcgctaactattgcatgcatccacatgcatatgggttaccaaccatactaaaaacttttcagccactaactacaccttaccgtctccgatctttgtatgtcatgaccaatctcccggccgggatggtacaacttagtagtataaggctattcccaacctaataactaagatggtgtccatagcattaaataggctgccatctaggatgaaaaatgatgtggcaagtgaataaatgagaaaagagaagaaaaccatgtcttgcatgagacatagtttctacacaatatccaagacatcatgtgaaataagtagcattaaatttaagtatggatagtggtgtttgcattggaagagtagtgtctagtactaatttcttgatgatgtagagtttatgaaaattatgtatagtgttttgggttgggaatggtctaatactccgtattgatgtagggattgctcatgatggttcatataaggtcatacatgtggaaaggagccattgggcaaggaagaaactttaaaggtaaaacggctgaagacaagaagagacagaacggtagttagctcgttaattctagaatatttcttgtgcgttgcatgattgtgtccattgcttcgtttatttatttatttttggggacgtgtaacgtccatagccaaattggaataacaaacttgtgagtatagtgttctggcagtgtggggctcgctagctaagctagtttgtggagagcgagctggcttgattaattatcttaattaagaatagcacgttgttttatgaaattaaacaacacattgtcaaaacggggccaaatgatatgttacaacaaaaccttcaataatataagataattaaaaaacatttgataatatgtcatccttgaggtggtattttcagtttatgagataccaaacaaaatccaatctttcgatagtaaggatgtggtgggtatttcgaatcttccccggcgcaccccctatcaagagtaccacatcatacaacttgtcaccgctcttgtccgcctgcattaggatgccatcaccctttacattctccttagtttgcccgcatccgcaacactgttttggcgttggacggcaagggtgctacgtgctcagattcagtcggtgagcttgtggaaggacctttgcatgaggtggacatcgccaacaagctcaaatgtgcgagattggagggaagagcggagcaggaggtgaagattgtcggcaactccaggttgatctggctggctagcttggaggtacgagcttgtatctcgtaggcgagattgggaaagggtcaagcgggaggacataggttatcgacaaactcagactccagccgatccggtgccacctctccctctggcatggatgatcacgttgcctctccgccccccacgcgtgcgggtccactggccgaggcgatgtgaggggcggatcttgcacccttccctcttctacacagatcccgccacctctccacctcccagcccctccagtgcacaaggatccgtcaatggcggtgacaggaggggtggatcctgtgctcacttcccctttcacgcggatccgccagcctctctacccctaatcactccgccctccacatgcgcgggtccaccggctgcggcgatgtgagaggcggatcaggcacccttccacctcccgcgcggatcccacctcctctccacctcccaacccccttggtgtgcaaggatctgtcggtggtggtgacgggaggggtggatccagtgcccgttcccactctcaggcgaatccgccagcctctccgcccctactcgcgaggatccatgggcagcttcaagcgacttaagtacctgcatgcgaaaacacaatttccacatgcaattgctgtacccgcatacagaaatagtgattttcgcagatacctaggtgcaggtgagccatccatccgcctgcgaaaatcaattttgaccagattagaaattcgtttatgtagtagtatgccttactatggatgtcaatatttgagtgtgaagctatatggtgaactctagcagttgcatgacttattggagtttaagtgtaggccttgggtgggggatggggttgagcatgtggtgaccagtggggccaagaggcaaatagtttttaagagatgaaaggcaattaatggtgatgaatcttaccgttcaaaatagggagccataaattgctgatggtcaggaggttgcgagtcccatcagttagccatatacggaataagccgttttggtttattagggaataaaaattaatttattgataattttttatatacgtgtttttggtaatttaaaaaccaatactgaaaaagaactatatatgttgaatatattttaaagtcaatattaaaattaagcttgaaaattcaaattttagctttatctttagctaattagggcatcccaagggagtcctgcaaaacatgcacatagatggtggatataattgatggctgatgctagctgatgaagtgggttagggttgggtagtaattgattgaaactcttaaatggaaattaaaaagaaaatgtagccccaatttgtttggaagtaagaactttgacagaaaggaggatcaaccagagagatgatactcccttcatctacttttgatagtcatatttcatcttggcacacagtccaaggataggtaattctacttatcatccgtttaaacatgctactagtcattcctcgtaatcaaacaattcattaatatttacatttctcgatgcccatgtagccaatcttgtgtggaagaatggagagtcacgtattaaattcgagaaagtcattaagacgataggttgttggattgaaatatgcttatcaaaaataattttttttagatttagaaatatgactatcaaaagtagattgagggagtatatgatagacactgggtcatcggctaccgggccaaaaattgattggctattaggctgtgtggagaaaatgtaaggccgggcatatatagacaattccaactcaattattccctccatctatttttgatagtcatatttcatcttgatacacagaccaaggataattaattctacttatcatccatttaaacatgctactagtcattcctcgtaaacaaacgattcattaatatttacattttctcgatgctcatgtagccaatcttgtgtggaagaatggagagtcatgcattaaatccgagaaagtcattaagagaatatgttgttgaattgaaatatatctatcaaaaataaattaagaggataggttgttgaattgaaatatgcctatcaaaaatatgtctatcaaaagtagatggagggagtataatatttagtaaaacaatatatatgaattttattgacatgtgacaaaaatcaacatattggtccaatctttaactaatgatgctatcatcgcctcatcggagtggaagagactaagccaagtggtcagtaacactctcaagttgacctagatattgacagaaagcatctaaaataaacatagtccgtgcatgctttgacaaaaatggaaatattgtccatgcatgcatgcattcaccgtgccggcgttgtggtcagtgttcccagagcaccagtggctcaccaaagaagaaatcgtcagcatcgtcatcccacggcgaaccgcaataatacggcggcggcggcggcggcaacgtgaacccgaactctagaagagcatctggcatggtgaaatacgtgtagtctagtccagtgccgccgtcctgctgcagtgtcccgttctcaacgatgcaaaccggcgccgtcgcctgctcaggctccgccggctcgggctcgtcatcggcagcggcgtcgacgtcgtggcatggcgtg

SEQ ID NO: 74776 - DNA, 6823 bp, Oryza sativa
actctctctttttttggccttgttttgctgtatttttctctgaattttctggcttgcggattggcagtgtccttgccatgtcctggttactattactgtttctccccgtactattcgacgaagatgctgcttgttcggaatgatatcctgtaactgttacgtaccttgttacggtcattgagtttgcatatgcattcatgttgactttgtagcctagagtcattgaagtttgttgagagagattgtgcgtcctggttgtgagatattcgataaattgtgatatttgtgctgctaatttcgacctcaagttgctgcgcaaattgcagttaactgattaactcattgcctaagctttattatagaacagttttttctgttggactactgatttggcctttgttacagatttgttcaaaagtggtgagaattgacctgttaatttccactgccgattattctacatggaagtttgctgattgtgactgcattgttctattacaatactccagttggactagcatgtgaacccctcatattgtccaactgaccacatgtggatgtcgacctgagttgattttgtccctgttatggcttgttggccgttgcctaagaacttacagtttcagagaatgctagctttgttctgaagaatttgtcagctttctttgtatcctagtggtccatcctttcccctctgttctgagaatatcatacctgtgctggccagattgagcatttttaattgtggagtttagtaatagatattcaatttaatatggtatatgattagttgaagtaggtagccatgttgggccaggaagcttagccattattgagtcatgtaactagcaagagtatataatattatgttattggcactaatgaagttacaactaatcatggaggaacaaatatggacataacaaaactagaggaacattagtgatgttgtaacttataagtaccatgcaagaataacagtggcattattagtggaaccaatgaggtgattaatggggtaataatacatgcatctttcagaaaaaaaatgatatttgaattcagtttgtcatttgataacttaagttactggtagaattggcatgcaattattgttactagatatattttccgtcagctgaaatacatgctctttttgtcttgtgtggtcttgattcttctagtatttatgcatcttcaactgtttctttaggaaagatgatggtgtgaaggtggtctctgtggagaatttgaagaatccttatgaaaaacaagggaacttcaacatgcgattcaagttgactcttaacaagctgtatgcatggagcctagtttcctatgaccgagttgttatgctagactctgacaacattttcctccagaacactgatgaattatttcagtgtggccagttctgtgctgtcttcattaacccttgtatcttccatacagggctctttgtgcttcaggtaggattacttgctatatgggtttctcctttcttctgcaaaatttcttttaactttctccatgtaaggaaagatattagctcttaatctcttcattactaggaatgactatgaatcgacctcctttagtccattgcatctacaaaggcattctgttttgtttagcacttcatattaggggtgatctaactgccatttgataagtaatccttcattattgtttaattaaaagatctatgcagttttgttgccaactggtttactgcaaatcttttacctgaaattaataagcttggttttagaagctgcaagcttatattgaatctgttttcttcctggatattagtctttagctttctgttggcctttctcaaagcacagatgtatttttcaggggcgcgaaacacagaatctacaatacttcttaaatctaaacctatctaatgcacgggccaattgctgttttttttggcacaatattctgcagtaggcaaattcaaaatggttatgacaactcctactttgtgcactcattttttttgtcatactaaccagttgttacttattaatcaacctgattttctctagtccagaaccatctaaagttcatcaaatgaacctgaatattgaaatttatgtcgtcatgaatttttttttctttctattttgttttcagccctcaatggacgtttttaagaacatgctacatgagctagctgttgggcgtgataacccagatggtgcagatcagggcttccttgctagctatttcccagacttgcttgaccgaccaatgttccatccaccagttaatggtaccaaacttgaaggaacatatcgtcttccgttaggctatcaaatggacgcatcttactattgtgagtatcaatagacatatacgaattcgtatgctcatgcattttccccctagactaatgggatatttgttcagatttgaaactccgctggagcattccatgtgggccgaacagcgtgattacatttcctagcgctccatggtttaagccatggtattggtggtcttggccagttttacctctgggactttcttggcatgaacaacgccgtgaaaacttggggtgagtaattttctcagatattttgtcttgcattttatttgcatgattgaattctgatgttaatagaatcttccactaatgcattgcttcatgtacaaaatttgttagcatggatcatggatggtaatatcatccataacagtgtatcatgtgcactcgtgtgattggttaaatgccctttgtgaattgctttctatcttctttagaataaagatgtgtaacaggtcattatcgagccttttacattttagaataaagttgcacaaggcaaggaattattgtgcttctttttttttgtcaggataaagttccataaagtagtggattgcaaagtcttcaaccttctgtcatgttttttaggataatgaagcatataacagtattcatttgtgcatcttaattctgaccagagggttgcctttcctgactatatgtaaacttgatgcaaagcaagtattcatcggagctaccggttgtattaatccaggccctattttacattggagtcattgcagtcacccgacttgcgcggcctagtttgtcaaagatgtgctacaacagaagaatggagaaaagtactatagttttgctcacaacactcagagtagtggcagcatggtccatacttgcagcttacaccatacccttcttcctgatcccacggacggtgcatccgctactaggttggccactatatttgcttggtgctttctccttttcttcaatcgtgatcaatgtattcctcctccacccccttgcggtcctcacaacatggttggggatcatcggtgctctcttcgtgatggcattcccatggtatttaaacggtgttgtaagggccttggcagtgttcgcctatgcattttgctgcgctcccttgatctggggatctttggttaagacaatgagctccttgcagatcctgattgaaagggatgcattcagacttggtgaacctaaccagacagccgagttcacgaagctttattgaggtgtgtattgcagatacatgtcattgcatttcatcagctaattccgattcgcattggctattctgatggccaattcagttgtacaagtaaaaccgcagatgaaactacagttgcacctttaacaccacctgaaacctttggagcccgtgatattcttcgtaattgcgtaggtgacatacagggcaaagggagagaacatagtttgatgtttgtgtgtggggggtgttggttgtggaagtggaactgcagaggaacattatagagtaatttttttgttacttcatttactgctcctctaaaagagccaacacattcttggctttcttgtaattgatatcatcagttccacacgtccactatcatgagattcaggtgttctttgcaaaatgctgattggaaaaagaaaactatgtactaccactggatatgcatttgcctttccctataggggggtgagtggtgacgttgcaaacaccaaagtaataagctttgcaaatatatggcggcacaaaatccaatcgtccacttcagaatgttgtcttgtctcgtcttgacaacgacgttggatacgacaaaggtgtttctcatgggcacggcccagtgatagaggtaactgaggttataggttcaacccggaagaaaccctcctctcaatgtcgatgtttcagtgtattacaagtgtttttaaatctttcccgctctcttcttttaaaaaaaaacacgtcacaaacgcaaacgctcacaacgtttgtgcactcatctctataaacgcaaacacgcacgccccacttttatgaacacctatgaaaaactaggtcggcatatcttgcgcgtgcacacttatccctatcaacgtacatacactatacccttatgagcacctccagaagattgggccgtatatcttgcgcgcatagattcacccctataaacgcacacaggtacatcctacctccataagcacctttgaaagactaagccgacatatcttgagattaacgaaatcaccacagatgcctcgctgtcaacgggtacatcgcttaccattgaaagaataattagccataaatatgaacatccgagtcagctttaaaacttgaacttaggtggctggctccaccacaagggactaggggtgtcaatttctccatcggggcgaccctaaggggccgggggcaaggtggaattctcacccgtgggtagggggcgcaaacagagttcactccctcgccgtccgccgcctcgttgtgccccctcgttggccacctcgtcgtcgcaccccctcctcgtccacctcatcactgagccccctcgccgttgccacgtcatcgcctgcaacctcgccgtccacctcatcgacgactttcttggttaggttgcggggcctcggggcgggtactgattttcgccctgttcatccctcgggggccggggacagggatacccgcaagagcgaggggacgggagcgttccagcctaacccggccccgtcccggcccattgccagtttgcaacccttacaagtaatctaacaagttgagctacgctctattcttttgctatgggttggttacaagggcaaaaccatcattttgctaagcctagcactcgactaatataattttgtaaaatcttcattttttatattttttcaaatgaattttggcctctttgatttgtagagaaaacaacaaatattggaggattttaatcctaaaaagaaaatactaagaagtcttttgaaacaaatgatttaattatattcttcctctaaaattcttatgtaagggataattctatagagatttcagaggaaaattagcaagagctttaaccccttgaaaatatccttgaagtctctcactctcatttgattcttgtgttggtctaatcaaatgactatttctacattcttttgtgttttacaatttgttttgcacttgtatttcttatatttttgttaactagaaaaatacccgtgtgttgcaagttgcaacagccaacaggtgaaggctattttaatttttattattgttatatggtttagttaaggtgaaattcattgggggagttcgtttggatatatatatatatatatatatatatatatatatatatatatatatatatatatatatatatatatatatatatatatatatatatatatatatatatagagagagagagagagagagagaaaatcctgtagtaggagtctggtcgtctcaaattagcatgcgagtttttttttagagaaattttttatatgactccttctgtattttcaaaagtgaacgaacttaaaacccgacccatacacggatgacgtaccaaaggaccgtaaaaaatatctttaatttttataatagtagatatatttatatgtttttattcatctttttttttctgtcaaagggacgacggaaacatgcgcagggctccacccctgattagttaggtaatactaacttgctgtattttttcttcttgttatacatgtttggaatttatagtccatcgagtaaaggaatggtactgtcctagtttagaagtggaacggtacatataagattttcttactaaaagttttatgaacaattaaggacatgttcttttctttaactctaaacttcaacttactcatttatgttagcacgattttcaaactattaaataatatttttttgcaaaaaaatatatgtagaagttgtttaaaacaaattaaataaatctattttttcaagtttataataattaatatttaataaatcgtatgctaatgaactttcttgtttcacgtgcgtaaaaattttccctctaatatgagacgagcgcagccttagttctatttaattatctaatataacgtgttctcatccataccttctttcaacaatgggaaccacgtcatccccttttcctaaatcttaagagccattttgaatagtagaaatagaaaaaacattgaattcatatacgattgtaaaatatggagaaaatatagaaataaccgtttgattggaccgtatgaaaaacgtagaaataagatgaagaggtagactcaaagaaaatttttcaagaggttataactcttgctaagttttctctatctctattggatcttcattccatagaaatttcaaatgatacgataagatttaattctttataatctttattataaagatattcatagaaaattattttaataggattgaaatcctccgaactttctattgttttctataaactagttgga

SEQ ID NO: 74777 - DNA, 1006 bp, Oryza sativa
ccagtcacagaacctaagccaccctctagggtagagtcgttagtcgcgtgtttctttgcttgtgtgtgtagcgcgtggtttgcatcagtggggtgtgatgtaaccatgctaggttgtttgcttaatcaacctgcagaaataagcaaaacaaacaacacatcaacaaaaagagttagttcctttaaggtcttgtccctagttctggtctattctttccttgtatgcttcccctctcaacctctaccttgtgacagatggataatactggtaacaaaggctatgggaacgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgattggttgcgcacaatcaagaagaagctagggttgattcagtgcaccgaccaggagcggggtggcttcgcaactcatcagctggttggaccggcttcagagtggtgggatagctacgaagcatcacggccagaaggacataccatcacctggaacgagttttcatctgtattcaggagatcacatgttcccgcaggaatgatcacactaagaaaacgagagtttcgctacctgaagcaaggagatttgaccgtcacagagtacctgcacgagttctatcgtttggctcactatgcaccagaagatgtggaaacagatgaagacaaacaagagaagtttctccaggggttaaaagatgagcttgcagtgcaactactcgctagaggattatgaaaattttgagaaacttgtggacaaagccatgcaacattgaaagtgagcataatccgatgacgaactgc

SEQ ID NO: 74778 - DNA, 1988 bp, Oryza sativa
cttggtatctagcagaatcagatccgaggaaaaaggaatcccctgaatttctataggaacggcagggctataatactttgctgtcataacccctccaggggtggtgatgagcagagggtttctaagcctttctacccccaactgacttttccccacgaatggcacagatataaacgagtgggaagctccagagtcgaacaaaattgtagcagggatggaatggatgaggaacgtaccaacgatgacgtccggagttgtcagcacgtcctcggccgtcacgtggttcacacgaccccgaatgacgtccttcccaccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagttggcgtaggaggacggggtgcacgagtcccttgttgattctgctgctgctgcggctgtgggacgcgcaccacgaattgaggtcgaggcgcggagcgagattgctgctgctgttgttgctgctgtgaggaggatccccctggatagggattggtgtagcggaccctttgattagcaccctgctgattgcggaagttcgccaagcggcgcttgtgcgactccagctccttgtgcttggcctccaagcggatgctcttgtccaccagacgttggaagtccgggtagtccccagagactagacgaacagacagctcagggtccattcctgccagaaacttctcttgcttctcctcatcttcccgcacatcctccggggcgtaacgggccagattgttgaactcatgcaaatactccatcacggagcggttgccttgcttcaactcccggaactccctcttcttaagagccacaactccggcgggcacatgggttctccggaaagcggcggtgaagtgggcccaagtgataggttgcccctctggctgcgtagcctggaagtggtcccaccagagagatgcgggcccctgcagctggtgggcggcaaagatgactttctcttcatcactgcactgcacagtgtccagcttcttccccacggcatgcaaccaatccaacgcatccacggggttgttggagctagagaaggtaggtgggcggatacggaggaactcggcgagtttagagtgttgtggaggtggtggtggagcattctgctgtggcggattttggaggtggtggaggaaagcagtcatcatgttggcctgctgggcgaggatttgggtgagaatggcgttggtgtctggtggtggtggtgaaggtggattgccttgggggttggggttgctgccttcgggttggttgccttcaccggtgctaacatttctcctggtcgtcaccatctgaaaaccccacacagaaccagcaaacagagagagctaacgattaaaactaaccacccacgactaccataaatcttgaatttattactgatattaaattggttcattaaggttcaagttgcttaggcaaataaaaacaagacaggctccgacatagttatgccacacaccggcataaccatgccccacacaactcaagaagacaaacgaggaaaaacacacgcgcaagcctactaactactcgactaccgctgcgacgggccaggacggaaggcgagcaacagcgcatcctccgtgctgccaacgccggaggcttccccctcctgaggaaccacgggcgcaggctcggcacgaggggtctcgacgaagcaggtccacgccaaggactgacgaacaagctcgggcctggaggtgctcttgcgggcggtgatcttctggctgcggcagacgcggcggcgcttggggcggctgtcctctccttgggcgagcttgagctggtgcagctgcgactccaacgcgtcgaggtccttcttgagctgcaggttctcctgacgcagctccagaatcttcatgtt

SEQ ID NO: 74779 - DNA, 3460 bp, Oryza sativa
cggtgttcagagtgtcgtcctgcagctccctcaaattggccatcatcctgagggcggcctcctcacaagcatgctctaatgtgcccttgcaagctgtcacctccatgttgggcatgtaggaggggatgccgtgaacctacaagcgaacctggtgcgggaactcgccactgagagggtggatgctagtgtattgtggctcccttggaaaaccgatcacgaacgccatgtgggacaactctgcaatgaagcctcccatagtctgaccttagtgcgttaggggacagccggtcatctatagaagacaaaggatggagaatcaaggcatgctcaaatccaattatagaataaacggaaaaggactcaaataaaataagcgaataagagcggaattttgtgcatagatcatttttgcatgagaacgaataaataagactgatatacatagcaataagataatgagaaattagatacatagtagtaataatagtagtagtagtaagaaattgatataggaccaggtgatagaccaaggccaacatttatcagtaagaatttatctccagagttcagaactaaattgatagagcttttgaaagaatatagaaattgcttcgcttgggagtattatgagatgccaggactcagccggaatgccaccacgacataccggaaagaggccgtgataggacccttcacataaacctctctaaccaaacacaccacacctcaggttttacccccactcctcgcaaggcagccggcaatcccctctcatacctaggtgaatccgaaaaccgcataggccgtcgcagggcccatcagaactccatcacgctcacccttgcctggatgcgtcagctagaggagagctacactacaagcccagccttgcccacgctggcttgtggcaagtacgaggaattcttccagggtttcccgcgaaccggtccttaattgccatgggtgcggccatcaaaaccattatcacatcctgatttttgtttcaggatttataaattatttaataaattaataatagaatttatattaaatgttcattaatttacaagtgaagttaaatgtgggaaataaaatttcctaaatataaagcatggatggatttaatttttattaaattctccatgattaagtcaactctctgaaattttctcggatttttcagagctcaattcttaaataatacaaagaacagttcagtaattatttgatcattaattatatttgttaagagcttttcttgtttaaaaacccttaaattataaattgttgtttaaaaggaattattagaaatgattttaaaagcttaaaagagaagatctagttttaatttgctaaatctcaacataaaattgggctagataaaattttgttaaatactttgcttaattctataattcttagatttttctgggatttatttgagctaaggaagtatttttaataaatggaattgcatttaagaaataatttaaattgaaaaaggttttaaaagtcttcttttggctttgggccgaaagccggcccaaaacccttctctctctttccctcggcccagccggcccagtccgccgagccgccgctctcctctctctctcagtcgctgacaggtgggccccgcttgtcagcttcgtcgtcctccttcggccgccgccgcccgcaaaccctagcgccgccgccgccttcttcttccaaatccggccgcgcctttccttctccggccaaattgatagaggggaaacaatctccgggatctcctcttccttttctcctttggaaacgtcggccaaatcggtttggaatgagtttgattcgagttcgaatcggatcggctttcctctctccaagccgagcttttcttcgccggtgccgccgccgtgggcctccgtcgctgctcgctagcccctttaaaaggatccccgagctcccctctacccgtcgcctccctcgccttcgctcgccggcgtctgtagcgccctagcgccgtgctgcttcgcgccgccgtcgtcgccgtcgctccagccgtgtcgcgccgccgttgcagtcgccgtcgtcggtcgccgtcgccaccatcgggttcgcaaggtcgtcgtcgtcctcgtccgccccttcgtcaccgctgaagaccgccggagcgccgttgccgccgtcgacccgaagagcttcgccgcttccttctcgtcgccctcgccgtccgttgcccttccgccgttcctttggtcaccggtgagttcgccgcgtcgtcctcttcgtcttggtgccctccgtttgtgccgaagtgccgccgttcgccggcgagcatgcgagcccgagccgccgagccgccgccgccggggtgacgtcatcgctgacgccatcggagccgttcgccgtgagccggtcgtggaccgatcgatctcggccgtccgttttggatagggttgatctcggccgtccgttcccgtgaaccgccaccgtgcgcccggtccaccgaaaccctagcccgctgacgcaataatccttcttttccttttcaaaaataattcattattgcgtcataattcaattaaaatcaatataaaggttttaatccgatttaatctttaaaaattcataactaattcatttgaactcagtttaatgtgcttcaagttgcaaaagttgtgtaaaataaagatctacatcttaaaattgtccttaaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtatggtttatttggtttttattagtcttttccttcgttttgcgtgttagcttgtcgtttccgtcgttgcgaaggttcgcgagtgcgccggaagtattcaagaagattaattgaagaccgaatattgtaaggcaagtcacacagatcttaaacacaatcctttgagcatgttgatcctatatttaaattctctatttatttcaactgtgcatttattttcgaatgtcactgggtggtgtgaatctattcctttgttatggcctgtttgctatatatattggttcagctagatattagatatgattgcttagccatgcttagaaacattagcacacaactgggataacttattattcactattatttaaggatggtctaatgatagttcacgatggtcaatcgtgattggttaattaattaattgccaactaaaacttgataatgatgggttgttgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgatatgtcctaaaagcctagaatgtgtaa

SEQ ID NO: 74780 - DNA, 2006 bp, Oryza sativa
ttgattactttattccttgataccttgggtaattataattggactagttgagctttatatatattggttcaactagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattatccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctgataagagtaaaactattcgaatagccgtgcccgcggttatgggcgagttgagcaatgtttttcgtgattagtctcacacctctcacaatatttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactattttacttctcttaaatgttttgctaaatgctgcttttgcaaatgagcctatattatgccatcctttggtatctttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttgttttccgctgcagttttcttcatgatgaggactaagtgcctcataagtaagtacttatcgttttagttaatttgattaatctgtatattaaattgtcagtttgtgtacctcggctgattcctggacgaggattttatgcacaaataagttcggaaattactagtgaatttccgggcgtgacagtgctcccggtccaccgtggaccgagaggctgacgcgtgggccccactcccgtggacccagtccgcgcgtcctctctcccggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagttaaagccttttcttttccgttggtcgtgtagacgctgcagcttcggaagatccgctcttcgtggaagttgaagccgacgtttgggaaagcgagcaaggcaagacacatcatcttgatcatattgaatcccagtttataaaattattttgatttaaattaatgcattaccgctttatttaaattcccgcgtgatcactgttttatttagccatgcctatttacctttgttatgaccttaatactattgttattgatattaataccttgttcaccctagattaaacaaaaccccaactagtgggtactctattcatggttccactagtatgaatgtaggtagatgcttcgctgattaattaggcaacattaggtggttttataactttagactttgggaattctcatatcatctagacactatggaattgttggtttatggtggaatttgacataca

SEQ ID NO: 74781 - DNA, 4938 bp, Oryza sativa
ggacccagggtcaggttgccagttcggtctgaatcatcataggccttgggttaaggcaggttcgtgtgggttcacggccttgattaataacattgtataactctaggatcgcgtttacaaaatagctttgagcaactaaacgtctttaaatgctgtttactgcaacgctaaccctttattataaattcccttgtactcccttgcatttattctgcatttgtgggtgtgtcttgttgagtacggtggttgtactcagtcttgctcaatttttcccaagtccagaagaggagctccttggagatgaaggctttggtgtctagctcgtgcctgccgtcaagcgcctgtggtcgtcgccctagtcttccgttgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacatcataactatgggcacggctattcgaatagattatactttgatcagaggtgtacaattttacccacaagacacgttttcctcacgtgaaaccacgtgccacataccaccatggcatacggacggaagacgtgacataccatcctagccataaacaagagtaccgacccaaccctgtctacggccggaatcccgggacaggtaaccaaggttgagcccctagcagcagaacaccggccctgtgccatgacatctcgactactgggccgcagctcgtgtagccttcattctccctagagatgtccatcgagccccgacttcgtccatctctatccgtgtacttttgcccatgaccagactgagccacaaactacgccttacccactagacatgtggaagtacggtagtgctttgcaacagaggcccgagcttaatccttatattggtcggggtgctacttcccacaactggcatgcaccaaaaccccaccgaaaaacaggttttaggggttttgaaagaggaagagatgtgtatgtccaattccaccacaagccaaccattccatagtgtccaagtgatatgagaattcccaaagtctaaagttataaaaccacctaatgttgcctaattaaccagcgaagcatctacctaagttcatactagtggaaccgtgaatagagtacccacaagttaaggtttcgtttatcctagggtgaacaaggtaataataacaatagcaataataataaggtcataacaaaggtaaataggcatggctaaataaaatagtgataacgcggggatataaacaaagcgataatgcattaatttaaatcaaaataattttataaactgggattcaatatgctcaaggatgatgtgacttgccttgctcagagagaacaaccttctgtaccttcggcgacgaccacgaaccacgcttcgggaacctctggaacgacaaaagctaccgaagcacacaagcaaagctacaagcctaaaaaagaagcaataacaatacataaaaagaaagcacagggttctttaggttattacaaacattaggagacttgaacaggtcgattcagagttcgtatgaccaaggcatggtcatccgaagtttaatgctgttatatggagatttatggattattataattatgttttgcaattataaaacatgtgtaagagctaacctggaaaagacaggaaggctgcgctgttgacatgcggaccccacatgtcaacctaagggacacgacagaccgggtacacagagacggtccacgggtcgacggaagcgggccccgtgtgtcaacagaggcgagtggccgacaaacagactccactagacaccacgcgggccgcacacgtggaaaccacgtggctaccgagcgggcacacaaacacggtcaccacacgcacacacgaacgactaccgacaccggtacacaggtaccgggttcgacaccgcacaacgggcacggggcgacaccgaaaggacgaggacggggcagcgagaggagagagatccttaccaccacgcgacgaggcgtgggaacgactacggcgaacaggcggcagagatgaacgggaatgacggagacgacggcgaggggacgacttcggcggcgatcgttggatgaaggcgagacgaggctggcacaaggcttgacgacgcggagccgaggatgaagacgacgacggggctgcggcatacttgacgaaacgcgggcgacgaacggacgcggcttgacgaagggagggccgacgacgagcgcaaccaggaacgaggaggaggcgacaatggcagccagcagcagctgcacagagacgagaacggtgtggaacacgccactacgatgccgatgatagtggcggcgcagcgagacgatgggccggcgaggatggacggccgactggagaagtcgtcgatgaggacgaacggtgacgacgatgaagaccggtagggttcggatggaggggaggcgaggccgaggacgaccttgtcgctgtgatgccgaaggtcgtggtggtgtggtgcggccgatagtcgcacgggcgaggaggaagggacggtcgaagggacaccggcaaggatggcgtggaggcgacgtgcggtggcttcccgaccaaggagaggcttggccaagggagaggacgacgctgcgacgccgaaggaggagacggcgatgtcggtcggtgtcacatcccaaaaatcttaaaaatataaattgttgtttaattggaatttttagaaattaaattaaaagcctacaagttaaaccctaattttctaggaaaattttcaatataaaaatgagctagataaaattttattaaatactatgcttgctcctctattttctagaattttctgggaattatttgagcaagggaagtatttttaataattgaaacaacatttcataaaatgttttattcaaaaaagttcaaaagttcccccttcttggtccttgggccgatttcggcccgtctctctctttcctctctctcctccgcgcgcggcccaagccggcccagccaagccgcccgcgctcgcgcccctctctcccggaggctgacaggtggggcccacctgtcagggccgtcttcaacctccggacggccgccgccgagccgaaccctagccgtcgtttcccgctccaaatccggccaaatccgactccgttttctccgattgattgaggggttttgttcctctcggtctcctctttctttttccccaagaatcaaagaaatccgttgaggattcgatccgaatcgaactcattttgatttatctctaaaaaccgagttcgtgttcttcccgatccgattcctctcgtttgcggcttggtctcttcgattcgagctcatataaaccttccccgtgatctcctctttcatttgcccttttcccgagtcctcccgtgcctcctagcgccgccgcgacgcgtcgcacgtccgccgccgccgctggccatcttcggcatcgccgccgtgccgtctccgccgtcgcctttggtcgccgccaccgccgttaggtgcgccgtgaggagaggaagctcgtccgcccctccgtttgcgtcgccgatcatcggagctccctcgacgccgtcgacccgagccgccgcgccgcctcttctcgtcgccggccgccgtcgtgcatcgtttcttgtcgtggtgagtaccaatgagttcgtctcgtcgcccgctacgcgttggtgccctccaatcccgccgccgaagtccctagcgccggcgagctctccttcccgagccggccgccgtcgctgacgtcatgccgacgtcaaccctagggctgacgtcatcagggccagggctgacgtcatccttctctctttttcctttttctcgattttcaaatagattaaaactttggaaaatcataactaaataaccgtagatccgttttaggtggttcaagtttctaaatttttctaaaatcaagatctacatgataaaaatatccacatgtactgtttatgcttgtttttgtactgttttgttgattttatttatttgctttagtttccgacgttccggaggagagcgtttccgttgaggaaggttccgaagcgtttgtggaagcccaaggcaagtcacacagatcccaaacaaccctttgagcatgttgatcccgtttaaagctattattttatttcaactatgcattgttttcgaatgtcatcgggtggtgagcctttcccagttaattattggccgaagttgactttattttcctatgggttataatttgaatagcatgaaccttatatattggattggttcagctaaatgctatatttaggtttgcttagccatgcctagaaacattagctaattaaaaggggttaagtataaattatattacataattattatgtattaattagggttataatcaatggtagctcacgatggtaaatcgtgcgatgttaattaattgataattaaaatctggataaggtgggttgtgagcatatggttttgatggttgtgctcatgacaattaaggaccggttcacgagctactgttgtgaaacatttatcgtgccaaccacaagccagcgtgggcaacggctttatcttttgtatagcatgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccgcggttatg

SEQ ID NO: 74782 - DNA, 7184 bp, Oryza sativa
ccgggagagagagggggggaaatggagctgggccgagaggggaggaggcccaagaggagggagagaaggagagggagagaaagagagggaggagagggagacttatttttagattttcttttttaataaacttcgataattgttgttgtggcttaataaatatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaagatgatttttattttcgggatgaatttatcaggacgtgacaaatccaccccccttacaagaatctcgtccccgagattcgaggaggctagcaagaagataggttgggcggtcttctcttcttgtccgacttcttccgctctgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttctttgcctggtaataaacatctttttcgatatcttctatcagtcatcttttgaccttggtcactaagtactcttcactccgagagttgtggatgcttctggtggcgatgaggtcctttggtctgctacctttcagtgaaaccttgaagtgtttcgccaaaagctacactgactgtcattgcctttgatccggaaaaaacacatctgaaactcttagtccaaacatatgtctctttggttaatcacttgattttcttttccatcctcaggttggttattagctcgaggttagaatatagttcctctggcacgagaccctaggtctcctttgtcagtaaacaattatacacatgatcacatatccgcatcttccgaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacgtggagttggaattggcggttggaaatccttgctaacattggcatcagtggtaccatagttgctatcaccattggagtctttctcagagtcaaaattgctaaggttgtcattctgggttccaacattgatactatcgttgacatcttggtgaatgctactgacattgcacgctttattcgagtggtcactaatggggccagaaccatggttgttggtggtatcatcagcattagtattgctattgtggttgtctgcgttgcgttcatctccttggggcaggaactcttgatacacaacagaagatccggtgatctgaagtggctcagtgcgctgtctttggttgccacctggaaatactgggttgttaaccatccttctcttgcagttcgtcatccgactatgctcactttcgagttgcatggctttgtccacaagtttctcaaaatcttcataatcctctaaaagtagttgcactgcgagctcatcttttaacccctggaggaacttctcttgtttgtcttcatccgtttccacatcttctggtgcatagtgagccgaacgatagaactcatgcaggtactctgtgacggtcaaatctccttgcttcaggtagcgaaactctcgttttcttagtgtgatcattccggcgggaacatgtgatctccggaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgtcggttgcccctgctgggttgttccgattctgtaatagttgaaaggctgttgccaacatgttggtttggttaaccacaacttggattagctctggtgaggtttcgttgatgcttttctcattcccattggcttgggttcttgagtcatcggatccatcattcccatagcctttgttaccagtactatccatctgtcacaaggtagaggttgagagggaaagcatacaagggaagaatagaccagaactagggacaagaccttaaaggaactaactcttcttattgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttccctccttcacagctggcttcactacttcctccatttcgctagcggatcctgcagtcttccggagcttcggcaaacaactgacgatgtcttcttcttcactgacctgaccatctagtactagttgaaaatccgaagaaggaagaacggagtaaaccttttgcaaatagcattaggggaaggagaaaaaggaactttcgcaaataatttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctaagacatcttctccaaagcttctcttactgaagggggaaaagatagagcaagaatgagtacaaccacagtactcagcaagccacaccggcagatgcatgattaatgcaagggaggtacaagggaataataatatagggattaagttttgcggtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaagttttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgtcctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttatagcaaacattaggagactttgaacgggtcgattcagagttcgtatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggaggcgaggacgaagacgatgacgggggctgcagcgaccttgacgaagcgaggacgacgaacgggaacggcttgacggaggggcgaacgccacgacgaccgggaacgacgagaggacgacgacgacgacgacgaccgggaccggcgagggggcgacgagggcagccggcagtggctgcacagagacggggacgacgcggaacacgccgcagcgatgacgatgacggaggcggcgccgcgagacgacgagccgagcgaggatgaacgggacgtcgacgacgagaacgatcggagacgacgatgatggaccgcggaggggtttggatggaggggaaacgatgccgaggacgaccttgccgctgcgatgccgaagatggtggtggaggtggccgaccgatgcacggcgaggagggacgggcggccgaacaactccggtgaggcggacggagaggttcgcggcgacgttccggcgaaaccgagggcaggccggggtggagggcgatgcggcgacgccgagggaggagacggcgacgtcggccgacgctctggcgcggcgaccggggcagccggaggagatgccgccgaggaggaaggagaaaccggcgcgggcgacggtgttccggcgaagttcgggcgaggcggaggtgatgccggggatgagagcggcgtcgtggagccgaggaaggtggtggcgacgtcggccggcgctccggggacgtggcagaggcggccggaggcggagaagtggtggcgacgccactggacgccggcgagggcgcgtctccggtgatttccccgcgaaacggagggctgaccgagggagagggggcagctgcgaggccgagggagaagacggcgcggccgggcggcgttcgggcgaggagaggaaggcggctggaggtggccggcgcgagggaaaggggagggcgacggcgggaacgtagttccgggggtctcctcgcgaaacggagggcaggccggcgtggaggaggtggcggcgatgctgtaggaggcgacgacgcgaccggacggcgctcgggcgaggcgggagaggcggctggaggcggccggcggcacgggagagagaggaggacggcggggagaggtgctgcggccgtgggggagctcgggaaggggctaaaacgagagaacgcacggagggggttgcattttatatgatgggggagggagccggccacgggaggagcgggaacggcggcgggaaccacggccggcggcaatggttggtggccggacttggcgcgtccgttcccgaggattgaaagcaccattcaaggggaaaaacgggggaaatcgaagaggaatcaatggggattaattgcccccaatcaatttggtaagagccggcttgaatagagcggatttagaggaggaatggcgctagggctcgctcgggagggagagaggaggacggccggcgcgggaggaggaagacgacgctggcgcgtgggccccacgcggtcgggcggcggcgtcagcgcgcgcacgcgcgcgcacgtgcgcggcacggggcgggggcgcggctagggttgggccgggcgaccggcccaggaggagaggaggggaagcggcttgggccgagggaggccgggaggaaggaggggggggggaaaaaaaa

SEQ ID NO: 74783 - DNA, 6183 bp, Oryza sativa
ccaactcatactaaagatgtctccaaggttagattaaaaagatgtgtgcaataggtgggatggtaacacgtacatgtgagtgctgagatgagagatcgtgagttcaaatcccacattctgcataagtttgttaaaatagaccaggtttgaattatgtgaaacatcacctaaaaacaacggtcgggttgtgccgtgcctggtccgggacaaaaccccatgacatgggtcgggccattaggccacttgccttttggccatctataaatagaggcaatgccaaattccttgatatcaaaacaggactaaaacacaaatattcaataatatgtaagggtatgcatatcattttttttacaaacttaacaccattaatatgaattggcagaataggggtaaactgaaacttcacttcgaaaaagtatggacaaaataaaaaaccctaataagtgggaataaaatcataattacaacttaaaagtataagtagagataagaacacaaatacccctaaattaaacggcgattaggataaactgaccctacatactgttatatacgttactgttggcctgttgcagatgcatcaacgagttagggtgtgtttagttcacaccaaaattaaaagtttggattaaattggaacaatgtggtggaaaagttcaaaatttatgtgtgtaggaaagttctgatgtgatggaaaagttgaaagtttgaaaaaaaactttgaaactaaggctgtgtttagatccaaacatcagtcattttccatcacattaacctgtcatacacacacaacttttcagtcacatcatctccaatttcaaccaaaatccaaactttgccatcaactaaacacagcctaaaccaggccttaggcgaaagttgctgatccacacatcagtttggcaggcatcagaatttttgtccggtcattctcctacagtacacaagtgcatataattgctctcgcatggacccggaccagcagagattgaggtagcgtgcaggcggtgcagctcttcgtctctcaaaatctcccaattaccgtacagaggtacagagttatgtgattgttttggaagatacacgtgcttagtcctatataaagcagctatagctagttaaattaaagcaaccatatcacacagaagatgcaaagctagctagttttcacagatatcctatcttataatattagattaatagtacgtatacacaaagcttctagctacttaatttctcggtcgctgaaagggcactatgtctgcaagctccatccctctccctctcttgtgtaatggtcctcctgtgcatattagggttagccatccgccggctgggcttcttgctcgttcggatggtgtccgagcaaaaggttacttccggcaaagcaatgttctgcgacatgcaagtggacatgggattcgatccgggaatgagctagcgtctagctttgagccctctgcgtggggggatttctttatcaactacgagcccaagcccctccaggcatatatatacatattttatttttcgtgcggtatatgtttgattctaataactctgataattaaactatacacctttgatatcccagataattttgatacctaagtgttctcattatatattcatcaagattggtgcaattttcaaatgtaaaatctcataattaatgcttatgttttttatttgtctttttttaaagtgacatatatagttctcatgtcccaagtacggatcaattgtgtttcattaattttgttttttattctagttatctttgttctgctttttgcaaaacatttgtcatgccacgaattgcacaaattaattatattaattggaaatcatttaattgaccttattaactgttcatttcagtgtattttttctttcactcaatcataacaaatcaaattcatgctgccaaataagcagagatcagagggatggatgatggagatggccgaaaagctaaaaagagatgtccgcatactgtttgggacctgcaatgatatattggagaagatgaatttaatagatgcagtccatcgtcttggaatagatcaccttttccaagaagaaataggaagtgcaataagtgacatcaaaggaagtgaattcactagctctagccttcatgaggttgctttatggtttcgcttacttagggagcatggcatttgggtatctccaggtattgttctacatgctaaaacctaaatgatactagcgaagcatgtgttaactgatataaggaaatctgaatattattggtttccttaaaaaccaaaacattttttgagaactaaaaagaactataactaattattacaaataagtatggcttccaaaattctatgaaatcaacaaaaagttaattccagcacatagtgataggcgtttttggaagagttgattgccaaacttttgaatgttctctttggattagaattatttaatttccttatcattttgtaggcgattcagaattgcatttatttgcattaattctgtggaacaacttctctgtatctgtccgaactaaccacactacaacctctgtttcaaattgctcaaattgcttgtcaatctagctttttgttaagtcaaacatttctatctttggtcatcaattttagaaattttgggtaatttagaaacatatgtattatgtatttcggaagtatttttcatgatgggtgtacaaacataaatattaagacttaaactatacggtggcgctaatacgcgcgctccacgcggaatattactttgagcgccacacaacgctccctccttccgattttccttttttaccaccccacctttcttccgtctgcttttttcgttttttaccaccccaccttccgtgtttcttttttctcttttccacctcattcgttttcatcaaagagcccggtaaaatattaaccatccatatttttccctttttcgttcgttctctccagtttttctgttttcacattttagtaaaatatttactgtctagtttttctttctaagtttttttatttttctagagtctccccacgtttcaaaaagtaacgaatttactctatagagctttccatttactcccggcttcccatatctgcacattcaaaagaaacaaatttactcgcataaatgcccccttcaaaagtaacaaatttacttgcacgaatgcccctacatcgtacgacaccattcctagatggtcgtaaaagaattactaccagcttacaacgctagtagttcatttaccagtgttataaatattgttcagacttcatggtctgtgagtaaaacaaccaccaccttcctcttgatatagcccgtgatctcgtagcctgcaatttatttactgatgtgttcaatacatagtataagaataaaaactgatactaaaagtattgttaatttgtatcacgaaatggtcgtacgaatgaaaaaaattaatggctcaatcacacacgagtgataaaatcacttacaggtgaattaaactagaaaagaaaaaaatgacagtttctacctggttacaagctctgtaatatttatgggactgttgtacttgtatattttatacattttataactttcttttttgttttaatgtattaaaagtaatgggggatgcctcgttgtaattttactaaaaaataaatccattgtgaatctgggatccttgaggctttcctggatcttgctataaggatggagaggctgacctatgtcttgtgactggtagcggagagggtaaccaggtggcgtcactactacaaaattaatttttcatggcaccaccttttttttttctctagcagttatacgtgtaaaccgtcagcaaaaatattacaaggggtaggggggctacggaccgccagcgaaaacagatcttcgctacggctgggttaagagggccgccagcaaaagtataactattttcgttggcggcccacttaaggaaccaccaacgaaaattggatttttggtagtggtcctctttaccagctgcctgtgaaaatctctattttcgttggtggttggtaaagaggaccgccaggaacaattcgatgttcgccaacgaaaattcaatgttccctggcggctactaaagtgcactgctagcggaaatcataccgcacattacaaaggcagccccaccgccacccactcctcctctagatacactgcctcccactcctcctctctttgtcctcgtctctcctccgcacccttctcctccccctccaccggcgactccaccggtgttctccaccgcgcggcttgcatagtcggacgggccgctgggcctcatggaggacaccgtagggccgaaggaggatggatccaccaccaccaggacgcggggaggacagatccgccaccgccgagccgtggggaggatggatctgccgccgccagtccattgggagcacggatctgccgccgccgagccgcggaggcacggatccaccgccgccgggctcctccaaccgcctccccactcccaggtctggaggctgcggatcagggcatggacttcagcgggcgatgtcacgtgccgcggatccaggcgatggaggggcgtgggcggcgggcgacaatgaccaagaaccatgctccagcaagttccaggaggagacggcgttccggagctggccttcctctcgctgttccaccacaagcacctcatcggcttcctcggctactgtgaggagaacgacaagcagctgctcatctaggaagtgtgattgtggttggggatttgggacaacgatttgggattgtgattggggattgggacaatgatttggaatttctcaaaactattttggacctagattttctatggttgtgattactgtgattgtgattattgtggttgtgatgattgtgattgtgattgtggttattgtggatttgggggatttaggacagtgattgtgggtcggagaattatggattttggatagtaattggggatcttgatttttatttttttatcctaaaatcattttcattggcggctctcactagccaccattagtgaaaatcaccttttctctagcagctgtcctaactttgctgcctgtggaagtcaattttcgctagcagttggtggaccactagtgaaaatttattttttcactggccttaggtttctggcagtgttgccggccggcagcggaaaaagcctttttgtgctagtgcgtgcggtagtagatgatggaatgatggaaggatgtagctgcgtggtatagagacgatctcgatgttgcgcagtagcagttattcgtcatctagaaagcacgaaaaaaatgcaaaaaacattctcgttcatgtcatacaaatgacgagtaaaagaaaaataggaaacaacctccatcaccggcggacttcaccctatcctctgcggcaaaccacatggagcatgatgtccaaatgtaggacatgtgcagcccatcaatttagatcaggtaatattggagattgcatgttaatttgatttgcaaaatgaatttggggcttcacgcatgaaggtgaaggagagtatgcagatgcaaattggagtgtcatttcgttactttcttattctgccaatgtcgccgacatggagcagtcgccggttattgctcttggcctaggtgaacacctccttgctagttaaggtgctgctcggcttccagcagcgaaccccgaagcaacgtccattgtcgcgtcccaaatcgactctaaaatctatcctcgaaattgtgcaaaagaataattaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataatagaaaagaaataaacaaagtggaaaaggttttataaaaagaaaaccctaaaaaaagttcgcttcccccccccttttccctcttgggccggctcggcccattccctccctctctctctcctctcccgcggcccatcggctccccgcgcgcgcgcgccgctgacaggcgggcccgcccgccgctctcgctgacgggtgggtcccacctggtatcttcctactcccgccaggtacgccgccgcgcccgtgccctatcgccgccg

SEQ ID NO: 74784 - DNA, 9079 bp, Oryza sativa
tccactaaaaatcctgttaatgaatttcgacatgtagaattcaagaaaaattccacatgtcaattccgattattatttgcattattttcttagggttttctcctgatttcacctgcattttcttggggtcatatgcaaattacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaacctggtgaccttgtttctggttctcctttcgctggtgtcaagtatgcgaaccggcttctccacataggtcaggtcctcctggatatcgatgtgttccgaatcagcctgttcctcaggtacccttaagcacttctttagttgggaaacgtggaacacgtcatggatgccgatcatgttggatggaagttctagctgataagcaacttctccccttcgttccaaaattttgtatggtcccacgaagcgtggtgccagcttgcctttcgtctgaaaacggtgtactcctcggagcggagtgacacgaaggtacacataatcccctgcttcgaaagtaagctctcttcggcggttatcagcataactcttctgccgagactgggcaattcttagcctttctctgatggttctgactttctcctctgcttcagttaatacttccgtcccaaacaattggcgttctccagtttgatcccagaagagcggagtgcggcatttccgtccgtacaacgcttcaaacggtgccatttgcaaactggcttgataactgttgttgtaagagaattccgcataaggcagacttttatcccatgctccaccaaaatcgagcgcacacgctcgcagcatatcttccaagatctgattgaccctttcggtctgaccatcagtttgcggatgataagccgtgctgaaattcaaacgagtccccaattcttcttgcagtttctgccaaaattttgaagtgaactgactcccccgatcagatactatcttcttaggtaccccatgcagacacatgatccttgctaagtacagctctgccaaccttttccccgtataggtagtgtgtactggaatgaaatgagcaactttggtgagtcgatccacgaccacccagattgaatcgtgccccgacgatgtcctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctgacccaccagaatttctctttgaggtcctggtacattttagtactgccgggatgaattgaatactgagtttgatgagcttctgttagtatgagatccttcagttctttgtcgtcaggcacacacaatctctctcccaaccagattgtgccatgctcatcctcatggaaatctcgagcttttccaaccctcatattctttttcagctcagctatttcaggatcatttacttgagctgctctgacttgatccacgagtgtaggccgtgcctctagggcagctacgaacccgtgttccacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcatgtggacgcaactgtcgcgaagcatatgcgaccactctgccttcttgcatcaacacacatcccaatccttggcgagatgcatcacagtatacctggaagtcttttgtctgatctggcagaattagaactggtgcagagactaacttcttcttgagttcttcaaaactttggttgcactcagccgaccacttgaatttttcatctttctttagcaactgtgtcatgggcctggcaatcttggagaaattttcgatgaaccgacggtaatagcccgcaagtccaagaaaactccggatttgagaaactgtctttggtggggtccacttggtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgttgctcatgttgtttttcagacttggaatagataagtatgtcgtcaatgaacaccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactggtgatagcctgatcgcaggtctatcttggagaacaccttagctccttttagctgatcaaacaggtcatcaattcttggcaacggatatttgttcttgattgtgacctcattaagggcccgataatcaacgcacatcctcttagtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacactggagaacggaaggtgatcttctcccctttgtcgttggttagggtgatggtgcggcttgcgcagtcaatcactcccttgtttctggtcaaccaatccattccgagaatgacatctaggtctttagattcgagaaggatgaggttggatagaaacggggatcttttgatctctatagtcaccgaggggcagtagtgtgctgtcctcatatcatttccaggggtatgaacctgcatcggtattttaagttccactaccgataatccatgcatcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtctagtgcgattcagcttcggacacttaccagcaaagtggccgtgcttgccacagttgaagcagggtcctggctttcctacagcccccttcttgggttgttctgactgaactgacacagctggcggatctgactgagctggtgccattagtgggggtggagtcgagttgtggttgtgctgcttactgttgttgtgactgccaccgttgtagtcgttgttgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctggcggatagccttgtccacaagcttctcaaagtcctcatagactccggagattagctggttggtcaattcatcgtcgagcccaaacaaaaacttctcctgcttctcagcatcggtgcgcacgtcctcaggagcgtagcgcgcgaggcggttgaactcgtgcaggtactctgtaaccgttctggttccttgttgcaatgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctctcggtcgttgcattgcaataggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcattccttgtcttcatcatctggacgaggataggtagaaataagagaaaggaagaaaacagatggcttggaagctaatctttcttataaaattaagtgccattatcttaatcttgattaaaacactgaaaaaagaggcacgcaactcctaataaaagcagccataccactgacacatgatatcgaccgccgactaacccacaagcaacaaacctaagcacagaaactagcaagcaaacaaaactaagaagacgataaagctatgggtggcgactctgaagcttggagcggcgcttgcgatcgaacaacaggtctgacatctaaggtaggcaagggataggaatcaacgcatgctcaaaaccaaattaaatgaagccacaaatgactcaaacaactagccaagcatgatgatttttatgcatagaacattttttttttatgaacccggataaagatacccatgcaacaaactaatcaatgaatcaatgcacaaaatagatgcatagctataatgatacgcataaaatctccccatcgtacctagacacgacttagcgcatatcacctaataaattcccgactcactatcaaataaattccggataaaatttttctaaaaccctagaccgagcaaattttaaggatccgacccgaatgaacgaccaagatttttcccacaaaccaaagaggcaaaaccccaaatttttcccgaaacaaatccaagtgcaaaaagcatatgcagatgaaaaggtttaagagagctcttaggttttccagttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaagcagcagttgaaagcagtaaaacagttgtagtaattaagcaatattaaccaatctctgtccaacgttacaccacgttgcaacaggcccaaaccaccacctgaactcaccagttcattaagcttaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtaatgtactttaattaaccaacaccattacggtggcactaaatcaaagctattgccaataatcaaagtctatgctttaatgtgatccccttttgtgcactagttgaactaagcatggctaagcatctcctaaaccaacatctagtcattttaatacccaagttatcaatggcgtaagggaaacaacataaagctgagtaataggacccgtcccacatgatattgtaaaacaatgcaatatttaatagaaatgcgggacatttgtaaattgggtacaatatgatcaattgcaatgtatgacttgccttgctctcgcactgatgaggccacagcaacgtcttcgagaaactacggatcgacgaaacggccgaaatctacgcgacaaacaaagcacacaagcaaaacatgctataagactactgaaacagagaacaaaaccatttttaatggattctacacatttttatgaatttactgagacttgaatggacttaatcggagctcggatgaattagttatgatttttagaagattctctgtgtttttactattaaagaaaaagccttaatcgatttattgcgcaatattgccccagggctgacgtcagcaaggggtggggcggcgccgacatgcgggacccacgggtcagtgactcaaagagagagagaggcggctggcaagcggggcccaccgggcagtgacacaagggggagaaggatggggcggcggcgccacgtggcggccggatcgacggccccgatctacccaagggtagatcggacggcggcggcggcggcagcccccgggctcggatcggcatcaaagccgatcggccgacccgggctagcggcggcggcgcgtgcgcgtcacgtcgccggcgacggcatccggcggcggaggcgacgcgaaagcggcggcagcggacggcggcaacgacccaaagcgacggcgagcgcgggcggcggcgacgcacggggaagcggggaaggaggggagaggaggtgcctcaccgagggtggccggcgcggaggaagatgatggcgaacggcgacggcaagccacgggaggcgacggcgaccggcggacgagctccggcgtgccctaaggaaggagaagagaggggttagagagagggagatagaccacggcgaccggaatccatggccgaaggcggcggtagaggttaaacccaccggagcgcgaggagacgggtgttccggcggcgaacctcgacggggaaggggcggccgaggtagatcttgaccccgcgaacccgacggcgacgacggcgcggcgcggcggcgaccctagcggcggctagcggcggccgaagtagcaaaaacggcggcggcgggtggttgcacggcgcgggagcgatggggagcacgggagagtgcggcgaaatggggaaaaagcgagagaggacgacggcgatgcttaaaaagggggagagagagccggacgtggccgggaacggcgggattcgccggccgacgcgggggagtggggaggagagagaggcgggattcgaatttcgaatcccggccatctcgggcgcgggcgcaagtgggagagagaggggaaagggcgcgggagacacggcgcacgcacgggcgtggacgacgtgggccgaggaaggcggagacgtgggcgtggcgtcagttgcggtggcggctgctcgagcgggatctgcgggaggagggagactggaccgacacgtgggccccacctttctgcgacccctggatgagggaggcgggcggccggctgtctggctgggcctcgggcttgcgcccgcccatcaaggaggagggggaggaaacataggggaaatgggccgacggcccattttaaccaaaatgaggaaaaagagggaaaaagaaaaagaaaaaggaaaaaggattttccctggaataaaaattgcacttgctcaattttaattggttaaaattatttctagagctctgaaaattccactaaaaatcctgttaatgaatttcgacatgtagaattcaagaaaaattccacatgtcaattccgattattatttgcattattttcttagggttttctcctgatttcacctgcattttcttggggtcatatgcaaattacaatttggcttgggaggaaaacttcggggtgtgacaaggaccagccagggtacacaaacgataattgttgacatacagatccacgtcttacaaaaatataaaagattacaaatgcagcggaaaagataaaacgaactaaacttggattcttgacttctgcagcgggcgactccactccacaggcaatccttgacggcatcgacgaaaccaacttcaacagaacagctcccactaggaagatcttcagctctggtgtgggggaaaagaaagcaagactgagtactacccactgtactcagcaagtcataccggatgagaatgtatgatgcaggatataaccaaaggaggctatgggttcatttgcacaaagctagcatttaaaagcagcagttgaaagcagta

SEQ ID NO: 74785 - DNA, 1350 bp, Oryza sativa
ggtgggttgtgagcatatgttttgatggttgtgctcatgacattaaggaccggttcgggagctactgttgggaaacatttatcgtgccaaccacaagccagcgtgggcaacggctttatcttttgtatagcatggttcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccgcggttatgggtgagttgagcaatgtttttcgtgattagtctcacacttctcattaatggtaataatgtggtaattaatttatttcctggtttggaatggttaattcctggtatggagggttaatttgttcaactggggttggttgatcaaatgtggttgggcctatgcaacacgggtgtgttgtatggtgtttatttaatattgattaattattcaactgttttacttctctcttaaatatttgttaaatgctgttttctgcaaatgagctatattatgccatcctttgctatcctgtgcacttgcatatttgctgtgtggcttgttgagtatgtcatatgctcattcttgcaatattcattcatcagaggaggagtacttcagtgaaggtgatgatctggaggaataggcttgttctggttaagttgcctgtggagtggagttgccgtcgctgttccgtagtttgttttagttttgttttccgctgcgtagaatgttgtttttgtttgagaggaactatctacctctgtaataattttattttgcgaatatttaataattatttgtactctattatcaatattgtcattgtgtgcctcggttgattcctggacgagggtttaacacacatgtaagcgtttggaattttggatagaaattccgggcgtgacagtcggcgctttggcgcggcgaccggggcggctggaggcggtgcagtggcggcaattgtcgcgaccgagaaaatttgcattttcccgaacgctagtgtattaatccctgtcccaggaaaagccggggtacaccacacaaacatgatacaaacggcacatctttattatatcgataatatttacatgattacaaaggcacttcaagcctgacaatcaaaaataaacagcagcggactagcgggcctacggctccatcttcacaggcgctcaactggggtata

SEQ ID NO: 74786 - DNA, 922 bp, Oryza sativa
cggccaacctccagccacgccgctccgccacgtccgccgtcgccgccgcttgccgccgtcgccaagaggtgcgccaaggggtggagaagcccggccgcctgtccttcctcgccgccggcgacctgagagtcgccgccgccgttcaaccgagccgccgccgtcgcccttctcgtcgccggccgtcgtcgttcgtcgtttgtcgttgtggtgagtaccgttgggttcgtctcgtcgtcctctacgtgttcatgtcccccaaattcgcagccgatcatccaatctccggcgaggtcgccaacccgggccggccattgatgaggtcatcgctgacgtcatcatcggtttttctttttcccgtttttctaatagattaaatcttcagaaaatcataactagataaccgtagatccgtttcaggtggttcaagttgctaaatttttctaaaataaagatctacatattaaaattgtccataaattgaattaaatttatttaattctttttaaatggactttaattagatttaatcttgtaaaattcatcataaattcatttgaagtcagaataaggccgttcaagtctcataattcatctaaaattatgatctacatgtttgtttactttatatgtactgtttatttggtttttattagtctttttcttcgttttgcgtgttagcttgtcgtttccgtcgttgcgaagtttcgtgagtgcgtcgaaagtgatcaagaagattaattgaagaccgattattgcaaggcaagtcacacagattctaaacacaaatcctttgagcatgttgatcctatatttaaattctctatttatttcaactgtgcatttattttcgaatgtcaccgagtggtgtgaacctattcctttgttatggccaatttgcattgaatgccctattccttgatac

SEQ ID NO: 74787 - DNA, 811 bp, Oryza sativa
taaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaatatccagaccattccaaggtgtccaggtgatatgaatatttcccaaagtctatagttgaaaaaccacctaatgttacctaattaaattgcgaagcatctacctaagataaaactagtggtgccatgagtagggtgtccactagttgaggttttgtttattctagggtgaacaaggtaataataacaataacaataataaggtcataacaaaggtaaataggcatggctaaataaaacagtggtaacgcgggaatttaaataaagcgataatgcaataatttaaatcaacataattttacaaactgggattcaatatgttcaaagatgatgtgacttgccttgctcgctttcccaaacgtcggcttcaacttccacgaagagcgggtcttccgaagctgcagcgtctacacgaccaacggaaaagaaaaggcttttactctaataaactccatataacagcagaaacaaagcacaaaaatgggttcttgacttcttaagaaaaaattagagacttgaacggtccaattccgagttcaaatggccaagttatggccatttgaagtttatatgctctttagatggatatttgcgaatttcttcatttaaattttaattaaaa

SEQ ID NO: 74788 - DNA, 14885 bp, Oryza sativa
gtaagaagggaggaatccacagagtgtggcctgctgggagtagagagttgttatttgagatacgacttcgtgacaagagtggtgtcggcattgggactactgacgtcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtgccatgtgcgatttcactcgtcctcctccagggcaagccaattgggttcctgactcaaatttattagttgatactaagggtcgtcgccagtcgcgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgtttcaaaggggaagtcgaagaagaaaaataatccttagttcgctattatccttggtggactccctactttgaagatcgttatcgttcaatttatgtttagtgcgtctgtaattttaatttgaactttcttgcacttttattacccgaatctatttgtaatagccttgtaattttcattttgaactgcactgcacttttaatatcgtcatgtatttgtattggaattgtaatttaaatttcgaactgcactgcacttgtaatatcataatatatgtgtcctgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatgtggttttcgatctgcaggtatggctgatcaatatgatgggcagctgatagacaaggagatcgataggaaccatcgatcgcgacgtcttagtacaggaactttctgcaatgtgctaaagatgcgaggaccggatcaatattggcgtattgatcctcgttgggttccaaggtatgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgccgatagctgggccagtagttggcccaacaatggtgaatgctggatgggcggatgaccttctggccagttttggtggtgtgctgcctgttgcactggaggatctcacagatgggcatgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcagtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcaacgatcgtcccactatggaatccttgtggacacaccgtgaggtattttttgttaaattcgtttatgttatcattatgaatactagttcacaaactttccttatatgagtaatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacgacttgttacctcgtggtggacgtgcacgtcgagccacacaatgtccacagggttctcaaacagttgggcatgtatcaggacttccctccgagagatggtcgtcctttggctgatagtcttcataggttagttcacatcacagttgtctaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagcatttataaatgatgtgcaactggttcattatttctaacaaatgtgcatcttgttaaatactcttaataaatgtgcaactggttaaataattttaattaccttgattatttgtggaacaggcggaatttgttgagcacgttcacgtggagtccgacaccatgctgcaaagactagaggcgagacctccggtcgtcaggcctgacgacgtggcgagcatccttcgcaacttccgtgcacgtgctgccgcactactacgtcgtgtctcctgtcggagcgcagcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacattagggggtcagccggatcaggggtacccacgtcgagcacggcaccaccacgtccacaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggggaagtagggatggattactggcacgcagcacctcaggtcacacagccgacgcaggagacggaggtcggtcaggggccagacgtgacaccacagcaggcagctagagataggcaccccccctgataatttgacatatcccactgagcagattaggcgtaggaagaagggaggacctagcaagcgtgcgaagggcactaatcgtccttgacttatctatttgtattaaacttttagtcatttctattctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaataacttattacaaataaatggagaacgcgaccctgtcgaacgcgccagttcgacggatatcctgtcgaacaggggcagttcgacagccccctgtcgaacaggggcagttcgacagccctgcctggggctgttcgacaggtcctatcgaacggcagccttccgatctcctcaccagtcgcgctctggccgttcgataggcgccctatcgaactgcacccgttcgacagggacctactttcgcgattttccccggttgaccactacttttgcgattttccataaaaataatattaattctcaaaaaaattcgctttcttttgttttcttctcttttatttgcggggcattagagatcgcggtcacgcttccgcttcgcggatcagctgcataatatcgagtggaccgatgctttaataacggatgaaaaaattaaccgaagtcttacttaatttttaccgatgctttaataacggatgaaaaaagtcttacttaatttttagttagatatagaaaaaaaagtgccatgcgttgcaacgaaaaataaagaaatatttattcacatctgtggcttagaaatcaacacattaattgaaacaaaaatatacaccgttgatcatagtggatctaaaaaaattttatgaatgtttagatataatgatgtagatttatcaaatataagctatatttttataattagatttaatccaaatcatgatcttataccggccagcaaaccgaactattttctttctgccatacagctgggccccggaaacatgaacgcaaaataaatgaaagatcatttcagcaattatttaattagaaaaatgaatcaaaatccgcgctttcaggtttgggccaaatatgaaaaaatccagattccctccttttgttttgtctcttctctgtttctggcatgtttcctttcttcggtaaatcttgcttgcgtcctcctcaattgggtctagtaaaataagtcctaacagaagtctaatttatgtccctattgctacagtagtttcttcaagttccagtcgagcccggcctacgggggctcctggttagaacagacgcgctagataattttgtagcgcgcacttccataacttcctcctgtttcatcgttttgtatatttttcctgttccgcaccgcgtccggggaggttaagcgcgtgggtccactacggccacgcgtcattagcgctaataacagcgctagccatatggattaatctagttatagtttttattatcaaaataatacataaatagttaagttgaaagtttcgaaaatatgatgaaaaatttcaaaatctgagttgaaagtttcaaaaaaaaatcttgagagtttcaatttcgagttgacagtttttaaatttgagttggaagctttcaaactcgagttggaagttttcaaacttaggttgaaagttttcaaatttgggttgaaagtttttaaatttgacttgaaacttttcaaattttgagtcgaaagtcttcaaattcgggtcgaaagttttcaaaactcgagatgaaagttttcaaaattgatttaaaagtttaaattttgagttgaaagtttttaaattttaaattgaaagtttaaattttgagttgtgacttttaatttttcatctatagaaagtttcaaatttcacgtatagatttttaaatctttagttaaaaaaataggacctcatgaaaaaaaggaaagattaattaaagaaacataattatcggaaactaattccgtcaactaatctaatcttgattattttctccgaatctggcgcacttgcgcacgcttcccagcgatccctcgcgcaaaaaaacagaaacaaaagtggaccggaagagaaatcacgtacgaggacatgggcctaaaacgcgcgctagatggctagttagcgcgtctgcgctaattaggaaattcgccggcctacacctgacgccaccctaatcccgcgtccgattcaaccaaacccgtggagttaatctcaaattagtcgagggcttttgatctatcttttctctcaggaaattgaagtcaatcccatgaaaattgcttccgtatcgagctcagactcgagtttatctctccagtgaaccctagtttttatctctccggcgaagtcaagtctgattcaaccaaattagcacgttgacggacaaaaatgcagaaaaaaaagtgacgaacggaaggttacagatttttcttttctaattagttaagataaaatatgatatagatagtccggcgacgactacctcctcttctgatattctcacatacacccgtcgccgccatgcacacacactctcgagctgcgtgtacatttatagttgtacgtataagtgtactgatacacgtataatatacgcagtgacgtgatggaggagttccacaaggagatccgacggtgccgacgagctgctggagttgttcctcagggcgggcactgggtctcaccggagtcgaggtggaagaagatgacggcgacgatgcactggtacccgaggtgcccggacctgcggcgagcgctgggactcagtgcacacagcgactccggcttctgctctagagcatcgtgccagggctgcagctgttccggcggggaccagaccggtgggtggcagtgccggcggtcgttcctggcgccttcgtcctcaacgtcggcgacctcatccatatgcatgctcaccaacggccgcttccacagcgtctaccaccgcgccgttgtcaaccgcaaccgcgataggatatcgctcggatacttcctcggcctaccagccgaacgtcaaggttgccggaggccgtgtgccgcccggctggagcgccgcctaccgcgccgtcacgtggccggagtacaaggccgtccgcaagaaggccttcaccacaggcggctccaccctcgagatggtctccacccccaccgccactgacgaacacaacgacgtaaccgacgtcgtccgggatgtcatataatatttacccctaatctgtcttactactttactattgtaccctcaagaataaatggttcagattagttctactggtagtataatactttcggtagaaagcacaatacttgcgtcttgctctgtgttttttcttccgtgcacggtgattatggcagaggcctccagctgttcataaacgcatgacgttttgacctcttcacagttcacgtgctgacaaaactaggataaaattaaagcagctctgatcacagctcgtctcaaagcagaaagaaatagaaaagagatgttgttattgttcaggtgaacaagataggttagagataatcctgctcacacatatgctcttccaaagatattccggtccctgctgacgaaaaaactaatcagcaaaaagtcatcaaaagtgttgcataatcttcataatactacttaggcttgatttaaaacatcattgaacggattgttgatgcgggttatctactttattatattgataaattaaatattatgagaaataaagttaacatgtatcttaagtaggtaagcagtacgggtagaggatttttacataaaatttattcttcaggcaagtatcctgtttgaacgatttggtaaataatttggaaaagtaaacctaaaaatacagtgggacgacgtcacactaaaatacagtactatatctgatgattggtgttcaaattttcatgggccatgtgttacaatttcaaatacaagttacacagctcaaattagttttgaaatgtaattaaactacagcttgtggtggtaatttatcaccatcgtcgttattcgagctatcacaaacgattctgtccttattgcttggccaatgtccttgttagttgttacggagctggccgccatcatgggcgtggctcccggctctttgccgatcgtgcactgtgggcttgtggctaggcgtggctcatagggccagaggccagtctggcagggcaggggccaggatgggaacagagttggatgggctcagcctgcaccgaactgttggcatgttaccaatggtaggaataagttcactttagatgcctcaatatgttaccgagtctaaaattcttccctgactacaataccacgtatagcttgtcccgaactcgcaaaaccgtttcaactttcgtcctaaggcagtatggctcccagtttcatccaacgtggcattttcactccggtcagctatgttgaatcagcatagtagctacacggggccctacatgttagcagccaactcctctccttctccccttctctctccatctgccctctcaacagtggcgctatgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctaagacatcttctccaaagcttctcttactgaagggggaaaagatagagcaagaatgagtacaaccacagtactcagcaagccacaccggcagatgcatgattaatgcaagggaggtacaagggaataataatatagggattaagttttgcggtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaagttttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgtcctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttatagcaaacattaggagactttgaacgggtcgattcagagttcgtatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggaggcgaggacgaagacgatgacgggggctgcagcgaccttgacgaagcgaggacgacgaacgggaacggcttgacggaggggcgaacgccacgacgaccgggaacgacgagaggacgacgacgacgacgacgaccgggaccggcgagggggcgacgagggcagccggcagtggctgcacagagacggggacgacgcggaacacgccgcagcgatgacgatgacggaggcggcgccgcgagacgacgagccgagcgaggatgaacgggacgtcgacgacgagaacgatcggagacgacgatgatggaccgcggaggggtttggatggaggggaaacgatgccgaggacgaccttgccgctgcgatgccgaagatggtggtggaggtggccgaccgatgcacggcgaggagggacgggcggccgaacaactccggtgaggcggacggagaggttcgcggcgacgttccggcgaaaccgagggcaggccggggtggagggcgatgcggcgacgccgagggaggagacggcgacgtcggccgacgctctggcgcggcgaccggggcagccggaggagatgccgccgaggaggaaggagaaaccggcgcgggcgacggtgttccggcgaagttcgggcgaggcggaggtgatgccggggatgagagcggcgtcgtggagccgaggaaggtggtggcgacgtcggccggcgctccggggacgtggcagaggcggccggaggcggagaagtggtggcgacgccactggacgccggcgagggcgcgtctccggtgatttccccgcgaaacggagggctgaccgagggagagggggcagctgcgaggccgagggagaagacggcgcggccgggcggcgttcgggcgaggagaggaaggcggctggaggtggccggcgcgagggaaaggggagggcgacggcgggaacgtagttccgggggtctcctcgcgaaacggagggcaggccggcgtggaggaggtggcggcgatgctgtaggaggcgacgacgcgaccggacggcgctcgggcgaggcgggagaggcggctggaggcggccggcggcacgggagagagaggaggacggcggggagaggtgctgcggccgtgggggagctcgggaaggggctaaaacgagagaacgcacggagggggttgcattttatatgatgggggagggagccggccacgggaggagcgggaacggcggcgggaaccacggccggcggcaatggttggtggccggacttggcgcgtccgttcccgaggattgaaagcaccattcaaggggaaaaacgggggaaatcgaagaggaatcaatggggattaattgcccccaatcaatttggtaagagccggcttgaatagagcggatttagaggaggaatggcgctagggctcgctcgggagggagagaggaggacggccggcgcgggaggaggaagacgacgctggcgcgtgggccccacgcggtcgggcggcggcgtcagcgcgcgcacgcgcgcgcacgtgcgcggcacggggcgggggcgcggctagggttgggccgggcgaccggcccatgaggagaggaggggaagcggcttgggccgagggaggccgggaggaaggagggggggggggaaaaaaagcccgggagagagagggggggaaatggagctgggccgagaggggaggaggcccaagaggagggagagaaggagagggagagaaagagagggaggagagggagacttatttttagattttcttttttaataaacttcgataattgttgttgtggcttaataaatatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaagatgatttttattttcgggatgaatttatcaggacgtgacacgctagcagctagcccacgagccacgtgtgccaagccatcctcattcggtgggcaacgaggacaggatcatcgacgcagacgaggtgactggcgtagctgttggcggcaaggagatggcgcgcggtgaggaagagggagctgagtcggagtaggccggagccgaggaaggtgaggcaagagggtggtgggctatggaaaccttgagttaccctcagcattggccaccgcccaccgaatgccggcgacctgccgcttttgtccccgtcgccagccggatgcctcaagcgctcaagctcacctcatggaaggcttcttgtcacgccctgaagtttcccctttttcttgccttcaaaaaaaatggttaaataaattgcccgaagaaatagtttaattaacctagagttgaatccctaattaataaatgcaattaataatcggaaatagtgtggtggaatttttcttgagttccccatgccctaatgcattaacaggatttttagtggaattttcagagccctataaataattttaaccaattaaaattcattaaccgcaatatttaatcccaggaaatccttttcctttttcttctttctttcccttcctttttctcttgacgacctatctctctcccgcgccctccctcttgctgggccagcccaagccgccttctctcctctctgggatgctgataggtggggcccacctatcaggtcgtcccctacctccagccgcccatgccccggcgccaaccgccgctccccacgccgcccaccttccccgcctcccgcgtctctcccgtgccttgagcccacgtcgccgcccacctcctccacctctcccgctctcgcgcgcgcccgtttagaggccgggattcgaatttgaatccccctcctctctctctctctccacccccacgttgctggccaaatagggggccaccccagccgtttccgcccctcccgagcccataaaatcacttccccgagctctctctctcgtttcccccattcgccgtcctctcccgcgccccctaccacgcccgcgccgtcacaccgacctccgccgcccgctgccgaccttcggccgcacgccgtcgctgctaggctcgccgccgcgccgcgcaaccgccgccgcagctagagctacctcggccgccgctcgcttgccgccaaacgtcgccgaagcgccgtttccatcgcacgccggtgagctctccatttccgcccaactccggccggccgctctagtcgccgtggtcatcctcccctcctcctaacctggtcatcgcctttcccaggttgtgcccgaccccgtccgccgttgttggaagcgccgccgccgctcgtctcttcccgcgccggtcgtcgtcatcgcctcggtgaggaaacccctctcctccttcctttcctctctctcgcgagcgccgccgccctccgcgcgtgcgccgtcgtcttcggccgcagccgccgccttcgcgccggtcgccgctgtctccccgcgccgccggtcaccgccggtgactgcgcatgcgcgcgccgccgcccgcgccatccgatcggcctcccggccgatccggacagttggtcccgtggaccagcggtggaccacccgcgtggtcccggtccacagtggaccggtgcctctcccctccccttgagccactgcccgtgggtcccacatgtcggcgctgcaaccccccccttgggtgacgtccgccctggggatttattgcgcaataaatcgaataaggacttttctttattagtaaaaacacagtttatcttctaaaattcataagtaattcatccgagctccgtttaagtccattcaagtctcagtaaattcatacaaatccctagaatccattaaaaatggttttgtttcatgtttcagtagtcttatagcatgttttgcttgtgtgctttgtttgtcgcgtagatttcggtcgtttcgtcgacccgcggtttctcgaagac

SEQ ID NO: 74789 - DNA, 16585 bp, Oryza sativa
tgggacccagggtcgggttgccagttcggtctgaatcatcataggccttgggttaaggcaggttcgtgtgggttcacggccttgattaataatattgtatagttctagcttcgtgtttacagaatagccttgagcaactaaattcctttaaatgctgtttactgcaaccctaaccctttatattataattcctttgtactcccttgcatttattctgcatttgtgggtgtgtcttgttgagtacggtggttgtactcagtcttgcttaattttcccaagcccagatgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcatttatcgtcaaaatctgatcttttaaatgctgcttttctctttgtttttgtttgtagatggccggcagcgttacccgtcgtggtttgagcatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgctagctcggaggatgacgctaccgtcgtgcatctggcacgcatggtggaggcgtacgacgcggctcgtatcgacttccaccagatggtgcgtcgtggcatggtggagaacaacatgaagatcctggagctgcgtcaggagaacctgcagctcaagaaggacctcgacgcgttggaggcgcagccgcaccagctcaaggtcgcccagggagagatcagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggctcgcgtgtgtttttcctcgtttgtctttttgagttgtgtggggcatggttacgccggtgtgtggtgtaactatgtcggagcctgtcttattttatttgcctaagcaacttgaaccttaatgaaccaatttaatagcagtgataaatttaagaataatagtagtcgtgggtggttagttttaatcgtcagctctctctctctgtttgctggttctgtgtggggttttcagatggtgtcgaccaggagaaatgttaacaccggtgaaggcaaccaacccgagggcagcaaccccaacccccaaggcaatccacctccaccaccaccaccagacaccaacgccattctcacccagatcctcgcccagcaagccaacatgatgaatgctttcctccaccacctccaaaatccaccacaacagaatgctccaccacctcctccccaacactccaaactcgccgaattcctccgcatccgcccacccaccttctctagctccaacaatcctgtagatgcgttggattggttgcatgccgtggggaagaagctagacacggtgcagtgcagcgacgaagagaaagtcatcttcgccgcccatcagctgcaaggacccgcatctctctggtgggaccatttccaggctgcgcagccagaagggcaaccgatcacttggactcgcttcaccgccgctttccggagaacccatgtgcccgctggagtcgtggctcttaagaaaaaggaattccgggagttgaagcaaggcaaccgctccgtgatggagtacttgcatgagttcaacaatctggcccgttacgcccctgaggatgtgcgggaagatgaggagaagcaagagaagttcctggcaggaatggaccccgagctgtccgttcgtctagtctctggggactacccggacttccaacgactggtggacaagagcatccgcttggaagccaagcacaaggagctggagtcgcacaagcgccgcttggcgaacatccgcaatcaacagggtgctaaccagagggtccgctacaccaatccctacccagggggatcctcctcgcagcagcagcagcagcagcagcagcaacctcgctccgcgcctcgacctcaattcgtggtgcgcgtcccacagcagcaaccgcagcagaatcagcaagggactcgtgcaccccgtcctcctacgccagctgggcagcccgttcaaggccgcagggacgcttcaggtccgcagcggctgtgcttcaactgcttcgagcccgggcactttgcggataaatgcccaaagccaaggcgtcagcaaggccaagcgcctccccgccccaacaacggtggcaaggatgtcatccgtggtcgcgtgaaccacgtgacggccgaggacgtgctgacaactccggacgtcatcgttggtacgttcctcgtccattccatccccgctacaattttgttcgactctggagcttcccactcgtttatatctgtgccattcgtggggaaaaatcagttgggggtagaaaggcttagaaaccctctgctcatcaccacccctggaggggttatgacagcaaagtattatagccccgccgttcctatagaaattcagggaattccttttccctcggatctgattctgttagacacaaagaacttggatgtgattcttgggatgaattggttggctcaattccaaggagtagtggattgcgcgagacgcactgtcactctgtaccgaggaccggaacagccggttgttttctttgcacctccaacctctgtccgaagttcagaactgcatcagataggtctgtcagaaatccccatcgtcagagagttcggagatatttccggaagaactacctggtatgccgcctaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtggagaagaaagacaaaacgaagaggatgtgcgttgactacagagctctcaatgaagttaccatcaaaaacaagtaccctcttcctcgaatcgatgatctgttcgaccagcttaaaggtgccactgtattctccaagattgatcttcgttccggatatcaccaattacgtattcgtgaagaagatattccgaagaccgcattcaccacgcgatatgggctgtatgaattcacggtgatgtcgttcggtttgaccaatgctcctgccttcttcatgaacttgatgaacaaagtgttcatggaatacttggataagttcgttgtggttttcatcgacgacattctgatatactcacaaacagaagaagaccatcagcaccatctccgtctggtattgggaaagctgcgggaacatcaattgtatgccaagcttagcaagtgtgagttctggttgtccgaagtcaaattcttggggcacgtgatatctgctaaaggagttgctgtggatcccgaaacagtgaccgccgtcaccgaatggaagcaacccaagacagtcactcaaattcgcagtttcttgggtttggcaggatactaccggagattcatcgagaacttctccaagatcgctcgacccatgacacagttgttgaagaaagaagagaaatttgtgtggagcccgcagtgcgagaaggcgttccaaactctcaaggaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgtcagctacgtcctcatgaaggcaactaccctacgcatgacttggagctagcagcggtggttcatgctctaaaaatttggcggcactatctcattgggaaccgctgtgaaatatatactgaccataagagtttgaaatacatcttcacccagtcggatctgaatcttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaactctatggaacggaaagcgggtgtgcgttcccgataacagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggacttccaaaaacccaaggaggatatgattccatatgggtagttgtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcgtatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccctatgaagcgttgtacgggcgcaaatgccggacaccgctattgtgggaccaagtcggagaaagccaagtgttcgggactgatatcctgagagaagctgaagctaaagtcagaatcattcgggataatctaaaggtggcacaatctcggcagaaaagttatgcagataaccgtcgtcgtgacttggaattcgcagtggatgattttgtgtaccttcgggtcacgccattgcgaggcgtgcacaggtttcagacgaaagggaagctcgcacctcggtatgtgggtcccttccgtatcatcgctcgacgcggagaagttgcttaccagctggagttgcccgcctccttgggcaacgtgcatgatgtgttccatgtgtcgcaactcaagaaatgtctccgagtgccatccgagcaggccaactcagagcaaattgaagtccgcgaagacctgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcctgatctcttcgccagttcttccgaatctcggggtcgagattccgtttaaggggggtaggtttgtcgcgtcccaaatcgactctaaaatctatcctcgaaattgtgcaaaagaataattaaaattcaatgtgaaagcctccaacaattaaaatgtgcaaagatgaaagtcaaatgaggcttggaggatttttgtatatttcctaaaagcctaaaatgcttaaataaattttagtggaattttcagagcacaaataataatagaaaagaaataaacaaagtggaaaaggttttataaaaagaaaaccctaaaaaaagttcgcttcccccccccttttccctcttgggccggctcggcccattccctccctctctctctcctctcccgcggcccatcggctccccgcgcgcgcgcgccgctgacaggcgggcccgcccgccgctctcgctgacgggtgggtcccacctgtcatcttcctcctcccgccgcttccgccgccgcgcccgtgccctagcgccgccgccgccgcgaatcccgccgctcccgtccgccccgcgtgcaatcaagaggggggatttactccccgcgtttccctcccccgtttccccctctttcccctctctctctccctcggattcgttcgaatcaagcccgtaatcgtcgccggcgcaatcaatggcggccgagatccccgcgcccgtttcctctctctccggccgctctttccttcctccggcgctatttaaaccctccccgagctccgcccttccgtttccgccgctcaccgctcgctctcgccgtcggaatcgtgctcgcgccgcttttccttctctccgccgtcgccgacgagttccgttccgccgccgccgccgctccggttctcctcccggctcggcgacccctccttcggcatcgccgcatcgccgccgaccccgtccgccgctccgcttcgtccgccgaccgccggagcaccgtcgtcatcgtcttcccgagccgcgccgccgtcttcctccgctccgtccgccgtttccgccgccttcgctgtctcggggtgagccgtggaccgtccccttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatggaatttttaattgaaaattaaatgaagaaattcgcaaatatccatttaaagagcatataaacttcaaatggccatatcttggccatttgaactcggaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgttgaagtcgaagccgtcgattgggaaaacgagcaaggcaagacacatcatcttgatcatattgaatcccagtttacaaaattatgttgatttaaattattgcattatcgctttatttaaattcccgcgttatcactgttttatttagccatgcctatttacctttgttatgaccatattattattgttattgttattattactaccttgttcaccctagacaaacaaaacctcaactagtggacactctactcatagtaccactagtataattctaggtagatgcttcgcaagttaattaggcaacattaggtggttttacaactctagacttgggaaattctcatatcacttggacactctggaattgttggattattgtggaattggcttcacaccgccccctctattcaaaattccctaaaatggttttaggctgggctcggggtgcatggtttggatggtagcaccttggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctgcctgtcccgggggttccggccgtaggcggaattgggtcggtactcttgtctaaggctaggatgggttggaaactatgtcacgtcttccgtctgtataccgtggtggtatgtggcacgtggtaacacgtgaggaagccgtgtcttgtgggtaaagatgtacacctctgatcagagtataatctattcgaatagccgagccctcggatatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattgtatagttctagcttcgtgtttacaaaatagccttgagcaactaaattcctttaaatgctgtttactgcaaccctaaccctttatattataattcctttgtactcccttgcatttattctgcatttgtgggtgtgtcttgttgagtacggtggttgtactcagtcttgcttaattttcccaagcccagatgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacatccatggtgcgtcatagatctatgggctgggatggtggatcgattcagatcaggaaaaaaaaaggaaaaaatgaagtgggggtgagagtggttggttgggtacaggaaaaatataatatataccagaagcaaagaagttgtttttatcgaagtaaatcatttactccattagtggtgggagcgggatgacaggacgtgtggtgggatcggaagcagggaagttgtttttatcgaagtaaatcatttactctgataatggtgggagcaggatgatgggacgtgaggtgaggtaggccttggctgatatatgtttggcgctcggaatactagaagctcctagtagtatctctataataagatgttttaaaaaatcaatggtcaacaatacaaatatttaatttaggacaaaattaaattgaaactgagggaatacatagaacgaaattaatgtgatttggagaagtggtttcctttatatgaagaggattatgtcttgcagatgcattcaggagattcaaaggagaggatggcaggttcatcaatactggaatagctgatgaaccgagggggttattaagtttatataatgcagcacatctcctcatccatgatgagccggaacttgaagaagcaatctctcttgcaagacaccatcttgaattaatgaggggtggaggtgggctcaaaccccctctagctgatcaaatcaaccgtgccctagatttaccattaccaagagcctacaagagaatagaaacattgcattatatgctggagtatgggcaggaagaagggcacaatgtggatcttctggatcttgcaaagctagaatttaacctgctgcagcatgtccacttgaaggagctcagaaatttttctcagtaagcatgtgtttatttgttgtacggggtatatatatatatatatatatatatatatcatctaagtaaatggatatgataaaagtaattaactctgcgctttcaaaaagtagctaatcatgataataatatcaaatgatatgcatgtctcaatgatgttctactttggtattaccagaaaaaccttgttttggcaattcatctaaacaatcagccgttataaagtctactggccctgcatagagctggtatacaaatattttttatggaatatttgtatacgatcgatggacagtttgttcaaatggtctctattggtagtagaatcgatatctagactgcccatcgatcgtttatgttccaacagtttgtatctatttatactgccatctcaactactaagtagttctataatatgttttatactggtattaaaactgacaaattaacggttgctatcactccactagtgataatactagtatagtagtagagaccaccgtaaaggtattctcagtgaaatggatcttcacattggtagtattttaggtctgcttgataggtatacacgtccacattattactatcataactaaacacaatgctactctatcttaaatacagtattaaacatgcacctgaatcacttaattttcaggtggtggaaaaatatctatggatatgtgcaactaagttacgccagggatcgtgcggtggaaagttacctttggtcctatgtcgtgttctacgagaaagatttagtgctttcacggatgatctttgcgaagatatttgcactgcttgtaactatggatgacacgtatgatgactatgccaccatcgaggaaagcaggaagctgaatgaagcgatacaaaggttggattaatatgaaaaaaaaacagggcaaatatccttgagatgaaaccacctgtgcggtagtattgcgaaaaccactccacaaccgcaaactatacttacaagtttccaaaagttcccaaacaaattctctcaaaaaacctgagttacgaatacttttttgtcaagttggtgagacaatattttttaaaaaatatgtaaatttcaagatcttgaccaatttggttcaaaaaattacaaaatttggaggtttgaaaagctttggaaaacaaaaataaatcaacatccaactgttttatacacctcttcattcttctatttgtcaatcgataaaactgaatcaattacaattcttgtattttacattattgtttgatatgcaaagtaaattttttgaaggttttatgtatattgtatctttcgtgatgtgccaaaaactgacagggaaataggaaaaacctttatgttcttgtcggtttttaccatctggctcatcacgatttgcatcatagcacttctaattctatacctgattttttctgaagtaccacatgcaaggatcaggaagaacaacctatgcatacacactagtatcatggctcatgaaatcgaaaaggcaaacattaagtaagagatgtgcaactatgtgatacaggcacccttgagggttagggtttgaaccatgaaatttgtccattgtttcgccactaaaaaataaaaagaggcaacattgatgccaccatcattatccttgttaccgtcttttctcaagtaatagatgaaccaacaatttgcaagatgttgacacaccgtttagagctataatttagaaatcatttgtccaagagtttatatttttatagtacaagccattataagggtgtatttggttcccagtaaagattagatatgatatggccattcatattttcaaagatatagttcatgattcaattttttatctagttggatggatgggatgatccactttctttcttagatggacgaggatggattgaatgaaaacaatgatctattattaacaataaaatatgttaattcattagtattaacataatttttactaattaagaaaaaaaagaataattatatataatcaactctaaccttgataagttaattatcactaatcagttagtaatttttatcaagattagcaagggacattatcctcaatccgtcaattttgcaggatgagatcattcaacatattcgtcgaatgttccgtctcacagcctccgtgttcactactgcccactcactataaacgtgcacaaaatttgccacccttccatttaaatataatttaatgtgttcccttttttgcttagtggccgttacaacctgatacctccctaccaaaccaatgtgcttatgcttgccaattgccaaagtaatttcatgcaaattgccaatttgcttattggacagctgggatgaaagtgctatatctttactaccagagtacatgacaaagttctacaatacattgctgaacaacttcaaggagtttgaggctcaagtagatgtcagtggtcagtacagggttctgcgcataaaaaaagaggtatacctattatatgtactttgttggtccacaattatttcaagtgttttgatttgtccaagaaattacacattgaccatgaatagttcataaaaaatatatttttgatagcttcaaaacaatcatcatatcaataatatttgtcgcatgaatcaattggtataatgttttcacatcagtttatatatatatatatatatatatatatatatatatatatatatatatataaaagtaaataatggccgaaatttgtgatgtttgatttttttaatgtagatgcacactgtacataagtgggtggttggatggagtactagttcattataattcttagcacacatttatataacagatagttaaagtactgaagtacctacgttttgacttgtagtttccatcaaactaattttttttttgattgtataagtattttgactatggcttgtccaaatcgacaattagcatgcctggatcatgtacctttgtgttgagtactttcgtagtgcagccgaacaacaatattgcaaaatttgtatgactaattaattttattcacatgcgtgtagttccaaaagttatctgcatattatctccaagaagctgaatggtctcatcaaaattacaagccaagctttaaggagcaggtggctttgtctactttatcatcatcaatgccactactttgtgcaattactacagttggccaggatgatgtagtaacgcgggaagcatttgagttggcaacacaacataatagtgcagtattagcttgtggaaagatattacgcttcatgaacgacatcgctgcattcaaggtacaaatgagtaactcaactgggcttaatttgagtacatgccttgtacttccctgatttctcttgcggctgaatttttccatatccatcatatacacactagcaaaatgcagcctacctagtaaaggatattgatatcatactacttaattatctcttcaccaatattaatttaatggtggatagtttaatttgtcacataatgctagctacctgcagaacattgaaacaaggaattccaagaaaacctagatatgtataatgtaactgaatcatatttctctttcacaaacatgcagtctggaagaaagaacaagggagatgccacaagcaccgtggagtgctacatgaatgagcacaaggtaacaggcgaggaagccatagccagaatcgattcaataatagaagatgaatggaaaaccctaaatgaagttcggtgtgagcatcctcagctactccctgcggtgcaacgagttatgaatttagctatttctgtgcccttcttttacaacaagaggagcgatgcatacacatcctctaaatatcttcataagattgttgaatgtctctttgttactcccattcccatatagaccatagtttatcagctaccagcaatgtggccatatgtctatgtacttttatgatgtcggtggctatgtaccacctgtaataattcttatgcgtgtatactgcacgtacattggtaaacaattaaaagtaaataaaaataccatgctcaaaagtgtataaccatttctgatgtggctaaagaattcgtgcaagatggtttacatgggtcattggagattcctcgggttaacataagtgttaggaaaagctttaatagtaagagtgagcgaggtacaactcattcgaatttgtcagaaattgaggtatataacattgttattggtatttgttacgatcacagataagttcacaagcgcccagttatcattgtagcaattcacctcagagtattccaaagatattgaatcttagggaacttgtgtgtataatctaagaagccggattcaaccaagaacaacaactaatggcaggcttaggttagagaggattcctatggattaattaactataccaaattaaggtaaaactctattgattgcttcgggcgccggatctcccttgatctgccgagttaaaccgacctgccgatcgaatttcgctcccatctaccgtagtaattggcgtttaaccaaagcagaagataacatcagagagtatcaaagctataaattagtcatttgcctaaatcatgccaccgccattgaatcgaataaccgatggcaacatcgcaacaaggacgctgcaccaaccggtaacctccaatgcgacaccgttaagaacatttcaacatttgggatgtcaccatcgataatttggatacccagaacagggatttaacttggaatgtccacccgtggaacaagtgaggaagtgggtgttgggacatcacatccagtaaggtgtgtggggcccatgtttatcaccattgtatgtccttgagaagcccacgatgatgatgctggagtggcccatgatgatgatggcgtctactgaccaagagcggcaacacagaagctcggctgccagaaaggttaatggaagatgggctagagggttattagccctcctgcggcattttaaccattgccacacatatttctcccgccgtcagttctcgttgcaaccacgttcatcacaatcattgtcacgccctacagaccaggcccaaccagatccagatttagacaatgtggccctcctatcctgccgcttcatcatccatagttgcagggtaccccatcgcagccatcattcaggagttgaggtgagccaatataccacaatgccgcagccggatctattctcggagacccagatatttggactccccacgcacctatccctacctacaagtgcccaccaccgctccgcagcatggcaccactcccacaaagccgctgccacctcaaatcacggccgtgcttgaatgccttgtgctaccatggagattgccttgctgccggcgggcctctgatggctcgtacaggcggcggcgaggcaaggagggagaggggaggttggttggtggctagggtttgaagtaggtgtatatatctctaacgtccaacacaacatcccgtatgttatagttaggtcgtcaacattttatccataaattgtagttctctcaactatttggaagatcgtttgatcctacagtatcgtcgatgaacaacgtgcctagacagctttaatttttaatccacatagctccacatggaacccaaccacaacctacatctactctttgatctggaaactggaattctagcgagtaccttctcttctccttgtctaactccaagttgatagtctgcgtcaccctccgcctgcggagagtgtcgggcatggctgatatttctggttcttccttgctagtggagccacagtctgtcacgtccctacatgtatatatgtggaaacgagctcatctagctacatcgttgtcaaaatcgagaaaattgcactattgggactgcaaacatgggggcttcgctattttgacactctaagtaaatgacaaatgggctcatctgtgtctatgaaatgtgggtccagtgtccttatagcaaaggttaatgtttgcaatgtcataattgcaaatccaccgtcaaaatgaagtgtacaaaatacagactagtctttttgtaggcctcaacacagggatgtcctcatctgaaggtcagtgtatgaatgtggtcaaaagtgtcaaaagtgttaatcaaaagtagtacttcctccgtttctggttataagactttctagcattgcccacattcttatagatgctaataaatctagacagatagcatctatatgtagatgatgtagtcgtcaagactaagcagaaggatgatttaatctcaactcaaattg

SEQ ID NO: 74790 - DNA, 34917 bp, Oryza sativa
gtattcttcataacccagttatacacttcagcaagatttgttgtcatcacaccatacctcgatccgtctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatcttttactcctgaattgtctataaaaattagccccaaaatgtcgcatgcaccatctgctatgtaaatctggccatggcacggactgtgtgacatcttcttgaagcttctgtatcgctgatagcaaacacatttggtctgttttcaacaacacacattttaatgtgccgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaaacccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatacgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcatgtaagtgacctttgtcatgaaacatctgtccaactttcacctgcttactatcataacaccaatgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctttccttgtgtattaccctctactacttcttcccctcgatcttgctcagtccgccaaacattttcagcttgtccaccttccaacggagtttcttccaccacgacatgacttgactcccccgatcgatcgacacatgttgtcttctgcaccactattgccaggctatagcctttctcccttactttactaacaaacttcctccaactcccagttgacgcaacctccactactctccactgccatccatgttgacccctcactggccacacggtatttatgacaaatttatcgtgcactggatctaccccaaacatattatacaaccaccctaacacgtcgttcaaacccatatgctccggtgcattcagactagtatcatggaaggcatatacagtcaaatctaccccgctatcacatatttgtataggagcatcgccataatacagacgaatgggcatatcacctgacatcctaataaaacatgacaaatagtctgacgtttaatcatttaatcattcgataattaccctattacaacttatactatattgccgtgtactaatttacaactattagtaacaaacaactagttttgataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaagtcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccatccggcgctcacggcgatgatctggcgactctcggcggcagctggcgatgtggtcctcaaaacaaatcgaactcgcggcctgggtggacggggctttaaaccggcctgtcgaacgcccattgttcgacagggtcggtggagggccctgtcgaacgcccccggttcgacaggcctcgcggcgccgggtggtgggccctgtcgaactccctccgttcgacaggtgagcgtgtcgaacgccagccgttcgacagggctttgtcgactgcccgtcgttcgataggtgccctatcgaattgcacccgttcgatagggacctagtttcgcgattttccccggttggccactacttttgcgattttccataaaaataatattaattctcaaaaaatttcaaagaaagctagcaagcggcccaaacaaagcagcagcaggctggcccaacagccagcccatagagttgagaagcaacggcccagcacagtaccgcgtaacactgtatcggtactccctctatccaaaaaaactcaacctaataagggatgtatgtgacccttcctaggactataaatctgaactactcttttgtccaaattcgttatcgtaggaggagtcacgtcttctcttagattgagttaacctagtttttttggacggaggaagtaggaatgcctaagactgataacacgaaataaggtttgtgtttacccgaaacgcgaagcagggatagaaaagaagatgcaattttattatgtaaaaaaataaaaaagaatcgtatatttatagtcctaggactataaatctgaactactcttttgtccagattcgttgtcgtaggaggagtcacgtctcctcctagattgagttaacctagttttttttttacggaggaagtaggaatgcctaagactgataacacgaaataaggtttgtgcttacgcgaaacgcgaagcagggatagaaaagaatatgcaattttattatgtaaaaaaataaaaaacaatcacatgtctttcttttttttcataaaacaagtaatcacaaaaaaatgaattattcttgttgaaaaaaaatcacataccttttttaaaaaaaacatgtaatcagtaacaaaatgaattattttagaaaaaaataaaaaagaatcgcatacttttttttaaaaaaaacacgtaatcaccaacaaaatgaattgtgtttacatcaagaattttttcctcatcacatcacttttttctcattcatggtacgatttccttatgatttttcttagagtgaaagtattctttttttttttcattcattgcatgatttccttccgactgttttttagttaaagccattctgcgattggagtgtagtgagtgtgatcagatagctagccaaaatcatttcttctactgtgagtactctttacagtatgacaaactagtgtttatcaatatcaagtaaaaaaaatcatgcattgcaaccgactcataatttctttctaaggtttcgaagtttagtctgtaatacataatttcattttaaagtgggaataatagttttcttataatcatccgcgctagtggatttagagcaattaataattatgtcatgttagcgtttttgttgcaccggtggctttataataacttcaattaatctggtggcttcatgctctcacactcactactacttattttggcttcacccagtgcaacgcatgaacattttactagttgtttttataattttttgaaattgaaaactctggatacggaaatggtatcgaatttcatcgaatacggatatgaaacaaatacggtaacttaccagaatataaaaccctgagtaaattgcacgttaggtcatctgttttaaccaaatgttttaatttagactacatagggataagacaacaccttcacttagaataaatttcacgaaaacaatccgtaaccgattctttcctggagtctgcctgtctaaccgtcatgcaatcgaatactgtcgcgtacaaagacggagcaaatacaaaatggaatgaatatggtaacaaatatttatcggaatataaaaactcaaactgagatacctgaatcaacaaaaagatatgacttgttatttttctaaaataaaaggtcaatatttctaaattttatatcatcaatttccctaggcggttacatgactttttgtgaattgatttccatagtccatcccttgaaaaatctgcatgtgaaaatgagttttcacttcctggtgccttaatgggatccaagatatcttcctccactccacgtgtagcttactaattaataatctcatatatcaaggtctcgctgtgtagattgatgatgctattcattttattttacctctccgaagcatgtaatgttttatgcactcctaatatttttagataaaatggtcatagactagaaagtagtaaatcccatcgagctatacaactttggtatagagcatgtccccatcagagattgtttgaatcatagatttatgattttacaatgaatattttgtctcctaaatgatctcaaatgataaaggtgtcagcaataaagttgtagatctcatcaatctctacaattctgatataaagtttatcttcatccgactttatatgataaagttacgtacacatacgtgttttgtttttttgaaaagttgatcctccatctgaccgtttccgatatccatcatatactagtcccaccgttttcgtttccatttctgaaaataaaactatccatattcgtttaccatctaaaaattatctatccaagactattcgtttacgaaaatgcgtctgaaaatcgaaactatccgaacagatttcattcctagtctgggcaacacaatgatttgtgctgcaatcctgcgagatccaaaagcaacgaatgtatgaaaaccaaacaaaacctacatagcacaaaacctatatgttcctcttatttaataatatttaaaaattggaatgtcagttcttcaattcttctgatgcatgcaacttcaccaagttgctagtatatactgtacacctcttcttatttaattatttgaaaattaattggagtgccaattcttcattcttctcatccaacttcaccaagttgctagttctgtaacctcttgtggagagtctaagatgtccctctcgatggtcatcatctcatttcaggctattccttgcgctgagtcgtctacgatgtccctgtcctccctcttgctgataaaaaactggggtatgatagcatccgcgtccctacgtttctagtattatgtagctttctagtttctaaattcaagcaatatttatgtacaaatgagttcaccttgtcattgtcaaaaatcaagtgtagatttgaattagctgctagtctttctgtagagataaacatatatcaaggaacagtacgtcgaggaatctcaaatcaggtaatgcgaaaattaaataatatattggtccagcaaattaaataataatatctggactattatttaattttcctcgacgtatatgccttgatataatggactaatcaaattggtttgcccattatagactcaattatgtataggtccagcaaacaaatgaccaatgccatgtaccatgcatcgatcgaagcctcatgtgccccaacataattattcagtaaattccacttgtaaaaaaatacacttttgtaggtgcttgataacccatttaccactataaaaaataaatttcgcatatgaatcccatatcactgtgcaaacgggtcaaatttttagctacacatgatagcacaagtgacagcctaaagtcctgggtgggggtgcgatgggcgtcctcctacgaaccgcttaattaaggtccgtcccgctccgcctgtgtatacatatgtgttttttttaaaactaattgcctgcagaaatcaaggatttgcgcagggaaatagagcctcaaatcaaggattcatgaaaatgaatgtccagaacaaaagcgttttacgatcttcatgcaactgacaacctacagaaatcatggatttatgcacatggatttcacaaccgcacctgaaaattattttatttttctcaaaaatagatttcttcttttttattttttaggcacaaccaccaccctccccctctccccccaaaaataaaaattttagtagttatctatatagggtagcaggtagtgtaaagtcaaaaatcacacgattttacactcgtgtgtggtatatatataggattcaaacctagcacctcttactccacactccacgcgtaacggttttacaatctcactctagtttgtgagcatggtatgaatgcccactttacctctctagaatttgtactctctagcttgttttcaattgtaagacgtttagtgtctttatcccttatctatattcactagcatttccctcatctatattcactaacattcatataaatttagacacatatacgaacttattttacatgaatctattcaaaacatatcaagtaacatatagatcatgttgaggtctacaactttgatatacaacatatctctatctgaggttataattttcttcatggctcttaaaatcatgatttgaagatgcagttttcttaaaaaagatatccttgaaaatgaacctattttacataggtagttttcttaagacccaaatgtaaaaaatggatttttaacagacagtttatgacattgaagtggcatgaaccatcctctcagccggttttcttttgaggccatctataaaaacgaaagcctagagtctgcgcaaataattttttgtagtgttcaaatcaaccttttcccccttaaatttttcttgtttattgtggatattttcttttttattcttttcattttttgattttaacttttatttcctttgttattattatcatatgccagatatcaatgtacattactaggtaaatagaatttaggaaaccaaatgctaaattgaaagcaagatatacagggactaataaggctgcgttcattcggacgagaatgaagaaatctctcgttttccacgcacacgctatccaaacagttaaacaatgtattttttaaaatattatataggaaaatttctttgtaaaatcataataattcatttttattttttttaaaaaataatactcaattaatcatatgctaaagtctcaccttattattttaaaaatcttatcgttcttctcttttaccctcctatagaacggagcctaaaacagaaaattaattaaaaatcagttgaactggactgccaagttgaatatggagtgcaaataatagaataagacgtaagtagagatggaacacattgtggatagtcttgccacgtatgcagctttcctcggagagtctgttatccgccctatcgggaaaacaactaaggaaaatgagaggtcggtagaaaattcaggcagaggatgctgtcatgcatgactatggataaaaacaataaactcccttcacgtgggccattcggacacttggataaaatgtttgttttgaacatgtcatggtcagcttatactccctgaaatttgtttttgggtcaatcattttagcaagccaaatggaccaactaggcttgcaaatggtttcacacacccaaaccggtgaaagaaaaatcattgcagatagctagaatgttctatactttctgcaatttgtaaaaggaaaaagtctaaattactactttgaactatatagcgattgtacgaattacccctgaatcacgaaaccaaacattttaaaccccaaactctttataccgaataaattacactctatctcgaaccaaattagttatagtcttgattgagaattaggggtaccactactagaaaaagcatttttacatgaggacaaaactaattttccgaggcgggagggaggtccgcctgcaccacagcgactgcgaaaatcatcggggcaacgtggcccgtctgcgaaaatggaatgaacaaacaaaaaaaaaaatcaccggcccgctccgtcatcgccgccgccaccgctccacgctgttgtcgctgccgccggcctcccccctccctcctccggccagatctgtaagggaggggggaggggagccgccgccgccctcctccctcctacctccggccagatctgggagtgaggggggaggggagccgccgccgttgtcaccgccgctccacgctgtcgccgcccccgccggcctcccccctccctcctctggccagatctgggagtgagggggggggagccgccgccgccgtcctcaccgccgtggccggaagccgcgccaccttgcctcctcgccgatgtcgccctccgccgccaccgcctgccgccgccgctgcgctccccgcagccccctccggccagatctgggagggacgggctgggagccgccggccgccgcgctccccccgcccccctccggccagatctgggagggaggggccgggccgcgctgccctcctccgtcgccctcctcggctgcgccgcctcgcctcgccgctgcagccctccgccatcaccgcccgccgccaccgccgcctccggccggcggccgggtagagtagaggtgaggggaggggagaggccggtgaagagaggtaaggggaggggagaggaggagaggtgtggaggggaggagaggtgtgagacttagaaaaaaattagcatccgcaagtctatttatattcaagtctattttcgtaggtggaccacttaagcggcgcctgcaaaaatgagcccccccacgtcgggaaaaatgctttttctagtagtataattcatctagttttaagagtttaaggtttaaaatgtgtagttttgttgtttaagatatttgtgaactatcgctatagataggggagtaatttggatttttttttcttcgtaaaccatcatgttaccaatctatagcattgacatacgtatggtagcacgactcaactaccgcagcagagatcgatcgttgttccttccgcaatttggtcgacggcaggtttttccttcgcacggctgtcaaaacaacagtgcggttgcagctagcgacgatgacaactctaggttgacaatgagggccacttgaaactattaagactatatatatgtatatatatgattggagtataaaacaaaaaatgaagtacaagatgattatgagagggaagaaaatcgaaggatatgtatataaaaaagatgattaaaacgacacaatatttgtaattaagaaaacaaatttttacactttgttttatattttaagacaatttaattttttcaagtcaaacttatttaagtttgaccatatggtaacatgtacaacaccaaactagtttcattaaatatagcataaaatgtattttaataatgtttttgttttgggttgaaaatgctaatatgattcatataatgtattaaaaagtcataagcaaacatctacatactcctccgttaaataatatatctcacgctatagtaccgtgtttttttctttttttttttgcctgcgatgttgacacgttcgtccggtgcatatattctagtgctgtaccttttttttctaattatatttttgctgacagatctactaatgtttattttgacaaacgaaatcttattatattttatgcatgtacttactcccatttttttctattgtttgaagcgacatctatgatctatctctatatttattaacaagccaagcaactacccaacgtcgttgtttccacagtgcgtatgagcgagcgagcgagcgatgagagagatgcggcgttggtgcagcaggatgagcggtctcgtgtgggtggtgcttgtgtgctcatggacatggaggatcgcagctgctcaggctccgcaaccaccaaaaactgatccactcgagggtaagttgtactactacatcgatcttaccagattttttgatgtatcattttttttttgttttgtaataaagactctgtaagtttgtttggctcaatttctacatatataccaaaggctgagtcaatatggatctgatttgtccgaaagatcatctcataccatgtgcaaatcgtcgtcttgatcttggttttcctccatcgattgcaggcctctagcttgcctcagaaaaagaactagagggaacttgattcattttatagttctgcatggacatatatacatgaacactaattaaacagtaacgctgagtttaaccatgccagcggcggccctgaacacgatactgggaagatggggcaagaaggcgtcgtcggagtggaacataagcggcgagccctgcagcggtctcgcctctgacaaaagcgactgggataactaccccaacatcaatccattcatcaagtgcgactgcactttcagcaacaacaccctctgccacattaccagactgtaagtatacgcttccacgtcttctctctttggtcaggtgtgctgtgcactatgagttcaatgaagtgccctttgtaaagagttcgtttaaatatttgatctatatatttgatggttcaaatatatgtggtcaagtgtcagactgttagtgactgcttgttttttgatctagtgtcatctagttcagctaattaactctacatgtgttgcttgcaactgcttcctaccataaaatatggtccattccaaccactgcttttgatccaatttgtttatattgtactactgtgtttcctctatttcttttttctttaaacaaccccgcacaagatagcacgacgtttctattgatacagcagaaaaaaaaaatcacaagtccatagtcctgcgagacaatagttaggaaaaagaaaaagacaaccacaccacatatctacatctcctaatgctaaaatcgaaacaagcacacaacaaccctaaggaatgtgtcttctaaatgacgcctccaaggagaaaacgacgctaagagcgccgccaccgcccattctaaagaatcaggacttagttttcaccaaaataacccattgggagagaagaggaaacatagcaatgccccaagggaaaagcggggtccgtaggcgtcgccgttgccggcccgaaggctaggccttcgcccatagttcctactctcccgcactaaagagtgcatatcagattcagcagaaccaccaaccaatccccttcgacacatagcaactacgccggcacctcgctgctggccggtcatcaaagagagtctcaaactccggcgcacttcaactgcatccacgtggttgggttggaggagagaatgagagtgaagaatggatcatctcttccccgtactagcttgtccagcatggccatcttatggcagcaagccaccgcagcaaaagcacaaacgcctggaaagatgcttgccgcaggcttcaacgttcttctcatagcactaccattgtcaccacctccaccaagctaccattgttttcgcaatgggccgctaggtatcatcatcattgcttccatcctctcaccacggcagccacaccgccactgcacaccagccatgccatgctcgcaccatgacgccgtttgcaccgaccttccatagcccttggtggcctttcactgcctctgctctcgccacgttagactcccacagccccacctcatcgggtgcatctcctagcgccaccatgcctactaactgccaccaccggacgctcccagtagggttctcctatccccgccgccatctccgccttcctcccaccgacggtgttgcacgggtgagcccaccatcgatggtgcagcatcgcgcctttccgcctccaaatgtctgccccaccacctccgatgtccaccacctccacactgccgcgccccaccgcctccccgccgccactagctcgaggatcggctccctgcgcctgggaggctggatccgggctgaggggctggatctagtagcctccttgccgcctccacgtccacgctgccaccgacatctacactgctgcctccacgcagccgtgccttggcgcctcgccgccaccaccgccggatctagacaggaggatgccagatctggccagcggcatcgtgcctcgccgtcgtcacattgccctggatctggtcggggtcgtgggcttcgatgccgcgacctcggggggaagggatggccccgccgccgccatcctggcggccacgtagtttctggtagcctgctcgaggggcggtgaggtcgaggagggagataggcagggatggtggcgcaccggctgggggcgcctcccgtgtcgcccctgccctaggagtgacgtgggggcttgcctctatttcaaattacttgtgcttcaaatgcactaagaatcctctcttcacgactgtcgatacctaaacttgtcgtccgtgtcattttccgatctctcaaaatatattttcaggacttcaaacttgtcaaagtgtgccgttgcggtcccacattatcaatagacgctcatgtgaaatgccacatgggagttgactcattttctttatcttttttctcccctttttctttttcttctgttcttccttccttttggtgtggaaaaaaggagaagggaaacacaaagggaaggaaatagaagaagaaaaaattttgggaccggaatattaatgtgttatgtcacattagtgtccatgtgacatgccacataagcgccatgtaggatctcggagggtcgtggtaatttgagaccataatgacacattttaataagttcgaggacctaaaaatgaattttgacagtttagggacctagatgacatagacgaacaagtttaaggacgggcaatacactttactctaaaagttatatctgacattgattagtggacattatagtcggagtgaagtatgccgacagtccctaaattagtgcgggtgtatcatctaggtctataaactatcaaaatgcattctcggatccctgaacgtgtcgtgggtgtcatataggtccaagcgggctccaagtcgctccgtgcgttgacgtggaatgccacggtgacatatacgtgttagtgtgacccacatattagtcacatagaaaagtatattttctcctccctttctccttctggatcttacatgaaattagaggaagataggggggagagagaagaaaaatatgtttttttaattttaatatcttctatgtgaatgacatgtgggtcctgttgacatgtaggtgccaccttggcatgtcacatccacgcatgaagtggattggagcccatttagaccttgataacacccattagaagttcgagacccaaaaataaattttggatgttcagggacctagatggcgcacttacactagtttagagatcacctgtgtacttcactcaattttaaatcgcaaaaattgttttttttttgttggaccgagggagtagtactttctatgtatatacaacagtgaaatgatcatctctccatagtaatggccgcagtatcgttttttcgcatcactgtcctctctcatctaaaccctagccacttgctaccccccgcctccacctcgctgctgcctgagcaggccaccggagggcgagcgatagctaggatggctgcggtgaggtcttcctcgcctcttttggcggtctgagccagagatgagggacagtgagcaacaccagagttttttttttttgactgaaagtgagcaacaccagagttgagggacaatgagcatggcttgagcggcatgaagggtgatgagctgatgatgctgtcgtggccacacgcaggagtgctaaaggaacccatgtgttggatgtagtgcaacggtcggctcataatagggatagtgaatcccatgggctagatttggccgaatggcaatgatggatggcaaccacataatgcctatcagtggccaaggtggcacatgggcattgggagccgtgcagtggtgccgttggcaggtgcggcctaggtgggcattggtattctcgagcctacaagccacgcctaagtttcagttgtgccggtgtcgcgagtggtggtgtcagcggtggtttaaagcaaggacatattttttaagatttgaagcttagtattctagctttcttttcagtcctctagcatttttcttgttttttctatactagaaaaggtacctgtgcgttgcaacgggtagagccaatttaatttgtacatatgtgtcagatagagaggggaagacatataggtcccactattattttgaaaagttttttctgccgacttagcataaaccattgtctaaaccactaatggagctaatttgcaccggttttttaagttgagggaagcattatacccggttctgggttgagagatgccatttgatcataggcaaaacaggagataggtaaaatagacttattccttcccctcaagtttacagcccatatatgttagttcagccagctttctacaacccaattaaatttgagaggatccattatatgccactgactttgtcacatgtttacgatttgtctctgactttgtcatgttctataatatgccatcgatttttgcttaacttctacaatttaccatcaccgtctggttagcctctgttagcactgtacattttttttccaaatgaccaaaatacccctaggacaaaaacttccaaaatttggataaaattatcaaaatatcatattataaacataagattgtaaacatccaaattttggccaaaaacataaaatatgatatttcagaatttttatccaaattttgaaagttttgccacagggatattttggtcattttgacaaatttgtacagtactaatagagactaaccggacgacgatggtaaatcgtagaagttaagaaaaagtcgatggcatattgtagaacgtgataaagtcagtggcaaatcatagatgtgcgacaaaatcaatggcatataatggattctctcattaaatttgcactaataaagcatgaaaataatccttttctttacagctcgattcaatcttcattgtcagtccgagcgagtgaacttcggctgaattgtgccgaactgagctgatacgacaatggaaacaaatcggacaacgcacaaaattttcaggcaaaaacaccttaaacttttataattgtagagatagagatagagatagagattgtgaggcgtggggtttaaatactcccgattgtaactttggctgcatacatccaactatggacaagcccatccaaatttcacttcttttgttttcctctgaaaccacaccagtccgtcccaaatttggtatgccggatgaaaaccgggtattctatttttttttgggtgaatcggcctgattttgtacgttctttgggcaaaccaaatgatttgggagttagggtaaaaagtgaatagttctcaacaatccaagggaaaaaatagaattatttcatttacttatcaacattgattactttcttgtttttgtaggagggtaacaaatttgagcgttgttggcgaaatacctttggagctgcagaatttcacctatatgctggacctgtatggtatctatgccttatcatcttaatcctgataatcaatgttaattttgcaggaaatataaattcaactccttgttttgaatactcaactgtcgacatcctggtgaaaaccagcaaatagtagtcgggaatgcaagatttttgtgttagctaactgacatgatgtttcttggtgttgttgcaggaacctgggctataattacttgactggtgccgtgccatcattctttggaaagtttactttcatgaaatatttgtaggagctatacgtcaatttctcaaattcatgtagcatctatagattggtgttttgtgttaactatttttcatcatttaaagggcttttcctttcaatgcactgtctggaccgcttccaaaggaacttggaaacctcaccaatctcctctcgctgtaaggacttgtttttcatggcagatcaatcttcaaatataattttgcgactgcctgaactaaaataattatactagaaacgattaatcacattttttctcgacaataaatttactgtaaattcagaagtctatatgttagtcctgtcggcatatcttagcctgtaagtttcaagttgtacttcacatgttcaaggaaaattgacctgaggaaggcttgaaaatttattatgtaggtcagatggctcatcaggttaaactgagcccctttccagctattagaggaatatagctaatttattgtcatgaaatattcgttttgattcaggggcattagctttaacaattttagcggtcaacttcctaaagaactgggcaatatgaccaatcttcagcagatgtaagatgcaccatttctaatatccaattgctatttatgaataactaaattttgttatgggcagatatattgttgtacaggataacacttcaatctttcaataacaggtacatcgatagttgtggattcagtggtccgttcccttcaacattctcaaaacttcagaacctgaagatcttgtacggtcaataccatagccttagacattatatatgttcgtcatgttttcatgctaaatgtctaacatttggatgcggatgcaggaggtcatcagataacgattttacagggaaaatacctgattatttggggatcatgcctaagttggaagatatgtaagattaattatataaacttgttgacataccactcagtgtatcttattcagagacaaatggaattgttcaacataaagtttctgcatgtgtttttccatctgaactcaaacaatagaatttttcaccttccagtctgcatggaattagagtaatctgcatgccatgttgatacaaacaactttgacttaaaaatgctcatacatggagcttacttttctctattagaatgagcttcgcatgtctgtacttttctgaaagtgtgagcttgtagggctttccaaggaaattcttttgaaggaccgatcccaccaagtttagctaatctaaccaagttaaccaacttgtaagtacattgttttgggtatcattgattcgatgatggctgagagcctgacaaggtcaagctagataactgatttgtaaaatatacaaatgagcagacggattggtgatattgtaaatgggagctcttcattggcctttatcagtaacctcacatctttgagcaacctgtatgtgatgcttttacacatagagcttatagtattcacaaagtttcaagttactgaaatttgatctttttgtcacagaatattaaggaactgcaagatatctggcaatcttgcaccagtagatttttcgaagtttggagttttaaccctgctgtgagttttcactcttagcattgctacatgatttattgtgcttttaatcatttcttcagattgtgaagcatctcttgatgtaaaaaatctgtcatgaatcacagggacttgagttttaacaatatcacaggccaaattcctcaaaccattctgaatatgacaaatcttgaatttctgtaagaatgttttcattgccttaattaagtttacacaaataaaagctgagctcatcattatgttccatcatcttgtaccatatcaggtttcttgggaacaacagctttacaggaagtcttccagatgctataagcccatccttgaaagcgatgtatgtcaaaaagaccaaaatagcaccataggtcaaattattttcataatacaatgtactaatttcatatgtactgaccgtggactgtttgtagcgatttttcctacaaccaactcaccggaggcttgccttcttgggctacccagaacaacttccaattgtgagtatgaaattctgaagtttggattgaagaatagtagaattagatattctaatcttttattttgtactagaaatttggtggcaaacaactttgaacttggtaccataggccacaggtacttatgacatttagttataattctgcaagaggttaaccatcaaaagaatgttactcacaacttttatttttttaattaaaattgtccacagcactttaccttcaggactaaactgcctccagcaagacaccccttgtttccgtggatctgcagaatgtatatttctttctcttcatctacagtagtagttaccatgagcatggaaatttgaatgattgattttacaaatcttaattccagactattcctttgcggttgactgcggcaataatagaacgactagaggcttagatggaactatttacgaaccagatgctgcaaaccttggggctgcatcatattatgttactagtgacacaagatggggtgtaagcaatgtcgggaactactttctggctacagatggagtgaacataataaatagtccacagaaaattcagaatgtccttgattcaagattatttgaaactgcaaggatgtcggcgtcgtcggtgaggtattatggccttggactcgagaatggaaattacactgttctgcttcaatttgccgagtttgcttatccagactcgcagacgtggctaagcttaggaaggagagtttttgacatatatgtccaggtaaaaattgactggcttgtttactgaatttttttattctttatctgaaccagttgcaatttgcctagggtgatctaaaagaaaagaattttgatataaggaagatggcgggtggaaaatcttttactgcagtcaacagaagttatactgcaagagtgtccaaaaatttccttgagattcatctcttttgggctggtaagggaacttgttgtgtacctactcaaggttactatgggccgatgatctcagcattaagtgtcacaccaagtaagcgcaaccattatgttatcttcaacaaggattatatggaatctaataagatcatttttttatacagattttactccaacagttcgaaatggtgtaccaaaaaggagaagtaaagcaggtgcaattgctggaataacaattggtgcattagtgttaggagtagtatccttatttggaatatttttgttggtaaagaagagaagaacaatagcagaacagcaagaaggtattaattatttttatagtaattcagtctaaaactatttagatgatttactctttctcatctgaccatgaaaaacaagcagaactgtacaaccttgctggacaacccgatgtcttcagtaacactgaactcaagctagctaccgacaatttcagttatcaaaacatcattggggaaggcggatatgggccagtgtataaggttttctattatctgttactaataatgtgcaaaaagagacgagtatttatttcattttctattaagaccagaattttggtaatctttatgtgcatgttcaaaatatacatgtaataggtttcttcatttggcagggtaaactacctgatggaagagttatagcagtgaaacaactttctgaaacatctcatcaaggcaaaagccaatttgtgacagaggtagcaacaatctctgctgtgcaacaccggaatcttgttaaattgcatgggtgctgcattgatagtaaaacacccttgttagtttatgagtaccttgaaaatggaagcctggatcgagcaatatttggtgagttcaatgatgcaaatttccagcatatgacattatgcttggttgatttcactaatacaattttgcttcactaagacaagacaatttgtttttttttgtattttgccaacaactgagttatttctgcttgcacaggacatagtatcttaaaactagattgggcaatgcgatttgatatcattttaggcatagcaagaggcctaacatatcttcatgaggagtcaagtgtccgcattgtgcatagggacatcaaagccagcaatgtcctacttgacactgacctcaccccaaagatctctgactttggacttgccaaactatatgatgagaagaaaactcatgtgagcacaagaattgcgggcacaatgtaagaacatttaaccatttctcttcttaaaaccgcaatatcaatatgattgctactattaatttatcttatctttgtcaaggggctacctagctcctgagtatgcaatgagaggtcatttgtcagagaaggccgatgtttttgcatttggagtacttatgttggagactgttgctggtcgatcgaatacaaacaactcccttgaggaaagcaagatatatctcttggagtgggtaagctgatcaatgatctttccatcccagaaaacattagttcgttcgtgtttattgtcttctgctcactgaacctatgtttgtatataggcctggggtttgtatgaaatggggcaagctctgcgcgtagtcgatccatgtcttaaggaatttgatgagaaggaagctttcagagtcatctgtattgctctcctttgtacgcagggctcaccgcaccagcggccgccaatgtcaagggttgtggcaatgctcatcggagatgttgatgtggctgaggtggtcacgaagccgagctatatcaccgagtggcagctcagggatggtgggagcagtagctacaccactagtagctatgcaggatctagtaaccctgagtttagtaggcagagggagaccaaccctctcgcacggtcatcaccaacgatcaccaaagctagtctggtgggaaggtgagaattgaaagttgaattgctgcaggtgattgacccttggtttgcagtgacaatattatacgttggtgtgaattggagaaaataacataattacttactctggtttcttgtctgaaaataaaagctttcctcctataatttttgaaaggtgaattaatgtggcgtattattagtattctgagtgaataagtgtcagcaacagttgttgggtacagaattacatcatgcttgtcaaatgaatgtttgatgaggtgtacaatgaaaggccatatggacatcaatccaacaatgagaaaatggtttatggcagaaagaaatactacttcgatccaaaaatataagaagcttttgggttgaacacaggtattaaaaagtaactaaaattaattggaggaatattgtgattggttgataagagaaagtagatggagaaattaagaggtcgacgcatgcgattgcttgagaagagaataagttacatttgggacaaattttcaattctagaagttattttatttcgggatgaaggaggtaagagatttccagtattcagaaacttcgatacgaataagttcgattcttcatggcccagcaacaatggacaggatacacaactagaacctaattcatgtaaaagaacagactcgtcatagtaacacaaacactagatcaaaacaatgacaaacgtgcaactcaaactaaaatcaagaccggaacttgacacaacaattcaacttaaaattctgctcagtagactaatggaacgatgcaacaactcaagttggcttggtaatggatataatctttttatggctattttctggttaggtagataaattactactctctctgtttaaaaatagagggaaactattttatgccattgcgaacaggctctagctgagttggttaggtggctctagtaacactcgtcaggtcctaggtttgactctcagtgggagtgaattttaggctggggttaaaaaaaatcccctgtcccatgccaaagcacaggtctaaggcccagtacatgtcgttggtcattctcacacaagttacggtgtcactgtatgggtggggttggggttcggggattttttcgacttgcatgaaaaggtcttcttctatacaaaatgcttgtgggtgttggcaactatttgtgacaagttgacaatgacgatcgcagcaccttaagccttgcggtgatcctagagtcgccaaccataactaaaccggctagcggagccgatttctagataattacccgtctcgtgggtaaaacgttaggttttcaggacaaacctacaaagagatgtcgcactcttgcagcggcggcgaacggtttacggcacaaaccgacaaagatggacaaactaagagaaaactaaaagcaatatgaaaaacgattcgattgattgattgtagattggtttttttcaatgaaccagccatgtcccttatataggggttggtcttgccctctacaggccctcctccacgtccaactcggggtagaaactaaaggaaacccgaaacatgccttcccgagcaaggaaacctcgagacccgacgaaacacagtcgggctcggacctgccggtcagaccggccctcaactggcggtctgaccgcccaacacacggcggtcagaccagcccactcggaggaaaccggtagatttccaaattctggcaatttttcctattttaattcttggtgccaaattttggtgtaaacacatgcccccctgccttttcgatgaacaacgtgaatctaaaagcatagaacatgttttggtcttaggacgataatccaattactggccatagtatctcctaagcgtcttgccaaacgctcgggaagtaattcttcaagtatttcccgttgattgctcgctgaaaacgctccccttgaagtgtctccaaaaaatatgcgtttcctcgaacaatgccgcatactcgataaggaccctcccaactaagagaccacttaccgaactccttggatcgagtacccaaaggcaaaattgtctgtcaaaccaaatctccaacttgaaacaactttgctttcacccttatattgtacgccttggccacccttttcttctcattctctatctctttcaatgccttcaagcgcttgtcaatgacttcatcaaggttatctcccataaacgtcttgtaatcttcacttgacaaatcatcttgcttgatataatgaagagaaccaagatttacctccaccggtaaaatgacttctcgaccataaaccaactcaaaaggagtcactttagtggcaccatgtttagatatcctatgcgcccataatgcttcggaaagcacctcatgccacctctttgggtgttcctcaatcttctttttcactaacttcaacaatgtcttattactcgactcggcttgtccattagcctgagcgtagtaaggagaagaactcaacaatttaataccataagattcggtaaaactcttcacttccttagacataaaagaagcaccttggtccatagttaatgtttgcgaaataccgaatctatgaataatatgcttcaaaataaagtcaattacctccgtatgagtcatgttcttcaaaggcacagcttcggcccacttggtgaagtattccgtagcaactagcacggacctatgcccctttgatgacgaaggacaaatttgaccaatgaaatccaaagccctacatcggaacggccatggtttcattataggattcaacacggcggcgggcgccaattgaacattgccgaaccgttgacaagcttcgcatcccctataatatttgaagcaatcatcaatcatcctcggccaatagaaccccactctcctaagcaaccaattcatcttgtgggccgattgatgagttccacaaattccttcatgtacctctcccatagccactttagattgatcttcatctaagcactttaacaagacacaatctatatttcagcgatataactctccaccaaacaaagtgtatttgaacgtgtaacatcctcaaattttaaactaaaatttgactgcatcatgctggcttttgattaaatttgtttggttcaaaaatctatttgatgtttatttaaaaattggttcaagtattattagaacccttccaatttactctaacttattccctttattttaaaccctagtgaatttgagcaaaatctctcaaattcaaaccatagattatttctttagcctatcctattattagtggagttttgctatactctaaaccctagtgaaacccttccaaactcctagtttgaattcaaatcttttctagggaaatattcaaaaattctggaaattcactgttcattgcacccaaggtgctcgacagaatgcctagcccaattagagcaacccaacttcttccaatcttgcacaaagtttagatttggtcctaggggaccacaacccactcaaaaccgtggctttctttgcctcttcctccccttcgcgccgcccgggcatccgacttagccgcgcgccatgtcgccgcgcgtcggcctcggagccgcctgcgcatgcccgaccgccttggcgcgccatcacccgtccgatgccctcagctcaccgctgctgcaccaatcttgacgacgacaaagccgggatgaccgccgctgcacgaaatcgtcgctcgacgccgtgcgctcccatccaagccgccgccgagtgcgatttcgcttctacccggggtgaatcgcgccaattcttgccgcacggttggattggagatagacggtggtatcccctctcacaattcaaaccattcaccccaagtcggccgttttcaccctcgccgccgccgcgcgtcgtgctcggattggcgtcaacacgtcgccagccgattccaaccgcggtcaagtcaatccttcgccggtaagtattcgaacgtggcctcccgccactcaaatcgatcttgcccgccctctctcagcttctgccacctttgcctcatccaaaacccgagttcatccatggcgatgacggtgcccgagctcatccggtcctcctagccctataaataggaccccaatcccttccctgtccatcatcgatcatcaacaaccatagccccacaaccccaaagctctgcttcaccaatccatctaatcaaccaccctcgctcgtcggtcgaacaccttgtgcgcgatcgactcaacccctctccatccatcctccgccctaaataacccttagaacacctatatcctaccatgttctagcataataagccctaaccaaagctctacgtcgagttttacctcgccacaccaagccgagcattgccgcccccacgctgctctgttcttcgccgccgcgaagtttttccggccgcaatccgtcgtttcaaccaacctcggtgagttcttccgtttcaaccatctacatactacctagattccattttagcaatccttttgcacaaacatgccgccctctgagctgccgacgtgagcacggccgccgcctatggaggcgctcgtcggcaactatgtttcgcaccttgccaaaggttggcaagctgccccggaatccctctaaatacctcatagatgctctggaacccctcccctagccatgtctaactcttatcaccttgatcgccatctcggcctaaccgtgccaccgccgccctagccgctaagccgtccatgcatcaaattaactcctccgccgccgctcgccgtcgccggagatccctagctccctcccctcctcggccgcaaccactttctccctctattgccgccgcaatcctaaaccctagtgccgccagcctgacttggggaatggccgaaggtagaagaagagaagagagagagagagactaacaggtgggacccgcacacagtgccatttcacatttatttgattttcaaactttagaagcccatatcttttaaaatatagatccaatttcaatgaaacttggaccaatattcttctaaaatcattctctatcttttggaccctttttgctatttttacattttattttattttctctatttttcttatttttagattttatttaaaactcctttttgaatttggattttatttgtctaaccctaggtcttgaggattcctctgacactctagataatatcaatcaatctcaggacatcgagcaaggcaagtaaccatatacctgttgatcatttaagcctatattttacaaattatttatttatagccttctattcaatattctattttctatgcataaattaatcatagaaacccagataatttagtattgcttattttgcttacaatctggttaaaataccctatacttaggttggaacaatacgtaagatttggatgatttccgggtggctagtattgtctcaatcgatataagttttacaaggtacttatgtcgaacgaacgggtacgaccgcagtttctataatggggacagacctagttattaggttaattggcaatatggcacctctgtatagtggttcttatttttaagtcctcgcgcaggaggcaactatagccgcgaagggcaactttaaccattaccatgtacaggtaaatggtttgtgatactcgagtataaactatatggtatatttctaaaccctgatcgagatgacgtggtgtcatacggtcagttccccttaaatatctcgggaacgccacaactcctcttgctgctgttaacattacgttcagagcatatgaggatataagttcatggaacaggtgccataattgttaatgacttaatactgggccatgactaaagtcgatgattatcagcaagtcgtggactgcaggtaaagcgtacatctgctgcagtagaatatctttgaaactattcgaatagccgtactcatggagttgagtaccgggactcatatggtaccctggttagaaacctaaagtttatatgttttataaactcttgctatgatttttccagattgtccaatactgctttttgcaaagaaccctattatatgtcaatgcacaacatatttccgtgataacttactgagtattgtgaatactcatccttgctcttataacccctttttcagatctaggtcaagaggaggacccttatgactattactacgaagaccccgataacttagaaaatccctaaaggttatacctcactagtcagaatgtatagaaacttccgctgtgtattaattagataggtgagtacctattattgtaaaacccatagtattgtaagactttaacgtatgcaacgaagaaccagttatattgtatgtatcattttttactgatccagggattgatacattaatcttagtcggatccaagttgttagttttgggtcccgatagaacgcttgccgccaaattttccaatcaaccttaagtgtaggatctttcaaatatcaaatcaaaggaattctccaatcttctttctcttcctgggtacaaatgtccaaatttacaattaattcaacctctaaattgattgaaacgtgccccccagcgctctgcccagaaccggtcagaccggccacacagggccggtcagaccgctcggggatgccggtcagaccggcggcatgtagccggtcagaccgcccctggtcaccagtcaaaccggccacgcaatgccggttagaccacccctggtccccagttttgccaatttcgcacaaaggtttaaaatcaagctccgactcttccaatactagaaatattctcttcttcacattatagccagatgcttgttgtgccaagtcatttgctctagaattatcacgcctagcaatatgtctaatagcaaaattatcaaaattggcaataatatccaaacatgaatcgaggtacctatttagtgatccgtccaagcatttataaactccagcgacttgttgcaccaccaattccgaatcaccaaaagcctccacgtacttagctccaaccatctccataacttgttagccgaataataaagcattatattcggcatgattatttgtacaataatactccaaacgaaccaatgcttcataacacatgccattaggtaaaaacaaaactacccctataccttgaccttctttgcaagaagaaccatcaaaataaatcttccaaggtataacttcaactaagaaaacctctccctcataagcgatatctacatgatgatccaccataaaatcacatacaatttggcctttcatagatttcaatggttcataagccaaatcataatctatcaaaacatatgcccacttgccaattctcccacttagaattggcctttgcaacatgtgtttaataacatcggcttgacaagcaattatgcatgtactagataacaaataatgcctcaatttggtacaagcataatataagcatagacaaagtctctctataaaaacatacatcgtttcggcatctaaaagacggcggctcaaatatgtaatgatatattccttgccatcttcctcttgcgttaaaacggcaccaatgactttgtcttcggaggcaatatataaccgaagaggcttttcggctttaggcactcacacaacgggtggagtagacaaatatctcttcaactcttcaaacgccccttgttgttttgcccccccaagtaaaatcggcttattttttcaagcgaagtataggaacaaaagcatcgattttacccgctaggttagaaataaaccttctcaaataattcaccttacttagcaacttttggacctccttcttgcatgtcggcgctttgaaatcacgaatcttttctatcttattaggatcaatctcaactcctctctcatgcaccatgaatcctaagaactttcctgccgacacatcaaaagcacatttaagtgggttcatctttaaaccataccggcgcatcctctcaaaagctaacctcaaatcagctatgtgtccttccataccatccgatttgacaacaatatcatcaatgtagatctctaagataatacctagcaaatcatgaaagatcaaattcattgccctttgatatgttgcaccggcgttcttcaacccaaaagtcatgacaacccactcaaacaaaccaacaaatcccgggcacctaaaagccgttttgtacatatcctcttccgccataaagatttgattgtagccggcattaccatctagaaagctaatcaccttatgacccgaggcatcattaatcatcatgtcggctataggcataggatactcatcttttggggtggctttatttaaatctctaaaatctatgcaaactctaatcttaccactccccttcttctccaccgggactatgctagagacccactccgcataaccaccgggatcaatcttctctttgactcggtcatatagcaaaggattaaaatgacgaggtggttgcttataaggcctagaacccggtttaattggaagccgatgctcaatgagctcacggctaagacccggcatctcatgatattcccatgcaaagcaatcaacatattctttaagtagctcgattatcttaaccttataatcggctctcatatttttgtttacaaaagtcggccttggtttcattccatcacctatgtctacttcttccaaaggattggccgatgtaaaccatttccctagcttctctacttcatcaaaatcttcaacggtttcaccaatatcgttctttgtagaccgatattcttgcaccctcttttgtaaccactctaaattagcctcgttactcattatacaaatttatatggcttagccgtgctacactagccggctttacagagataggtacaaatttgccatcggagatactaataaaatcataactagaaagatccctccccgataagcattgaatattcccatgacgccactcaaaagtagcatcggccattgcaacctcggccgatgtatccgcttgaacaatttcaacatcatcaccgtcccattgaattaaacattgatgcaaggtagaaggcacacaacaattggcatggatccaacaacgacccaaaataacattgtagttaccttgcacatcgacgatgaagaaagcggttggtagcgtcttgtttcccacggtgagctccgccgaaaagataccctttgcctccgttggttcgccattgaagccattgagaatcatgttagtcttcttcaactcatcatcctcacgccccaacttcttgaataatgaatacggcatcaagttcattgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcacgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggttcttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcgggaatttaaatagagcgataatgcaataatttaaatcaacataattttacaaactgggattcaatatgttcaaagatgatgtgacttgccttgctcgctttcccaaacgttggcttcaacttccacgaagagcggatcttccgaagctgcagcgtctacacgaccaacggaaaagaaacggcttttactctactaaactccatataacaagcagaaacaaagcacaacaatgggttcttgacttcttaaggagaaatcagagacttgaacggtccaattccgagttcaaatggtcaagttatggccatttgaaggttatatgctctttaaatgaatatttgcgaatttcttcatttaaattttaatttaaaatcggatttattgcgtcagccgaggggaggggcgcgcggaccgggtccacgggagtggggcccatgcggcagcctcacggtccacgatggaccgggtgcacgcggcttacgccggccggcgccgtgggtcccacgcgtcagccgcacacgagggcgcgggcggctgacggccgggccccacatggcagccgcggggcgcgcccgaaggcggcctcgccggcacagccgacgggaggcgacgcgcccgcgccccgatggtcgccggcggcgaccaccagcgcggcggagcggcgcccgagagaggggagggaagggggaagtgaaacggcggtccacggctcaccccgggtcgacggcgacgacggaaatggcgaccggagcggaggaaggcggcggcgcggctcgggtcgacgaggacggcggcgttccggtgatcggcgggcgaagccgaaggaggcgatgccgaagcgggaggaggtccggggcgacggcggcggcgaaccggagctcggcggcgacggcggagaaagagggcgacggcgcgagctcgattccgacggggagaaagagcggcgagtggcggaaacggaggagggaggcacggggaacgtttaaatagtgttgggagggggagagagcggccggatgagggggaatcggccgcggaagatccggccgccattgatgcgccggcgaagttcgcgggggagtttccaaacgaatccgagggagagagagagggaaaagtgggggggaagagggagggaatcaaggggagtgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcgggggaaggccgatgggccgcgggggagaggagagagagggagggagctgggccgagccggcccaagagggggaagggggggggaaaaggacttttagggtttttctttttataaaaccattttaactttgtttatttcttcttaattattatttgtgctctgaaaattccactaaaatttatttacgcattttaggcttttaggaaatatacaaaaatcctccaagccttatttgacttttaaatttgcacattttaattgctggaggctttcacatggattttaattattctatgcataattttgaggatgtattttagagtcgatttgggaagcgacaaacctaccccccttaaacggaatctcgaccccgagattcggaaggactggcgaagagatcgggatgggctgccttcagctcgtcttcacgctcccaagtagcttcttcttcggcgtggttgctccattggaccttgcaaaaacggattacccggttcctggtcctgcgctccatggtgtccaggatttttactggcctttccacgtaggtcaagtcttcgcgaacttcaatttgctctgagtcggcctgctcggatggcactcggagacatttcttgagttgcgacacatggaacacatcatgcacgttgcccaaggaggcgggcagctccagctggtaagcgacttctccgtgccgagcaatgatacggaaaggacccacgaaccgaggtgcgagcttcccttttgtctgaaacctgtgtacacctcgcaatggcgtgacccgaagatacacaaaatcacccactgcgaattccaggtcacggcgacggttatctgcataacttttctgccgggactgtgccacctttagattatcccgaatggttctgaccttcgcttcagcttctctcaggatatcagtcccgaacacttggctttccccaacttggtcccacaatagcggtgtccggcacttgcgcccatacaacgcttcataaggtgccatttgtatgctggcttgatagctgttattgtaggagaactcggcataggggagactcttatcccaggtcttcccgaaatctaggacacatgcgcgaagcatatcttctaggatctgatttagacgctcggtctgcccatctgtctgcgggtgatatgcggtgctgaagtttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtataagctgcttaagttctctgttatctggaacgcatacccgttttccgttccatagggttccgtgctcatcctctgtgaaaccagcggctttaccctgtttcatattcttgaggagtccatgca

SEQ ID NO: 74791 - DNA, 20962 bp, Oryza sativa
agtccatgcatgtccggatcattcttctgagcctcgcggatttgatcgagcaaggtaggcttggcttccaacgcagccaagaatccacgactaactatgcttaggttccgggctgccatctgttgattaagttcgggtggaatgccacagatgttaagagtgttgcaatggctctttcgacttagagcgtcagcgaccacgttggccttaccaggatgatagtgaattcccacatcataatccttgatgagttctaaccatctcctctgccgaagattcaggtccgactgagtgaagatgtatttcaaactcttatgatcagtatatatttcacagcgattcccaatgaggtagtgccgccagatttttagagcatgaaccaccgcggctaactccaagtcatgggtagggtagttgccttcatggggccgtagctggcgtgaggcataggccaccacatgaccgtcctgcatgagcacgcaccccaatccttggcgcgaagcgtcacaatacaccatgaaatccttgcgagtatccggcaagattaacactggcgaggcaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcgaacttgagtgactgttttggattgcttccaatcagtgacagcggtcactgtttcggggtccacagcaacacctttagcagatatcacgtgccctaagaatttgacttcggacaaccagaactcacacttgctaagtttggcatacaattgatgttcccgcaactttcccaacaccaggcggagatggtgctgatggtcttcctccgattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagtccgtatcgcgtggtgaatgcggtcttcggaatatcttcttcacgaatacgtaattggtgatatccggaacgaagatcgatcttagagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtgctcggacgtatataccccttttctgtcaactcttccaactgtttcttaacttcggccagttcatttgctgccatacggtagggtcgcttgtacagaggaatggttcctggagcaagatctattcggaactcaatctctcgcttgggcggcataccaggtagttcttccggaaacacatctccgaactccctgacgatggggatttctgacagtcctatctgatgcagttctgaactcctgacagaggttgggggtgcaaagaaaacaaccggttgttccggacctcggtacagagtgacagtgcgtctcgcgcaatccactactccttggaattgagccaaccaattcatcccaaggatcacatccaagttcttggtgtctagcagaatcaaatccgagggaaaaggaatcccctgaatttctatagggacggcaggactataatactttgctgtcataacccctccaggggtggtgatgagcagagggttcctaagcctttctacccccaactgatttcttcccacgaatggcacagatataaacgagtgggaagctccagagtcgaacaaaatggtagcagggatggaatgaatgaggaacgtaccaacgatgacatctggagttgtcagcacgtcctcggccgtcacgtggttcacacgaccccgaatgacatccttaccaccgttgttggagcggggaggcacttggccttgctgacgccgcggttttgggcatttgtccgcaaagtgcccgggctcgaagcagttgaagcacagacgctgcggaccttgaacgtccctgcggccttgaccaggctgcacagttggcgtaggaggacggggcgcacgagtcccttgctgactctgctgttgctgcggctgtgggacgcgcaccatgaattgagggcggggcgcggagcgaggttgctgctgctgttgttgctgctgcgaggaggatccccctggatagggattggtgtagcggaccctttggttagcaccctgttgattacggaaattcgccaagcggcgcttgtgcgactccagttccttgtgcttggcttccaagcggatgctcttgtccaccagacattggaaatccggatagtccacggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgtccctctggctgcgtagcctggaaatggtcccaccatagagatgcgggtccctgcagctggtgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttggggaggtgggggtggagcattatgttgtggcggattttggaggtggtggaggaaagcagtcatcatgttggcctgctgggcgaggatttgggtgagaatggcgttggtatctggtggtggtggtggtggtggaggcggaggaggaggtggaggtgggctgccatggttgttgtggttgctgccttcgggttggttgccatcactggtggcagcatttctcctggtcgtcaccatctgaaaaccccacacagaaccagcaaacagagagagctgacaattaaagctaaccacccacgactaccataattcttgaatttattactgctattaaatgggttcattaaagttcaagttgcttaagcaaataaaataaagacaggctccgacacagttacaccacacaccggcataaccgtgccccacacaacccaacaagaagacaaacgagaaagaacacacgcgcaagcctactaactgctcgtctaccgctgcgacgggccagggcggaaggtgagcaacagcgcatcctccgtgctaccaacgccggaggcttccccctcctggggaaccacgggcgcaggctcggcacgaggggtctccacgaagcaagtccacgccagggactgacgaacaagctcgggcctggaggtgctcttgcgggcggtgatcttctggctgcggcagacgcggcggcgcttggggcggcagacctctccctgggcgatcttgagctgatgcagctgcgcctccaccgcgtctaggtccttcttgagctgcaggttctcctgacgcagctcctggatcttcatgttgttctcgaccatcccacggcgcaccatctgatggaagtcgatacgagccgcgtcgtacgcctccaccatgcgcgccaggtgcatgatggtagcgtcatccttcgagctagcatcccggaaggtggcgtagtcgcgggctcctccgcggcgagggtggtagcggtagggcgagtgctgcaactcgtccgggtagcgctggtgaagagtgccgatggcgaggagagcggcgctctggcaagcggcggggaaggaatccccacccgcggtgactgccagcgaagtccgctcgggagagccagagaggatcactgcagtaacctcccaaccagcgtggggctctgcgtcatcaccctcctgctccggaagcggcctggcctggtagtccactccatgtggataccctaggaccacgcacatgccccgcagctccaagacgaaaccagtcatgtccaaaccacgacgggtgacgctgccggccttctacaaacaaaaacaaaaagaaaagcaacattttaaaggtcagattttggcgataaatgaagcagcaagacagagagagactagacagttttcacaaataacaaaaggatttttatttttgaaaatattgctaaggcttgggatctacggctcgtcctagggtcaagggggctctgataccaacttgtcacgaccggaaataacccaacgggcgttccttacgtgcgtgcattaatccttgtcccaggaggtaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcatgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcctagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatctgtcacatcctgattttcgtttcaggatttataaattatttaataaattattaatagaatttatattaaatgatctttaattttcaagtgaagtaaaatgtgggaaataaaattttctaaatctaaagcatggatggatttaatttttgttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccatataaaatttcattaaatactttgcttaattctataattcctagatttttctgggatttatttgagctaaggaagtatttttaataaatggaattgcatttaagaaataatttaattgaaaaaggttttaaaaaagtcttcttttggctttgggccgaaagccggcccaaaacccttctctctctttccctcggcccagccggcccagtccgccgagccgccgctcttctctctctcggtgtcgctgacaggtgggtcccacctgtcaggttcgtcttcctcgagccgccgctgccgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgacgtcggtcgccgtcgccaccatcgggttcgccaagtcgtcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcttaataaattcatttgaagtcagaatgaggccgttcaagtctcataattcatctaaaaatatgatctacatgtttgtttactttttatgtattgtttatttggtttttattagtctttttcttcgttttgcgtgttagcttgtcgtttccgtcgttgcgaaggttcacgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttctcgattactttattccttgataccttgggtgattataattggactagttgagctttatatatattggttcaactagatgttagatataattgcttagccatgcttagaaacattagcacactattgggataacttatgactcactattatttaatgatggcttaatgatagttcacgatggtcaatcgtgattgattaattaattacttgccaactaaaacttgataatggtgggttgtgagcacatggttttgagagtcgtgctcatggcaattaaggaccggttcgcgagctactattgtggaacattaaccgtgccaaccacaagccagcgtgggcaacggctttaccttttgtatagcatggttcattgcggggcaccagactgagaagtggcggagataagcccacgggggtcgctggggagtccatgccttgttttataagggggtgattatgatccaggaatggtgcactgtggtgagttgtgttatgcagagggtattgtcatagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcatcattgtaaaagatgcttaaactggtaataatttgattagctcctggtttggagttagatctgttcagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgcaagtgtgtaacgttattattatgatggatttgtatattaaattgtcagtttgtgtacctcggctgattcctggacgaggattttatgcacaaatgagttcggaaattactagtgaatttccgggcgtgacacaatcccacctacggccggaacccccgggacaggcaggtaggactgagcccctagcagcaggactccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcgggaatttaaatagagcgataatgcaataatttaaatcaacataattttacaaactgggattcaatatgttcaaagatgatgtgacttgccttgctcgctttcccaaacgttggcttcaacttccacgaagagcggatcttccgaagctgcagcgtctacacgaccaacggaaaagaaacggcttttactctactaaactccatataacaagcagaaacaaagcacaaaaatgggttcttgacttcttaaggagaaatcagagacttgaacggtccaattccgagttcaaatggtcaagttatggccatttgaaggttatatgctctttaaatgaatatttgcgaatttcttcatttaaattttaatttaaaatcggatttattgcgtcagccgaggggaggggcgcgcggaccgggtccacgggagtggggcccatgcggcagcctcacggtccacgatggaccgggtgcacgcggcttacgccggccggcgccgtgggtcccacgcgtcagccgcacacgagggcgcgggcggctgacggccgggccccacatggcagccgcggggcgcgcccgaaggcggcctcgccggcacagccgacgggaggcgacgcgcccgcgccccgatggtcgccggcggcgaccaccagcgcggcggagcggcgcccgagagaggggagggaagggggaagtgaaacggcggtccacggctcaccccgggtcgacggcgacgacggaaatggcgaccggagcggaggaaggcggcggcgcggctcgggtcgacgaggacggcggcgttccggtgatcggcgggcgaagccgaaggaggcgatgccgaagcgggaggaggtccggggcgacggcggcggcgaaccggagctcggcggcgacggcggagaaagagggcgacggcgcgagctcgattccgacggggagaaagagcggcgagtggcggaaacggaggagggaggcacggggaacgtttaaatagtgttgggagggggagagagcggccggatgagggggaatcggccgcggaagatccggccgccattgatgcgccggcgaagttcgcgggggagtttccaaacgaatccgagggagagagagagggaaaagtgggggggggaagagggagggaatcacggggagtgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcgggggaaggccgatgggccgcgggggagaggagagagagggagggagctgggccgagccggcccaagagggggaagggggggggggaaaaggacttttagggtttttctttttataaaaccattttaactttgtttatttcttcttaattattatttgtgctctgaaaattccactaaaatttatttacgcattttaggcttttaggaaatatacaaaaatcctccaagccttatttgacttttaaatttgcacattttaattgctggaggctttcacatggattttaattattctatgcataattttgaggatgtattttagagtcgatttgggacgcgacattcatggcggcacctccatccactagcatcctagaaaccggcttcccatcaacatggccatgttgatatccacgtcttcttttggagacgattcacctttatcaaccgattgttcctccttctcctctacaacaaccggtttttccttttctatggatttatgcctccacaccggtggtggtcgcaactctatgaaccttttatctccttgctcttcagcctttttctctcttagttcttgagcccgaagacgttgcaaccttctcttctgagtagccgtcaaatccttaggcatccacttaggaatcagctctgttccaggaggtaaataatgtcctctattggtcttgttcgaagacgatgaagccctcacatcgccctttgcaaacctcatatcaaaccggcgctggagcccggtcagaccgatcagatgcgccggtcagaccgacatgtggtccgcggtcagaccggccggaagcgtcggtcgaaccgccgtcgggtcggcagtcagaccggccgcatggctgcggtcagaccggccagaaggcctggtctgaccggccgactacgatgagttggtaccgacttcggattttttgtttgaggactccccaacttcatctccagaaggtattggcacgccatgagaccccactttgatagtgattacttccgaagtccttgcctccaccttgatgtgctttccttcccttttttcttcgttagcctgattcttaccataaaaccggccgttgtttggtgaagacaaacgcgcatgaattggcctcctcggtcctccccacccttggttgagttgtattggaggcatatgactgaacattggataagaaccacatgacatgtcttgtggatgatgatatggaggtgaatgcgaccgtcttggtgaatgaccaaatcgctccctaggaggtgatcttggtcttttacctttgttgcgaattttctcaccaccttgcttctcatatttctccaaaagcatatcaaaagtcaccttggtcttcctaggggctttagaagtcaaagctctactcttattctccttccaaacgccaacctccggcttctttggcactatcatctttggccttggttcgccaataaccaccccttttctcttactagattcagcttgctccggccgaatcaacaccttcttataattgaaattaattgtattcaccggaaaaggatcatgatcaagtccttcatctatggccgattgaacctgtcgtcgaaacacattgcaatcattagtataatgagaatgagaatcatgccatttacaataagctcgacgtttcaattcttcttgagatggtatgacatggcctttaggtaatctaatttgtttctcttgtaaaagataatcaaaaatcttatcacacttggccacatcaaaactatatttaacctcactttgccgatctttgcgaggagtcggcattaggttagagctaacaaaaggcttatttttgttagtccatgaccattcagcaacatatatatcatgatcaccttcctcctcactatcactagcctcagggtaatcaatcacattaacattaggctttttgttatattcaagctataacatcggtttctaacatccctaaatctcttaatataatcaatgacaggctcattatatttttgcttaaccgatgttaaatcacataacctaagctcagtttctccagtatagaaataatcatgaaatttttcttctaattgagcccaagtatgaatagaatttgcccgtaaagaccatgtaaaagtagtaccggagaaagataaagaaaacaagcgcaatttaaaagtatcactattagcctcaccacattatactaaaaattgaccaacatgctcccatgtggtcctaccatctttagcactaaacttggtaaattcgggaactctataattacgaggaaacgtcacattatcataatagtcaggatatggctttttgtaaaccctagcacgattcctagtttcaatcccgaatttatccctaataatctcactaaatatatcctccatattatcaggcctatgctgatttggcggtggatttggtggccaaataggttgtgtttgtggcgcaatatgattatattggccttgtctagtatcgggaggataccccctagcaacatcattataagcattaggaacatgcgggggaacttggggactatttgcagcagtagatacaggaggatcaaatgttctaagatgatacaaataactagcattagtcgttggatctatcccctgtaccggtataatcgcgccggtctgaccggcccagggcccagtctgatcggcatgcagaggagcagtcggaccggcttgagtcccggtcggaccgacggtgaagtcgcggtctgaccggccatcaggtctggtcggaccggccgtgtgcgccgctccatcggttccgctacccgtttggtctataggaggttggttagcagtggtagaggctttatcttttgacatgtaatcggccataagagggccgaatttaaatcttaaaaactcatcaaatttaccctcaaaagttgcatctaacttatctttaaaaacagtcatagatgaatctattgtagatgctacttgttgttggatagattgtgttacctcttcaatgcttaccaaatcgggagcgagcttaggacgtggcccgggcttgatgatcacgccttgacgagtcctagtgcatgccctcatcagcgcctcctgtgtgatctccttgaggtactcctccatagacttgcggtcttccccttcaaaatcatccaatgtgataggtatcacattagatggctccacctccgtcttggatggcggcttcgtcttggcgaagtcgaagttgagttgacgctaaacggatctcctccccagcggagtcgccaaaaatcgtgttagcaactttttgtgacaagttgacaacgacgatcgcagcaccttaagccttgcagtgatccttgagtcgccaaccacctcgatctagcaaagagctaaacctagatgggttttgataactaaaccggctagcggagccgatttctagataactacccgtctcgtgggcaaaacggaaggttttcaggacaaacctacaaagagatgtcgcactctcgcagtggcggcggacggtttacggcgcaaaccgacaaagatggacaaactaagagaaaactaaaagcaatatgaaaaacgattcgattgattgattgtagattagttttttacaatgaacatgccatgtcccttatataggggttggtcttgccctctataggccctcctccacgtccaactcggggtagaaactaaaggaaacctgaaacatgccttcccgagcaaggaaacctcgagacccgacgaaacacagtcagactcggacctgccggtcagaccggccacacaccgccggtctgaccggccctcaatcagcggtctgaccacccaacacacggcggtcagaccgacccactcggaggaaaccggtagacttccaaattctggcaatttttcctattttaatcctaggtgccaaatttgggtgtaaacagtgggctgtcgagttttcttttatgccatcgagtttgtcctagttcaacaatttgccactaacattctctccatatataatatatcaatgacttcatcaattgttctacaatacccaaatggttgggcctttattttcaaaaatacacaaaatacccttatggacatacaacattaacaattgatttatcttattagaactttcaaaaaaatatgattttttatttggcctccttacactacacggaagtttgtatataagtttcaagatttgcatttctacttttaaaaaatataactaattcgttatatgttatgtaaaatacttttttatattgttgattttaatgtagatcatctttcgtatgctacataagattttctttttgtattattatcttttgtgtaagcaatttctctcctacagtacacggaagtatttgttttgacaaataaaaatactaaaaaacttgaaacttatatagtagtgtaaggaagtcacataaaaaaaatcatttttctttaaacttgtattgagataaacctattgttgaccttatatgtcactaaggtactttgagtattttttttaaaaagccctactgaaatgacatattatagaacaattgacaaaatcattggtatattatagaaaaagacaatgtcagtagcaaattgttgaacggagataaattcaatgcatagagtagattatctcttaaaaatatataaagtgtttcttttatacaaaagacctccttgtgattatgttttttatcagataaataatatattagtaaagcatttttagtcaaagcctggtcataacatacaaaatacaccttataataaaaaaaatggagggagcagcaaagtaaaggatacatgtatacttatcaggcatcctgtgctctaataccacttaatgtgaatcggtgctcaatattccgataaattttatttgcaggcatgaagacattaatgtttggaggtttctgatcagcctatcgtcaccttgtaactgctgcacctgcatgactcattataatcgttcatgttctcacacaattaatctaaagaacaaggaagtgtgatgcctgaattacatataaatgtttaacacattaagttagtttcgacgaactgatctagcacaaactacaaagtagaagaataatctagaaaaacctaaaccctaaagacgatgacatgtacctaattatgagtgaggtgtggtgtaaagtcatgcataacatagactagatggccaaacaaaactccatctcaacgcccaaggccctatatttggaccggaagaggtatgcgacttgatatcatgcagccatgagttggatcggtagacttcataaacattccaagaaggcccccaagcaatctcttggatcggtagctaggtttgtttgaagttgatcccgtcaggtgggccaaatctaaatccaaaacatgcagaactttattttcttcccttttaagacgacaaaagtgacatggggaaatggcaggaggcttagggaaaacctaaagctggtcccaatcatctgtgcatttcttacccatgcttcccatttcttcaaccatgcatgcctgcgttcacacggttgctatattgtgtgaacaggcttgtaactgctatgcacatactcatactcatgtatacccattaaatgataatggtatagaagaggggattaaaacccataattccaatccttaaaattagtataatccatcatactagtcatccatctcatgttgcctgctggtaaatttctccgttttcaacatacatgatgtcttcatctcggtcatgatgttggctcaaacagattgtagactaccctcaatatcgtcaagtccatcagtaagacgaccctcacgatcctcaattctgtcgggcagcggacaaccgtttatccatgcgctcaatggagttcctgatgtccattttcgcatgtatgtctttcagccttttaatcacttggtctattgcaccctacatctgagcatgactaacacactcgttgaaattcttcgggctgctatctccgctttacttttttaacgaaaactacgaacagaaaacaaaaactcaagagattattcctatcagctgctagaacaaggattgcagtggagactagctaatggaagtgtcttattaaactcttacaagtgtcttaccaacaattctaaggatagtacaaccggtggacgtgataccttgagggtgcgatctagcgactgtaacggccgaagctatgctaatcagaagtatgtatgtggagtttgggagaacaaatttgtttttggtagaatacaattcagtaacacatagtaatgttgagtaaatatctcaaagtatgtgtatgcaatcactagttgagacacgttcccaagcctaatcagtgagaataaaaaacaaaccacttaggacagttctctcacaaagtctctcaaagcagctcgaggaaaaacaatattacacctcctttatcacctttttattcacttcttttatttattttcattttcttctcaaccacaggcatgaaagtagaagcacaatatgaagaagcaactcaagctgacgaaagatgcaactgtagaattttgggagcgtcctttaaaatttgtgctagaacttcgaagctcgataactcaatcttccatgccaaatttagtaaaatttttttggcaaaccagatgaagtgcagataatcctatatactttttctatagatgtgcgtagattaattttttacccaattccatgtccatatgtaaaagttatatctgttttaagataggtgacacaagttagtgtttggaggcatacccttgtttctctggctagggtaaaattgcaaataatcctcaagaatgcatataacctactgtttaactacaatattgctgtgggtggcaaaaggtagtaggatccttgtagtcgatagagagacgatagtgaagtggagcccatatgtggtggcaaggagttgctcttgtgggggtcggtcgactacgaatcacatgtacaatttagtaacacctagtctgtccacgggtggccaagtgcgaagccgccaattgatctcgtcattccgtaaatctgatgcctgaaaaatctgagccgctttaagttgatgttttttattgggttatgttttttaaggtttgttttgtaacaatgaagaaatcaagttaacagaaccgagaaaacaataaaaaccaaacacccatccctattgtgattgattaggtcattaggataagagagtacgtggagaagtcctcatattttaaagaaaaaaaaagtatgttttacaccctcaaactatttcattatccacttaaacctctattgtaatatttttgactgattttaccaactaaagtcttgtttgttctctttacatgacccgtattttctgctagaattttgtagatccattggtaatatcattattaatgttcaactttttttgcaaaaattttcatgtgtatctttttttaaagaaaaacaataggggaggtcccccactattaaataaacatttattaatgaaagaaataaaggaaaaataaaaaaagaaattacaacaactgatccatctcatgactacattttgtctctctcatttaacctaaaaagcaaaaggagaagatcacccttaaagagctgtatccaagaagacaaagaaggagacttattatcaaaaataaaatcatttatttgctttcaaatattccatgccccaaacaagaatttttcaataaaacaatggccttgatatcgatgtctagcatccactatcttgttctccagatgcaaagaaatgtcccaagaaatacctatagcattccagcaactcctcatgaaggggcaatgaaaaaaagaagtgaaacaaattttcaaagattggattgtgcatagcacacaattcaggtcacagtttggacggccaccatgcttattatccaacatatactttgtgtttaatctgtccatcagccaatgaaacattttaacttttgaagttgctttactctttcataacaataagaaatgctgtggtagctgtggcccgggctaggtggatgcgggcgaggcctcagctcgccttgtccggcggtggtgacgggcgtgaccggcgaatcggacggcggcggcatcgggcgtgactggcgaatcggacggcggcggcatcggccacgtggcatcgggcgggaccggtggaggactaggctaggtggatctggcgggtggctgtggcatcctcgagtgtgacgggctgaaacctaggccccacagatttgggagtggcagcggcggcacatgcgagcactggcttggagaatccgacggcggcgggcttgaccggcgaaggtgcctcttttcttcctcatcgccagtcggactcagctcccgctcctgcctctgaagtgcttctaggtcctgctcgatgatgttgccgcttcacgtcaacctcctggcgcttgttcatgccatcatcagctcagccattcactggcaccacgttgatcggtacatacgctccagatgaagggagaggaaggagattaaggaacaagatgaggatattttggtccagaaaatcttgtaagttcaccaaagaggtaagtagtggcttatctcaaatatatgtaagattgtaatggcatcacttcaaatagttgaatagtaatggtatttttcaaaatagataaaattgtagtggtatgatccaattaacccaaatataaacccatgtatcttagcccggtgacaagttcacctcttctaacagttaaggttgtaaaatgagtaaaagaaatagtttaggggttaagttaaccaacagaatagttttggggagtagtattgattttttttctagtttaaaacggatgaaatatctatgttagcaggaagtgcattttggcacgttcagagcatgagagcagtgctttaactctgacaatgattggaatttcctagacgtttcagtgtttcgtcgaagaacaagttccggccggatgatgattaccgagctaggcgcatgtttcttgggtgttttgcgggtgttccttttttttttttttgtaagtttctttcgggtgttttggtcactacggagattctgctgtacagtagtgatgtctgcagtagtcgtcaacacaacagttagctggatggcgtatgtaacttggacctatttgctttgtgtaattgtgtggtatggtttatcgccacgagacacgccgcccaagtatcgacagctcagacatttcgtatggccatatagctcagacatccacccaaaggtaccatcgatgtcatcctgctagcactgcaataatcatgcgaccatgtatacataccagtcgttccgatttcacgattcttaacgttgaataacgttggacttaaataattaaaattttactaacctaataaccataaaaatatttaacttgaagacacttaaacacgacgtcaagattagtctaaaaaatattttaataaacatagatatttacttattttgtacacatattataataaaaaattgatagtcaagcatatttcttgaaactatgttattgtctaaaacgccgagagctacagaactaggtagagttgaaatatctgtttcctttatttttgtggcaaaataataaagaaactgaatattcatttttatggctgttcaagagagccgcctttgaaaaatcaattttattttcacacaggcgtgctattgcgcgaattaatcagcgatttccacccaacccttagttggatgtggttcaaacaaacaccggtgtagataagttgtccaccgtctaaagggtatatatatattagtgtagcaattgtgttttcaccctcactttcatatacaattgtgatttttccctcttttttagggtttgtcaatttgttgttgttattttgaaatgaaactaccgtttacccctagttcagatggctgttaggtgggcatgaaactattgagttaaattaaagaaaaaatatttatgaaacaaaaaaatgaccattctaaccccatgtgtatcacctacccatgtccaactcatttccaaattcttattgttagcttattgttagcttattgattggttgcttgcacccatgcatgcatccatccaccatgtgccattggcatgccgacgaagccgccaactccaatgtccaatcttgtgtcgttcttctcttgtagttgacttcctttgttcgcatgaagcaaatgtttatgcaagttgtgttaaatacaaccgatcttttatcgtggtactcaaaaaacaaatacctcggttagatttagaaccggtactaaatttatttttagtactggttaaaaaagtctaagtcccaaaaacatctttagttcctgtttaggttaccatctatagtatcagttgggaac

SEQ ID NO: 74792 - DNA, 15604 bp, Oryza sativa
  unsure (1)..(15604): unsure at all n locations
attcctgcagcccggtccatgtgaaccaaggccaaagaacacacaaacaagactaatcctgctaatttaagtgttgattaggatgttacattaacatgtaagtgaggagagagccgcatagacatacattgttcagaaaaatgtttaataaggcctaagagtgcacggagaaaaataaaaaaaaagaaattatgcaagaggtagaactgacaataataaagcgaaaatcaagtttacaaatatagcatgtctcatgcctgtatacatcgtgtcctaaccaacttctaacttggtaagcttggccattttgtgttttttcatcttggttcgcacacatcaaacatgtacatacactaaaataagtgttttacaagtttgagtactaaattatacctacttgatatatgtactgcttgttaaatatgtgatccgaattttgggcccataatatattcggattagttatctaataggacactactttataggattagtttcctattagggctcctagatttctgctatatatatcccttgtaaaccgcacggggagggtgcgacagtccaatgtatcccctgtgtttgtatccaattcctctatagtgatcattgccggtcggcgcccgtggttttttcccgcaaggattttccacgtaaaaattcgtatctccgttgtgcatctattttcataacaagtggtatcagagcattggagattcgatctatagtcgcttcgttgttgggttcgtggccatccatcagatcgatctatatgatgtcctggtcactggcgtgattccacgatcgaagaaatcgatctcatctgatcggcggcagcaggcgcgtgtcgtcgcgtcgtctcgccgatttaaagcggggtcatctgtcgactccgagcagccggcgtccacctaccaatctaccggcgtcatacacacgtcgggactcaggagatcaatctaccagcgcacgcccacgtcgggagaaaagaaagtcaggaagcggaagccaccgttcctgccctgttcatgtgaattaaatttcacgttggatttttcctgcgtgcacatatccatcgtaccagggatttaagccttgcattgttttggttctgttcaggggaacacaaattcacgttccaaattgctatgttcacaaagccaagtctaccaggaggttttttacggagatcaaatacttcgttttatgcacctagagtgtttcgcatttctgttagggtttgacaaattgtaccagcagattcaggattttattcccaaggcgagttagaagtttgatctaccactcctggattgagatgcaatctcgttatggcaagtgaagatgcaagttggcgcatgtttcaaggaggataagtcatgcacctgagattaaaaaaaagtacattcaagtcgtcgagagggagcctcgctcctgtcaagatcacaaggtgatcaaattgtccggcgaattctgctaccattgtacccaacataccaggaggttatcaggggatctaagtactttgtttttgtgcacaagaatttttcgcgtttctgtttggattccagaaattaatgccagcagatttaggattttattcccatggcgagtttgaagtttgtacatcagtttcgcgtctctgctgggttccacaatgtcataccagcaaatttaggatttgttcccaatggcgagtttgaagtatggtctacctcttctggattaagggtgttatggattatagtccaagtgactatttggcgcacattgattttatcatcacgaggttctttggagattgaagatttttatgctacaagggaaattcgtctcaaggaggagattgttaaatatgtgatccgaatttcgggcccacaatatattcggattagttatctaatatgactctactttataggattagtttcctattaggactcctagatttctgctatatatatcccttgtaagccgcacggggagggtgcgatagcccaatgtatcccctgcgtttgtatccaattcctctatagtgatcattgccggtcggcgcccatggttttttcccgcaagggttttccacgtaaaaattcgtgtctccgttgtgcatatattttcataacactgctaatgcaatttactcttacaacaatttacatttcacaatatagaagcctgtgggggccgatcgtgcgctcctaatctcttaaatactctctccgtcccattttaagtgcaaccataagtttccgtatccaactttgattatctgtcttatttgattttttttataattagtatttttattgtgagatgataaaacatgaatagtacttacacgtgacttttgttttttactttttttaaaaactttttaaataaaacggacgatcaaagttgtgcatggaaaattatggctgcagttaaaatgggacggaggggctatcaaccatatttctatgaatgcttctgaattatttttatcattgttacaattagtcatgttccaattcggagatgcatgggccgtgaatgctgttaacgtgggcctaagaaaatagcccagcaggccgcagtttcttttatatattttcccagtttttttaagggaatatattttgccaggtcaataggttaaccaccaggacttaataaagctccttagggtgaatagctaatatgggccctgaagtttcgcttcgggcttagtttagtcattgaggttttaaatcgtccagacaagtcctccaaattaattatttgggttaatataatccttggacccataaaaagtgacacgtgcgtatgccaagtcatcctcgcatgcagcggtctacccttatataccatatagaaaagaaagaaaaaaaaagaaggtaaatatttcgcacgtgtatgatcgttttagaattgtcacttacgattgctgcagccaaccacggattgtataaattccttttgtcgttcaccctctgcaacaatgttgggcctaggctggcttgttattttttctgtttgtgtctttttttttaattatgatatataagggtagaatgatatttcatttataccgctgcatgtgaggatgatttggcatgctcacgtggcgttttttgggtccaaaggctatattaacccaaataattattttagaggacttgtttggacaatttgaaacatcgatgactaaattgagcccgaagcgaaactttaggaccatattggctattcactcagctccttaaatgttgttttcgtgaaaaccgaacaaaaacctccgacttggatcaattttcgcaaactaaaattcgaattcgaatttgaattttctcgttctgcttgttggctatcgacagaaaaccgaattcgagtttgaattttctcgttctgcttgttggctatcgatagaaaaccgatcggaataaacgattttcctaacggaaataaacggcaagattagtccaaactgaacggagaaggcaagtttaacatcggctccagcgttggttaattcgttaggttaatcttgtagagattcatcgataagtggtatgtggttttaaccctgaagtcttatgttcaatccccaacacacccataatttcttcttataaggttcaagcgcgtggtcttatactcgatcttattgcagttcaaaacataaatggggtcctgcagagctattaccaatacataaatgggcttacatattgcaatttgcagttcagtagtggccttacggcacagcccatcagaacatgttctttattttctcacgctttccattctgtcccggtaaacaagtcatttagattcatattttcttaatttgtttaggaatttatatgagttcttcgaaaaaataaaattcaaatttgaatttggatgaaatggaccgatttagtcctcagcaacatagcttttgtcccgcgtcggttagtcagttttttttgtcctgttttcgttcaaccctgtatactcagtagagtttaaattctgatatctataattacgcacacaattaaaaaaacatatacatatatataattacgcacacgtggatgtgctcttaatggggattttgtgaggtttatagatttacggttggcctgtcttgagcgtgtaaagggcacgccacaccatacatcgtgagtgtgtgcacatgtcttccctttacatgtcgttaccatgcttaattctagctagtttagaaatgaatcatcggggtcgttgctaacatttgtgcctatctagctaggctcctctaataaatgaaaccagaaaagaagtggttgtgtagatagtaggtttaatgaatggcacgttgggttcagtcaagtcatcgattgtcaagagaaactttattttaatactaataccatttttaatatattacagtagcttatagttatcatgttcctcttattcttgagaagtctcccttagattggatgggtggctatgtctactctatctatcaaacatatttttaagagctttatttatcatctgtaaaagattggatacataactatttaagtatagatgttaggatttaaacttaagtggatgtaaattcatgtacatgtaactcgagagattggatacataactatttaagtatagacgttaggatttaaacttcagtggatgtaaattcatgtacatgtaactcgaacatcaagatcaaaggtgatatttgccataattttactacggtcaactcatatatatgatctattatctcaaactaaacggattttcacaaaatcttaggaagctttctaacaaccatggaacaaggacaaaggacaacctctactagctaacacctaaccattcacaaaaacttagtcaaggggctttttctagtttttatcaagttctaaatctccggctaagcctcttagcggttgagctctccaacagctaagacattagctgttgtcgaaaatattaggaaaaagttcaaaaatttgacagaatttaggctaaaagttagcatatcgatcactcacttgatttgcacatcaagttcatcaccaattcataattcatacttcatacgtggagttcatagttcctaattcatacttaatttagaggctaagtacaactattagcggccgataaatcttagcatcaaaattgaagtatcctagttgttcccctctccatctttgccgctatagccagaggtttagaacattggtttttatgaaaccattgacaagcggtgaaattaatctgaccgaatttcgtaaaagaaaaaaaattaaaatccacttcaaacttaataaaaaaacccaacgctttatgcttttagccgtcctagaaaatatatttttcgcagaaaccggccagttttccttggtatgtaaagttgtaaacccagtcatggtcgaccatggtgcacgccgaagtcgagagctgttggctcttatggtggaaaatattgacccccgtacacatgatgaagcactaggagtgaaacaacgagtgttggcacatgtccatatgcatcttgcatgattgatcgcgccagtgaaaccactgttagggcatacggtgaaaatctagtaaagatgattctaatctacttcctccgtttcataatgcaaatcattctagcattgtctatattcatataaatgttaatgaatatatacatatgcatatgtctaaatttattaacatctatttgaatgtggacaatgctagaatgacttatattatgaaacgaagggagtagctagctataggctgtggttgcatgcgcgcatggatatgctatccagcttcccttttgtcttacacaatatgcatgcttgcgtgcgttaatatataataactagggatgatgatcgatgcggtcttcagctcacataagggaacacacaatattcttttttttgggtgaaatttaatttgcacttattcatttcaccattctcccgttagtgtgcatttttgggtgtgttccgtagccaggctgtggcagccacagctgtagccggctgcttgcttggcttgtgtgaaacagcgctgcagcagcgctgcagccaagtagcccaacagacccttttgttttgccatccctattaaggctgacatcgaatccactggttcataacttccccccatgacaacgagcacgaggtagttcattagtgcatcattaattaagtattagttaaaaacattgaaaattagattaataagatctttttactcaactttgctataagaaaatttttataacacacgtactacctcagtcctaaaattttatagaaaagttgctttaaaaattatattaatccatttctcaagtttattttggttaatacttaataaatcatgcactaaccgccgctctatgtgttgggagtgagggttccaacccactcccgaactcaatctaagccaatgattcttcatctgtttcatactccctctgtccaacgtaagttattttgagtttttgtttgcaacgtttgaccactcgtcttattcaaatttttttttgcaaatataaaaaatgaaaagttgtgcttaaattactgtagataataaagtaagtcacaaataaaataaataataatttcaaaaaattttaaataagacaagtggtcaaacgttgcaagcaaaaactcaaaatctcttatattatgggacggagggagtatgaaacagagggagtagttgacatttaacttctttttcttagtaacacattactaacacaagcaaccataacgcgcgcacactcacccctataaacgtacatacgcatgccttattctgatgagcacagttaactttatcttaatagaccattatgcccttgtgcatattccaacattaaacattcctttgaaaatttttaacgagtacaaaaaaaaaggataattaaattttgtctacctaaagtatattgattttaaaaacattaaattggtgaacatgttatttttcttatttttttcaaaaacaatgcaccatggaatcattcggttctcaaatgtttcattaaataatttatagtagggaattaactgcattgcatgtttaatatatatattttttacaatattagcaactacttaatatttatatgtgaaaactattttccatattttattttaaagtttcacataaaaacctttaaaactaactgaaaattttcttacaatatatacattttcatacaacctttaaaactaacaacattaaaactatatctccttattttttgtttgaaatttgttatgacttttagtttcataagggaataataggcctttgggggcaaatctaatggtcaactaacattgatcaatgataatggtaaaagagaagtgagtgctaacagaatagtggtaaaagagagagaaatacaaaacttttaaggcggaaaagagaacacggtttggacggctagcaaaaagaaaaaataaatacattcctttcaatgtgtatttttcagagctatgacaataaaaatagtgtaaaaacttattagtggtagccattacttttccaaagttttgaggtcaaatagctagataatgatatatagttatatatataatgtagtaccatcttctgtacgtagttttctttccatatggtctagatccatagaaagagagaaccattggtagccattatataggcatatggttcatttgcttctaaacatggagctatattttctcaactctatatgtgcatctgtgcatgtttgcaacaacctaacatgacatcagtgacttttatacatgccctaattatgtgtgtgtgttcatagatcagtgcatatgttgcgtgcaacatcgatcgctttgtgtcaattattcatcagtccaatcatgtgggcgtccatggacgacaagcaacacgcgccgtaattaagacagaaattaagcatgaccggacagctactagtcttcaattgcactatattaacattgagatcagaagtagggagtacaatatatagctttctctgtctttaacagaatttcactatattataattggaattgaagttttgaaaaaactaatcttttcattgttagcttgatcatgtacttacatctagaacgatatattttttttttgacttgaaagagttatgaaggattgtctcgagagcagtctacacgaactccatgttaactagctagagatgggaaccggatcctctgatgttaggaaaccaacgtcagaaggcagtagtttcttcatccttcatccaccgtccctggagcatccaacgcctctcttgcttttgcttcattgtagggtgccacaatctctgttctctggcgcgtgaaggggattgattcatcgaggcggcgagcgaggaagcgccaagcaaacgaatcctgagacaaatcaacctgtattgactcaaacctcacaaatcaacctggaactttattcgatcgacccaagaaactcaagatcaacgaatacataagctatctgcgctactccaaccttgacaacaataaatcataaatggcattaagctagtgcagagcagaaaaaaaatcataataatgtgtgagctcgacggcattaattaattagttcctcgccggcgagtggtacgggctcggcgttccgtacgacggcgtcagcatcggcgttgggtgcggcggctggccagggtgcggcttgggcgccggcttggtcgacgacgcggctggcagatgggcttgcagatggtcgccgacgcgcacaccggcgacgtgcagtgggtcttgccggcgacggcaacgaaggttctctccgacagctgcatgatcctcgacggctcctgaccggggcatgccgcgttatgtttcgccgcgctgtggagctgagccacgctgtcggcgccgcggaggtcggcggcgagcggcacgctgaatgcgccggcgccgtcgagcttcccggccgcttcatctcgtactcgccgtcagcgctgttcttgcacttgatcgccacacggagacctgcacacaaatatatacttcctccgtcccataataagggattttgagtttttgtttgtaaattttgaccactcgttttatttaaattttttttgtaaatataaaaatcaaaaagttgtgcttaaaatactatagataataaagtaagtcacaaataaaataaataataattttaaaaaattttgaataagacgagtggtcaaacgttgcaagtaaaaacttaaaatcccttatattataggacggagggagtacacttgacttaacaatggcaaatcgtacaagatcgggctgttgtcgtcctcgtaggctgcgttaatccggtttggatgtgaaggacgaaaatttgactcggcgacagtgaccgcttccttgatagccgtctcaatgaatcgatcaccttcgcgcgcgagagaacagaggttgcggcaccccacaatgaagcaaaagcaagagaggcgttggatgctttagggatggtggatgaagaaactactgccctctgacgttggtttccttacatcagaggatccggttccctagagatgatacaagagaaaaaaaaaagtttcccttagcccatgcattattgcatattcctatacttgcctctgaaaaataacatacttttatgacttgaaagagttacaaaggattgtctctcaagcagtctacacgactccgtattaactagagatgatatagcgggggaaaaaagtttcccttacccatgcattatgtattcctacatagactctttcgtctttaatttgtttttgagccggttacactggtccttttcatatccaaggagacgatcataatgtacgtaacaaaaaatattacgagagaaataattgatataagagataaggtataccgttcatttggcttttctttctcatgcataatgtacatcctatatatagcactagcagaataaacacggatggtcatagacatcgtcgaacgctctaccacacaatctcaaacatatatatttttagagaaactatacataatactaacttccactgatcgcaaaaaaaaaaaaaaaagagtggtggtggtgtctcctgtttgcctccactggcttaaatccataaaaaaaaaggagctttagttttgcctcattctgttctccccaatattcacaggcagatagcccaaatcttcaaaccccgggaccccacagaaatggatggttccatcttgctagcaatgatgcatgcacacggctagcttgttcgtatatattgtcttcatgtgccattcacatatactacttgcctcttgtatactccatccatatcccaaaataaattagcttctatagatgaatctggatataggttatgtacttcagattcatatccaagaattgatttttttatgggacatatgggagtatatgtattcatgttcttatctcaaaatttaagagctagctgagggggcctaaattaagggggaaatagaaaaacaagtggacttgtaataggactttttgttggagaaggtggatactgcatgcttacattaggatttgttgcatcttagaatatattattgtgtatattgtatctttaaaacatactccttccgtttcaggttataagatgttttgactttagtgaaagtcaaaccatttcaagtttgactaagtttaccaaattagttttattaaattaataattaaatatatttttataataaatttatctttggtcaaaatattactatttttttctataaacttggtcaaataaacatcttataacagaaaacagagggagtatgagtgttgcactttctgaggattgctacataaaagaaatttcataggattttagaagagatatatgatgcatgtttgtttctctctcgcagtagagcccaacaaattgaaagcaaatccaatggctctaatttgtaggggagtttgtggttaggcaaatgtctagctcagtaccctccaaattatttggatcaatgattgttaacaccagtggatctacacatctaatccctctagctaccatagtaccatgataattaacaatgttttctaaagcaccccctgttaactaattaattaatctgtactccacaacatagggtagggtatatttttcaacaaattcgatccacggctgggaccacgcatcggaatccgtgcccggaagatgcacggcatggatcatatgtgctgctctatctcaacctctcttctccagtacaaaaaggcacaggaccccactgactaatcaacaagattagcagttaaataaaccttgggttgcatgtaaaataagctattaatttgcatgggttagtatgcatatacgtgtgcacatgatagaaaagaatggtgctattgctataggcagatcagaagaaccagagacaagtaaattaagacgttggttttattgcaagttgggagatttggcaaatcctccttgggattcttcgtgagtcgtcaaacttttcggtttcgttttcttcgaactatgtatatatagcttttgagatttcgttttatgtggcccggccctccaaaatccaaattggcactgaaaaatctcggcttttcgttgtgccgtctgctagagtttatagttaggtaaagctccaacatctcccagactatgattagcacttgtgttattgggttaatggtacccacattttcactttcttatcaagccaagtaccattgagatttaattagacctcgttcggaacacgatgacaggaacgattaattgttataacttgtgtagaatatacgtataaattcagtacagatttaaacagatataagttcagctgaacctcgctaagaaatatatatcatgaatctctctttgtcgtcaccaagtttgggtcttatccagtgattttccgtggttggataccgaacactggtttttacaacattaatcctagtagggaattttcatgcattacaaatgtggccttaccctagacttgcatattattgtacctagcatggactctattattgtgttcacctttctatcatacttgtttgttaataacatagtcttgattttctctttacaataaggttttgtggaatactccacacttgagatatttatttgctcgctattcatactcttagctaaaatgttaaacaaaatatggtaagcgaacatatctctactactttaaaagtgtaatcgtctgccttccgttcccttctcaccatgcaccagaggttgtgcgtccctttatgtgtacgtaatcaatatagaattcaatacttttccctcaatccacccacctagcctatccctaattatataggttagtctatgttttattctcaatccatccacccagccaatccctaattatatgagatgacccattggaaagcacagaatcttactagtttgaattaaatgtcatggttacccaaagaatctcaagtgatctatgaatgaaaagattgtagcaaattccaaagaaaaacctaggtcaaaaaaatccttcgaatggaaattgttgcttttacgcatcgcaaaactgaattttgaatatattataacagtcagtctcattactggagttgcatgcctgcaatcaatcgaggattttgttccttgcacacatattgatatactgactcttcagagagtgataacacaaaatggatctgcaggctagctgctgagccattgatcaaccaattttgtcttttcctggatcaatgcaaaaaaaatattcagtgacaggcatacaacctgaagaaccaattaagtgagagttgatctgattaattaactgatcagacgggtcgacgggacggccgtttacatccctagaggctctaacacaccttcatcatgcatgcatatgtgctattttgtatagttatgtgtgctataagtatataatattaatctatgtagcaacatctctagatcaggtcctagctatgatatgatcttccaggtatatattggaattggagtgagagagcccaaacatgcactgttgtacagaaccaaaatacaattgcaagtagctacatcatctataattcattcatccatatatctgaaactgcaaggaggctgctggctagcttcctcctctatttatacacacacccctctcacaggcctccacttgcatctctctctctctctctcccaattatatttgtagagagagggaagaaaagaagagaggggaggagcaatggcagggtctgaggagaagaaggagatgcaagaccccaggacacaggccatagcatccaccattagagttgtgcccaacttccctaagccaggttctctctcctctcttgcttgttgttttttagcttaattattcttgcatcctctcttgctttactgtgatttcgagcttagttcttgcatgtctcgctagttaattcatgtggttttctagctctgtcttcttgttttgaaaccgaacgatgttatttcttttgagtataaatatttttcagaagtattatgtatcaactggttggcttcttctttctgatcctttttttcagcatatatgtgctcataatctcatatatacatgtgcaataggggctgcaattctgtaaagaatattgaccttgggggttgcctttaatttcaagtgccaaaatctgtgtttccttgcaaaggtccccactggtactattgatccttgcctcgttggttctttccttcctttttttgtttattggttctgaacccaaaaactttcatgaatatagcttgtttcttgtgtgactttatcatgagctttttgcagcttgtaacctataaccaaatttctcacattactacaatttataggcatgcacatgcatggtttgagcatgcacatttaccacaaaatattgttgctgcgaactgatcttcctttatttttaaaattatttttcctgctatattatgtcatgaagacatatttaatcttcctattgaggtgaaactctcactctattcaaaaggctaattatgtggatatttcgataagcgcatccatcgtgatgatgaaggtggtgtgagcaaaatgttgtgtattcgagacattatgattttccctttagaagtcttttcccactctatatatatatatatatatatatatatatatatatatatatatatatatatatatatatatatatatatatatatatatatatatatggaggggtatcaanagagatcgcgcgcgcgtgcgcgcgcgctctctctctgcatttttctcaacacacatctcatcttcccttgcccgcccaaatttaatttatagaattcccacaaatactttggaagagttttgtggcaattatttttttctagaaaaaaaatcgattgactagatctgcgaattaaatcaatgacacatccctgcagaagaaaaggtctatgcaatacctttttttttcaggttctttcataatatttgtttttcttgatgaaatgtgcaggaataatgttccaagatatcacgaccctacttctaaatccccctgtgttcaaggacaccatcgacttgttcgttgaacggtacactggcaaaggcatctccgttgttgctggtaacatataattgttttgttttttatctcaaaaaattgaaaaaatcaagatttatttgaacttgtgcgctttgtttattcaagtactccatccgtcccttaattaatataagggattttgatattttgcttgcactgttttgatcactcgtcttattaaaaaaaattgtgcaaatataaaaacgaaaagttatgtttaaagtactttgagtaataaagtaagtcacaaataaaataaataatagttttaatttttttaataagacgaatgttcaaacagtacaagtaaaatgtcaaaatctcttatattaagggacggagggagtagtaactaatctgatctttatctcaaaaaaatatcagatcttatcaaatccattgaaatatataatttatttttttaatactaagtcagagttattatttatgaagatccaaatatagttaattaaaagcgtgactttgacaggcacacgatgggtcgattgaaaatctagccaagttgtacagtacaatatcttttacttgtcgttttttatactgacccggcctccaataatacatactcctaaccgttaattacctacttattactgtagaaaatcggtaaagttcagtagtatcgaagtaatttcatggaaaaatctaatgacatgattttcatttgtcgattccaaaaaaaatgctaagtcaatttaatttataagattaacgaaaataattctaaaatgacaaataaattagagagagagagagagtgtgtgtaagatcagagcgagagagattattcgtatgaggagtgtcacagtcaaatgtacagagaaatgaagaataatgcagcagtagtaattgactacaaaacaggaggtttggcctctctgtctgacccttttgtaaagttcgaaggcttccagatgatatgacaaaaatatttgcctttccctccacttgtttgtgcctgttggacaaatattttgag

SEQ ID NO: 74793 - DNA, 4911 bp, Oryza sativa
tcgatcgttctcgttcacgttgtcgcggcaacgtacgttgacgtgttcgttctcgctctcgttcgttcgatcgttctcgttctcgttcgttaacggcggtgtggcggcatcggggcggcggttggcacggcggcgtggcgacggcggcggcggcgtggcgttgtggggccgtggcggcggcggcgtggcgtggcggcggtggcgtggcgtggcgtggcggcggcggtgtggcgtggcggcggcggcattgcgcgcgcggcggcgaaggcggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcgtcgtcggcgcggggatttgccctaggcagtggcggcgaaggagagaggccgagagagatcgatcggccgaaaacgtttaagtgttggtgaagaagacgagggcgcaccgggaatatatataccccttgatctttactcccggttgttctcaacaaccgggagtaaatatcttatcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattttaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaagatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctatgcaaaatttgatgacctcctctgttccataacccttggcgatgcttgcctctggacgagcacggttacgaacatacttcttcagaacgcccatgtacctctcaaaatgaaacatgttgtgtaggtacataggcccgagaatacggatctctttcacaaggtgacaaagcagatgcatcattatattgaaaaaggaaggtggaaatatcaactcaaaactgacgagacattgcaccacttcattctgaagggtttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccttatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaatgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctaggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccccacacaaataattattcttacaataatgac

SEQ ID NO: 74794 - DNA, 39023 bp, Oryza sativa
tgacgccgttgacttttttaaacatgtttgactgttcgtcttattcaaaaactcttgtgaaatacgtaaactatatataaacataaaagtatatttaacaataaatcaaacgataggaaaagaattaataattacttaaactttttgaataaggtgaacggtcaaacatggttaaaaaagtcaacggcgtcaaacatttagggacggaggaagtagttaccacgaggaggagggagaggatgatctggaggctgatctgcggcgtgccggggctgagcccgcccgcggcggtggcggcctggaacgcccccgtgagcgccgcgccggcgagcgacgtggcggagcagagcgtgaacggcgccgggaagtgcaccatggtggccgcctgcagcacggtggtgccggacaccaccagcaccgcgcccaggaggcacgcgcacccgacggcccagtcccccccgccggcgttcgccgccgccgccgtcgtcgtcctgtggctgctgctacgcgtggcggcggcggcggcggggctctgcaggacgctcatggtgacggcgccggcgaggcacagcaccgtcccggcgatcttggccctcgtgtaccggcagctgaggtcgaccctctcgaagccgaggcacgcggcgacgacgaagatgaagaccggggcgaggttgggcatggtggaggcgatggccggcgacgtcttcttcatgccgtgcagcatcagcgcctggaacaccgtcaccctgcagccaacgacaaggatcgatataaatctgtcatcagacatgttttgcacaaaatgtgataataatcgtttgacgggaaaactattttaatctctcaaggggatatccctttatttttttcacgtcacttaaatggttgtgataaaaaaaggtgtattaatacgcgatataatactccacaaacatacaagttcaaattcaatttatacatctcgtaatgaaaaaaaacaaattaaaccacaactagttaacgtatatttagagtcaaatttgtttttttcgttgcgagacgtagaagtttaaatttttttcttgtatatttatgaagcgatatatcacatgttaatacattttcttagtttttgtcataatatttaagtgacatgtaaacgatgtaaacaatgagaggatatattaaaatccacttcccgattgacatgttatacatgcataccctccgagggcgagcaagaagaggcggagaagaaggtggttggcgttgaggtgcgacggccatctcttcctctcgaggttgatggcgaaagggagggtgaagaggcccgtggcgaggctgccgaaggtgacgaggaagagcgggtcgaggccgagcgccagcaccggcgcgagcaccaccatgtacgccgcgcccgcgagctgcaccgccaccagccccgcggagatcgccacgtcctcccactcccagctgcaccaccccgccgccggcggcagcacgggcagcagcagcggcaccgccgcgtcgtcctcgccgccgccaccgccggtggccgctggcgccattggacgacgcgcgcggcaggcaagggcgaagagggcgcgcgcgcggcgcacggcaccaccacacgcccacgccacgcgccccggccgtggaacggaaacccagcggtttcctctttggcgcgcgcgcgcgcgtgcttgtgtaggtgcgcgctttcgtccgctcgctcagcccaccacgttgctccgcaccgcacgtcccgcgcgcatgcgcagtatcgctcgccgctatttttgggcatcctccccgtctagccctcttttttcttcatcatgtatatatgggatacagttgataaacagttataaagagcctgtttggcacagctctacagctcagtcaaaaaatttcagctctacctagagtagagctgaatgtacggccccgtttggtagggctccaaactccaactcccagctctaaacttctactctagttggagctagctcctattggagttgcagacccatcaaaagtgtttggcaaatttttagctccagatctgaaaaaaattgaaaaaaaagaaaaaaaaaggaatcctcgccgccagccggccagcccccgcgccgctgccaagcccgcacgccgccgccagcccccgctccgccgctgagaacgtgcgtcgccgaccagcccgcgcgccactgccgaccccgtgcgccgccgccagcccacgctccgccgccagcccgcgcgccgccgaccagcccgcgcgccgctgagcccgaccgccgctggttgccgccggcgccggcgccgccagcccgcccgccgccggattttgccggagaagatgggaggagagagaatgggaggaggagtttagggtagttcaatggcatttttgtgtaaatacataaaaaattaaagggtagtgggtcttttggggtgaagtggagctgtggagcagaaaaacctagctccatccccgtagtacaaaattgtggagctgctctgcaaactccactccagaaaacagagaatttgtaccgtttggcacaactctagctctaggtaagttggagttgggagctggagctgtgccaaatggggtcgtactctctcataaattaactagagagttggagttctttggcacccgagctctatggtcgctgatgcgttggccaacaaccattgaatccgcgatctccatggctccttgggagtccaggcaatcctgcaatacttgcagatttggtcgtcgttgtgaacaacaactctctaagagggtcatcctgattctttcatctagaggtgggagagttcggggtcgtactccacccggtcggcttaccttgacctcttctcgggcaggatctcgtttcggcacctgccaatctagcgatcttttgccccgccccgatgtcgctacttcatgtggctggtcgctcaccgacgctgctggacggctgaccgactagagaagcatggactgccgcacccaacctattgtgccttctgcgaccaactggaagagacaatcgaccacattctgattgtgtgcccggagtccctccagctatggtggactatcctttcgagcctcggtctcccttagtgtttcccctctggcactaattccttccatgagtggcactgctcttgccggctcaaagttccgagggagcgtcgtagtgggttcgatacaattgtgactcttggcgcttggtccatttgaaaggaaaggaacaatcgtgtgttcaacaaccgttcccggtcctggcctgaggttgtcacagccatggcgcaagaggccgccctgtggcatcttgcccatcccatgttgctagtgctccctagttagcgtgtttggtcgttcggtcgtcacattgtaatagcgagagtaggcttaagtgcttgttttcctttttctcttttttctcactctctcccttctttgtttgccgtttgtataaattttattcctcttaatacaaaaagtacgcaatccttttgcgtattcccgaaaaaactagagagttggagttgggtttaggctgctccataactcctccactccagacctaactcttggaactaaaattaggagttggagctctaccaaacaggaccaaaagataagcaattataatagcgaatttgttatctgtattatgaatgacttagaatgagggatactgaaaattagaaaaaaaatccaaaacaatttaaaatgaagtttcaaaattctaaaatcaattctaattttggttgcttttggtaagccaacaaaccaaattaatttcagaaaatcatatatgataaaagttgcacaaaatcgaatatagggcttgttcagttcttatccactttctacaataccaatttactttctacaataccaaaattggcacattttcgtatcgccaaatttcagtagcgttggttgtgtttagtttaatgtcttagactttttaatagtgggaacttctagaattattaaagtttggtagtatagcatcaataataatgtgtttagtttgttgttttactaaaatttggtattgttgaacaacaaagtgaacatgcccataatacgacttgtggcataggttaaaaccaccacgacataataatgacttgtggcaacatcaaatattgcggtgtcaaaggtttaaaaaaaaccccgggtattatcatctggtcaaacttttgtaagacctgaattttcagatcaacgactagcacatgcagaagcagacttccctatgaaaactgcgcctgaaatgaagtactgtcatatagcctaacctagtcatacaattcataacaatataggattagaggttgcctaaaaactaatcaacagcagcctagctaatgtcacagaatgacagcacggaaaaacagggccacatgttccaagcaaaaaacaacatcgcagtcgatagcacaacaggttacaggtgagcccaacggatgcttcgtttcagtggatgcacagctttcttgccgagtggagcagacagacatgctctgataccttctctcttgtgcctacttgggtttatctgtaaggctgacgagggatttcacgatgccggggctgattctgtctgcaagggcacctttctctgatatcacaaacgatttctccttcacaaagctctgtagcttcttggtgtcatagtctagtcgttcttgatctgcatcattatgaaaatgaagacaatgagttaatttgacaaaagaacaagttatgctcctagatgacacaaccgcaagtgaataatttttttttaatccttgctgcactttaaaatggacaatagaggccttcctcaacagtattgaaaatagatcaagagtgtacctttgtctagaacagtgtgggccacatgaaatggaacacgagcaaagatatctgatcctggaaacattaaccatgtatcttccttggggtcatgatctccacatgttgggcatatctcctttaccagctgcttgccagaggttccttccaaccctttcattatgatttcaaagggggtcggaacactagttttggttgtcttggctcttttccggagggctgtcagtgcttccctattaccattccttatcctatcgttttccactaactggttatcacagaaaaacataaagttatcagtatcaatacctatctaacatattaacaagaaaaaggcaagtcggcaactcataaatacctgatgccttgccagaagaagctgctctgcatcagtttcaatgtcaaccagtgcttcttgaagttgcttcattttaggatccattatataactacaaaacaatgccatttaatttgaaactgtaagtgaatcatgtaacaagaattcatgaatcttcctaccataaagaaatgtacagtgatggcaggggcaggcccaggtttttcaacttgggtattcgaaattattagagatagaaaaaattttccaacccaaaatctaatagttgtataatatgtaacggtataaacatgatttcataaagtcatagatggatagaattgaccataaattgaatgcgttaagcatattagagtatagtactaaactattaaatgacaaaacatatcaaatttatagagcatacaaaatggcaaaatgataagaaatcttataatttaaagaactttccgtttcttaatattttgaaaatgattgacttggaccagttggttcttgagttctcttttttacagcagctttttctaaaaaaaatttagattaaccatgggaccatttttttctcttcatgtttcaaacatacaaacaacaatatcaaagagcaattgagcaaagcagcactggtttctaaatcctaatctatatagttattcacaagctaaaataaccaatatacttcagtctgaaattctgaatcagagaagggaacttgtaaaaaccaatgatgcactagaatctctatggcttatcatcaaagaacaagcataagacaatcaaattcctgaaattactttcaactagattactagaaatctagaatatctgtggctcatcatttagctcatcaagaacaagcataagacaatcaaattcctgaaattactttcaactagattactagaaatctagaatatatgtggcttatcatttagctcatcaagaacaagctacaagcaatatcctcagttagtcaattcgacagttcctcttcctcaccgctgctgcagttctgcgctggccggtgaccggggaccgccggtcgccggaccggggaggcgccgaggcggcgacgcggcgtcacgacagcgtcagcgggcgcgacgcgcgagtgcgcgcggcggccggggggccgtgccgccacgggcgacggggcgcagggcgagtgggcgaccggcgaggcgggcaggcggctgggctggcacggcgacggcgcctcggcctaggcgcccggcggctggcggctgggggaggtgagaactcaactgagaagagatagggttagaaatgcatttgggctttgttctgctattgggccaataggcctgaaatggtgggtggtgggagggttagtaatcctttcagtttgggcttcttttgagttttgaatgtgtatatgcattttttttcttttttcctatatatacatatttttttagataatggaatataatatcccggcctttgctcaaaaataactatagccaattattacaaagatccacttcagaagagagtgtagttcaagacaagttgaacacaccaaacaagagaagagaggacccaaacagagaaaagcaaaacaaaatgtggagctagaaggcctcgtccaggcctaagactgaagttcgaagccaatgcatagaccaatgacaatatccttgtacgaagaggtttctccaaagcggtgccccaaggaggatgcgacgtggatcgccgccaccgctcgttcggaaccgaagcaaggttttcacccggagaatatggtagggaaaggaaatgggtatgctaaaacaacgcctccaaggaggggaacgacgccaaacagcgtcgtcgttgtcagccggccaaatggctcagcaaggctttcgcccacgattccctgtccaaacccacaccaccaatccgcacaagaaagatcgttgtcggtcaacaacattgtcccttcagcgattcggcaaaggccacagcccacaattgttcccaccatcgatggcgcgcccgcacccggactcctccttccccgccgccagaccccttccccgcctccacataccgccgccgacgacgatgcaccgtcagccggatgatggcctttaaccatcgccgccataggtaccatcgtcgacagccgccaccgccactgccacagccaccaccgtcgccagccgccaccgtcagccaccatcgccaccgccacggacacccctgtccagccgccaccgtcagccgccaccgtcgctagccagcgccgccagacgccagccgtccagatccgaccggggtggtgcggatcggaggtgcagcgcgaagcgcgggtcgccggcatcatggaggaaggcatcacgggcacggtgttcacagccggagcattgacgagggcgccgcgccttcctcgtggtggcgaggttcttgacgagggccggcgtcgcggcacacgccgcagtccgccgccgttgtcggcaacttcgtcgttgccacatccgccaccatcgccgccgctagccaccctcctgccaggttcgcggagcggtgccggcgtcgaccgagcccatcgccggtcaccccggccaagcggggagaccagatctggcgacgcagtcgcccgtcgctggagccgcggagagccaacaccgagcgccccaccgccgcgcccaacgccgcgccgtccccgtcaccacgacctcgccgtcccgccgccatcgtcgccacgcccgcgccggggcgaggtggagccgaggaggatggccccgccgccgccatcccagcgcgtcgcccggctttgccggcgacgagctccggcggcggcgaagcacagaggagggaggaggaggggcggcggcggaggctagggttctaccccctaggggcggcggaggctctttcttattggatctctttcatacccttaccattaggtttccttcaggtggctggttggtttgcttcaaaatatccattactagcaaatatgcccgtgcgttgcaacgggtgaatatcaaataaatatggattgtcaatattgcttgcatacttatttaaatgcaataaaagcagatgcatcacgtccaataggaaattgctctgttttttttttaaatctgggtgcatatatgagtaacgtcgagcgagactcttagtatccatactaaatattgggtgcatatacgagtcttgcttgtgttttctgtttttctaatataggttaagaagatgtttgtatcctacttccatgtaattcttattcttggactttgtaattcctgtgttgtaattcctaagctatgtaattgtatctaactcggtttacgcttcaatcaatccttcaacgtgcgcacccaaataactgatcgggaacggtggtggaaaaaaccgggctcaccaaaaaaaaaccgtgaaaagaaatcgccacccacgaaaaaaacggtcggataaaaaaccagtccataaaaaaaaacacttccaagagaaaaccgcgtgcggaaaaaaaaccatcgggtctcgcacatacggacgaaacggagtgtacaaaatctcaaattggtccatacgtagcaaatcttcaaattttataccgctttacatattaggaaacggatgtcattataaaaaagcaaattattgcacaacaatttcatatatattaaaatgatggttcaaagtgattaaaaattagttatgtaaacattaaatgatttttagcgaaaaaaataaaggcaaaatgaataaggcccgaaagctagcgacggtccaaaactgcgtgcgtcggcccgataatgcacgaggctcggccagtgcggcccgttaggcaaggaggcccttcatcgcgtgcggcccgtatcgtgtgcgagcagccgagtagaccccaggcaagcgcgagcggccgaaatgtcggttagcagctaagcaggccgcgtgcgagtacgtgcagcccagatacactcgcaggcccattatccagtgtcgttgttgcttgcggtggtgtgaggagttttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgtcgcctccgttcgctctcgggcgacggccgtcaacgaaatttgcaggcggcccccttgccgccctccgctagggcgattttgtactgtgcggggggccgcctgcaaatgggcagcggggggcctggaattttgcaggcggcccccttgccgccctaggggagggcgattttatactgtgctttatatttttttataaatatcaatagttatcaaatctttttatgttgaaaactatacaagattaaaatctccaagactggtaaaatacaattttattattttttagggcctatttggaatgttacggtacaaatattttgttagtgccaaaatataagcaagttttggcactaacaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcgaattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtttaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggtcgctcacgccacgtgggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttttatcatgagggaagacttgagtatgcatccatccccacaatagcacaaaggacggtcacaccatggtggaaaccaaccagcaaaaggatcgcttcgccagttgagacgatcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactatatgtcaacaggcagcgccgaaagttgatagtgacaactcgagctgcctcttttcatgtatgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatgtaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctaaactgtaccgtgcgaaaccggtgctgtaggtcgcactgctccgaagctaggggcgctcgaaggcaaacgaggtcctgcgaggatggaacatcaagttacgacggggtgatgttttcgcacaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacacatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggtgtctggagtgaaggtcacacgcgcacgagtgcgaagaaggtaccagcgaaggtagtcacggtagttctcctccgtgtgtgggaagagctcgttgatcacctcctctgtagctaatacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctatgtacggctcccagatgacgtcgctcggctgtagatggtcaaactcgaacacgaagtccgggtaacctcgtctcacctggacgtgagcgtaacgacgctgcaataaacatgatcagaattagacatgttatgtgaagaaaaaaaagaagacgactgataaacttataacgcagcgaagttgcactaaccccacgtcgacaccagtaagtccccatcgtgggaccgtcctctggccactgcgcgctgtgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtggccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccccctcaacaagcctacaaagtggtagaaggcctgccgcacgcaaccagtatagagcaaacttcaaacataagtacaacacaaagcaaagttgagttgaaatgtgaacatacgcgtaccaaggaacgtgacgggggtcgacacgcaaccactcgcgcgacgtgcgtggatggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagtgaattactaacacatattaaacaagagtacaaacaaacaaaagtgtcaccatacggaatatttctaattacaacaataactgcagttacacgatatgagtacttagtccgaacactcatcacgataacattatgatacaacaccgaatagttcgcaataccactagtataacaatagtcggaggtactcattacaacaacattcaattgaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaacataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgctaaacactatgttgttatcggccatggacggaccaattttcttgtatcgatccctaaagtacgcttgcgtgccgtgaaggatgaattcaataatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttattcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccaaggtacatgatcaccctctgatataacaagttcagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaatatcccctgcattgataggaccctctacatcttcggtttgcattgaaacatttatatctttctcttgtaccgacacaaatataacgaggggccatgaccgttcaaaagccatttccacatatcgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgataaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgtttttttggatttttagtgaatataatgaaatttcagagaggggggactgggctttatagggggaggcaaaaatcgccctcccccagggcagcaagggggccgcctgcaaaatttcatgccccctggccgcccatttgcaggcgaccccccgcacagtacaaaatcgtcctagcggagggcggcaagggggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatggaaaattatttttgtaaaacttttaataaaaaaattaaaaataaaaaaaagtcgtggtgtgagtcggcacgattgacggcgtcggtaggatattgatcggacaactgagatttcatgagcttaggacaaaacaccccattcctgaaaaacctaaccataagccatttctaccctttcccccgatttctccagcgtgaggagggaggtgatggtggcggcgatttggtagagcggcggcgactgtgtgctcttgcgcagcgggcttaggccacgcatggctccgacggaggtcaagctggcggtgtgccacgaattgatatcatgtctacctagtcgggtgcccatgtgcactaaggctgtgtttgaggagaagtagattgggaagatacgtaaaacgaggtgagcaattagtgcgtgattaattaagtattaactattttaaatttaaaaaatagattaatatgattttttaaagcaactttcatatataaaatttttgtaaaaaatacaccgtttagtagtttggaaagtgtgcgcgcagaatacgatgtgcaatctcacccaatcacctaagaacgaatactaagtgccagcgacgccaaggtgatggtggcggcggtgatggcacagggtgggctgaggtcagctatccgctcccccacctaggttcacctccgcaactgaggcgagcctcagtctcgcacgaccaactcaggcaggcacgggactggtctgggttgcatagtaaggtaggtacacggtagagctgaaaaaataaataattacacagatcgcgataaattttcaagacgaattttttaagtctaattgctctatggtttgacaatgtggtcctatagtaaacatttgctaatgatggattaattaagcttaataaatccgtctcgcgttttactaatagattctgtaattagttttttttattaggcctccaatatttcatacgacaccctgcataatatctgatgtgacgaaccaaactttacacctctcaatctaaacaacaccccctaagttagaagtattttaatgtccatagtgcaaacactgtgagcatcgactgtaataatttgttagagataaaaaatggacgctagatgaaaattcaatttagctaattaaaaaaactgattattcatctattttgcgttaagaacggtatatacggctgatattttggaaaattttacggaaaggctaaaaaactgtcgacacatttttctctagaaatatgtcgatttctgatccattagatcaactgtaggattcgtgctattttagttgacgaaaataaaattgtactgcaaagaatcgaacctaggatctccagtggcttgtccagcggccctgaccaactgatcgagcaaagattttggcttgaattgaaattacacactaattatacttaaattgcatatcatttacatatataatttagagacttacattgtaaatacactaaaattacatatgtaatttagagacttacatatgtaattgtagcacttacattgtaaatatactaaaattacatatgtaatttatgaacttacaatgtaaatacataccgactattttttttatgaaaaatatgacgccataaatataactacacccaaattttatgtgggtctcacggccacgtgtgatgcgaaccagcgaaccaaaattgtcttcgcttttctgccgaacgtgtcaagccgagagagccgcgccttgattcctccgccccgcccttatcctttccctctcctcctccgccactcgtttctctcatcctttctctcctccgcgcgctcctctcagctggcgaggagctccgatgagcaatggcgccggtgatttattcattttcttggatgattttgattcattgttgttagatttgtgactttgtgattcaatggatttgtgattttgtgatttatttggatcggatttgatctcgttcaagggggcatgggcatacgggacgggatgagcgacgcacaggtgaaaaggacacgcggtgacggaaaaaaagtgtgacggacgaaaaaacacatggtgtaaagatgtgacgaccggaaaaatgctaatatttatattagttagttatagatatagatatagatatatctatttttttaaaaaaaatcttgggtattcatttgaatacccatgaattacagtgggtccgcccctgagtgatggtccacaaatctttatatgtggtgctatatcctatccaccttttaggacgaggcaacaataggataccacaacatatttacaaaaagctgtgcagaaacttacttgcaaaaaaaaagggccgtagaaataaagaacactgaaccatacaaatacaagcaataacatagctgcaataaagaaacaggagggaatggggatttggtggtgtagaaggcgcaatccagatgcactcagagatggatctaaaaatctaacggtcccaggatgaagatcctgatctcctagaccaattttcaatatttgtgatatattttctaaaagaggatcaattgtattttgtcttagcaaggaaaatataataagataatttacttaaggagtaccatgtgtaaatcataatagaatagagcaagaagcatctagatcagagaaaaaattgaactagttcatgcatagcttggacatcagcatttactgtgcagaaaattcctgaatggatacagtagttcggcaatggccaatggggtacatccatggttctgtcttatggtgtcttcgtttattcaaaagcatatcatggtatgtgatgtcttatcatctactccctccgtcctacaaaatcatgaatcctggagggggaggtttgtaaaaaaaaaaaaaaacgatctgtgcacagaaaaaaagattgtgggccatagtagatgggaaaggagcctgccacctctctctctcctatcgttttgaccgcagaaaccttatctcctcggcttttctcgtctcgttctctcctccctaaatcgcatcgctctctcttcccccaaatcacgcccagatgcgacctcctgcctccacgccttcctccccgcaaatccctcccttctccatgccgctccccctcactccctccctgccttcctccccgcacatccctcctgctcaacgtggcggcggctggcgggggaggcgacgagcggacgccggtgttcttgcgtacatgcggcctcgggggtagcggtgacgagcggacaaggcatcggcggcgacaagcggacgcggcctcgtcggcggcggcgatcggcgaacacggcggcggcggcgacgagcggacacggcctcgtcggggttcttgctagttcattcgtcggggttcttgctagttcttgtagtatctggttcttgctagttcttgtagtatctctttttctctgttcctggctctgttcttaattgacagatgcgaggctccaccagtccacctccccgcgcctccctccgttgtgttggaggctttgctacgcggcggcggcggtggagccttgcatgcgtgtggtatactggtatgtggccgatgcttgctttgcatgctgatggacgtggcttgttcgaatgcagctgttatggtggaaggggattgacgatgggaaggacaaccacaaggaaatttatgcttgtctttttttttaccgttaattaatggttgtactttgtaatttggtgagggcatactagtcttttaccactgctgctaaagtcacctcgggtttataggaatcgtgattttatgggacggagggagtataagactacatcatcctagcaaatagcatactgctagctgataagatttgtatgttaagccaaaaaatgctgctacaagcatgacgtcactacggaacacatctctccccaccaaaaatttgtggaaaaccctaagcacagctgtttgcagttctcactataagcttgaatcagctctatctaaatatatcaaagttcacaccgatgcaaaccgatcaacaaatgaaacgatttccacaatgaattaaactacagtgcacttttttttttttacaggaatgaccaaaggaggccatccaaatgacattaagattgaggggaaaaagttacaagacagcaaattatgcatactaagtgcccagctaatagaataaacaataacaaaatagaacgattaaacctctacaaaaacaaacaacgagatttaccaactctaatagcacaaatgaactgattggttccagtaagggctaagagtagtttcagtcaatctaaatgtaaacaatcacataatcacaaagtcacaacatacgtagaaacaggataaaatcagatgcagagttgcgcttggcaacttatcatatctctaatttttttttgggagggggggggggggggaatcacaactctcgtctaacaatccagccctctctctcagcaaccacagcaacttaggccccctttgattaaaggaaattcataggaattttagaggattttatttttataggaatttttcctatatagctctttgaatcaaaggaatggatcttatggaatcctatgaaattcctatgaatgcctaatgccatgcaagttttggaggaatatcatgaggtagaacctcatagaaactttccttcgagtctttatctctcctctaattcatgtatttttcctgtggtctaatcaaacggtcattcctgtgttttgtaatcctctgttttatacttatattcctatcaaaatcctacgattttcctattcgtacgttttctcaatcctgcgattaaaggggcccttattgaggattgcttttgaatttctgttcagaagggagcaaacttagcgaagggagggccgccggtaaggggcgggtgactggggatgcgcccgccgccggcgagagaggagggtttcctcggcggccgctttgctggggctggacgccggagcttggaggcggcggctgttggtaaggcaacgcaaggcaaaggcaagcagagagagagagagagaggatgggccagatattattgggcttccaaaagaggcctgaggtgggcccacgtgacagtctcacagcccactcccctcaactccgctcttcccaaatgggcccaggcccaagcctgggtataaaagcagagctctcgccatcttctggcgcaagcctcactctcctcctccccgcttcggattccaccgtcgcggagctcggcgcgggcggagatggagggcgacgccgccggagccggtggcggcgaccggtcgagcatcgtgatcggcctcatcgagaaccgagccaaggaggtgacgcctctcactgactaaccccccccccccccgccctcccatccctccccctacacccccgcacgcatttttgcttgtcggattgctcgcctagctagcttcctcctcttctcctccaaggcccccgagggtttccgtttcgcgttctactcggtcttcgctgcgccgcggatcggcttcgatcgtgtcgtcggcctgcgtgcgtgttgtgttcgcgctcccgcgggggtggtggtcgatcggatgctgctcgggtggattacttgctctagctggtcagattggtggtggtggtgggggggggggttcgtgttatatggcgttctgagcggcttgatttgagggtttggtggttttaggatttgaggctccagctccatttccggggcgattagagcataccctgtcctcgatagtgctgctctagcggttcgaatcgagttggtgtgatgtgtacagtaaattgttggagaggtgggcacaattactgcagtgacctgctgttgcaattttttcctccactgatttggccggcactttcttacaagttgggaatccggataaccaacggtcaaaggataaagccatttccataacagcaccatgcgccatgcgggaaagcatttttatctacgatatattagttgttctccaggcttgttttgaaggagttgcaagtttcattgtaaacaggaaaattcattggatcatggtgcattggcgcagaagagagaaatttgatcaaagtgttgtagtagatcaactcataaacttattatggatgaattttttttagataatgtattatggatgaacagattgtgaaaatgatttctccattgtacacacttgttttgtggtttactaatgaacaagatcttctgagacgctgacctctctgtacatctttatttttcttgttctaagtcaagtgtatctttagttttggaagcatctcaacatttttgccaacgtaagaattctttgtagtgtcagttttggaaaaaaaaaatcgtgatatgaacacgtgtagattgtctgtgcacgtcagttgataacttgatatgcacaccatccaattcaactcaaattgaaaacatacaaacaaaaatcatggagttaattatttctcaatttctttattatgaaccaaaagatcacgaagatttatcaaactagtatttttgcaggttggtgttgctgcttttgatttgagatcagcctcactgcatctttctcagtatattgagaccagttgctcatatcacaatacgaagacacttctgcatttctatgatcctatggttgcaatagtgcccccaaacaaaacagcagcagacggtatggttggagtttcagagctggttggtaaacatttgccaacaaataaaaaggtgatggctgacatatgcaaatttgttctatgttttctcataatatgaacccactttcgtttattctaaacagagttcaccttttagataacaatggcacgtggctgctttgatgacacaaaggtataatgatttgtattcctttctgaccatttatttgcttaattgttgggtgattaactgctgcttaacatcatgcatgttcttgttttcttttaagggtgctgttatggtaaaaaatctttcagctagagacccatctgcactcggtttagatacttattgcaagcaatactatctttgtcttgctgctgcctctgcaacaattaagtggtacgcgtgctatctttgtctcgatacattgctgggctacattttccctgtttaggattaagttaataacttctgttatgtatctcccatgaacatagttgtgtattgcttcaatatggacataacgacttgacaaagctgtgtcataatttctattttttcaaagtgtaattggagcatatgaacttactatgtactacaacagtgcaactctcaaagcaagtacttactaaattattttacaatttgtctgttacttctcatgtcatttcataggagttatgcctaagcacctcatttgatgatactacttactatttatacaatgccccagaatatttgttgttacttagtacattgaaatggaaactgagataggattttcaagttggatacttggattctataaagcttatcttggatcatcaaaacatatttctcatattgttttttttggtcatagataactatttttttcctcgtattggacggaaatgaggataaaaccgaaatatagcagatgattagatctcatgttgatagtgttgataagtatcacaatgacaatttactttgtttcttcttgcaggattgaatcagaaagaggtgtaattatcactaatcactcattatcagtaagttttttagagttttgtttcatataaatcatcgttgtttagcctttttttcacctgtaaggccattcttacgatattatgtatcaaaagtctccattttgtgactactcttctatgggctatgctgatctgaaaaaaatctatacattatggggtcccatacattatctctaaaaacgttttctctaaaaatgttagctgatgtttccgtatttttctcttatatatgtatgtataacttttcaggttacattcaatgggtcatttgaccacatgaacattgactcaactaggtactcttttggttaaattgagcagtattatctgtcacttgataaatcatcttcaccaaaggagcagaaacaatataagttaaaattttctgctacacgatctgaattgccttcattgttccatatatgcacctagcagtgtacaaacattggaaattattgaccctcttcatactgaactgtggggaactagcaacaaaaagaaaagtctctttcagatgttgaagactacaaagactacaggagggtatggctttcccattctccaaactaatcttttttacatatatttacactgcaacattcaatatctcctcatttttgcaatttgaacaatcttttctgagataaaaagtttcatgtcaacttctattgatggtacaaaatagtttaactttatgtagtctatgtattgaaatatcaagcacactgcaacaattctcttcaaacttgcttgttcaggactagactactgagagccaacttgttgcaaccgttaaaagacattcaaacaatcaatactcgtctggattgcttggtaaggagattaatcttttttgttattctcaattcttaaattggaatgtctgtttgatcaaattggtcatacggtaatcctgacatttgaaacttccaaagttgcacatattaagttctggatcttctagtaggctaggttctggatcttctgtgggaatgaactaacttcatggagtatgaaccctgctttatgcatgtggaaatcttagtgcatatagtcttaaatcgttactcgaagggtttaccacaatcatgtttgtaccatttatagttcatttcctgttggagcactttgcaatataatggagaattttactgcaaccatgattgtacaccacaggccatatgtgaaagtatttccatgagaaggggaagcaatagttcttgtaatattgatatgcaacgctcctttgcaagaatgaaagtcaactggaatctgggatataacaagtattcagttactaatattatcatcgaaaatgatcagtaatatatccaataaatgcatgtttattaattttatatcttaaattttaggatgagctaatgagtaatgaggaattattctttggcttgacacaaggtcttcgtaagtttccaaaagaatcaggtgaacttatgtcctttttctctgtagaaaattctatatcctcttctggctgtgcaacactacagataataggtaaaatggttgctggtgttacaacttccataattttattatgcctcagataaagttctttgccacttctgcttcaaacccaaaaaggatactgatgaagtgctaaagcctgccaatggtagaaagagccaagggctgatttctgacattattgttctaaaaacagctctggatgccataccattcctctccaaggtagtgttatagatgtgtttgtcctagtattcaatttagcaatttattcattctgatttttcattttgttttgtttttgaagatgcatgttattttgttcatttaagggtaaatgtcttttattctagaaacatacccatctaccttttcacgcatgtgatgtgtagctcatcacaggttctaaggggtgcaaaaagtttccttcttcgcaacatttatcagactatatgtgaaaacccaaagtatgcaagcatgagaaagaggtactgttttctgacctttttcctcccatttcaaaggagaagttgaatgaagactgaaaacagcatgctaacttcaggcttagtcttcccatcctgcttttgtttgtacatttgtttttagtttttagtaatattgccagtatattagcattatgtgactgtaaatatgttcgtccacatttattaaataacaagtatatccatctacattctaaaagtaaccattcacctttgatttggttgcatgttttcttttatgatcctagaattggggatgtcattgatgaagatgttgttcattcaagggctccttttgtaacctgcactcaacaatgttttgctattaaggctggaattgatggactgcttgatgttgctcgtagatctttctgtgataccagcgaaggtgtctatcgttttcatgtttgttttctaattttacctaacacagctgattgacataatgcatttttcagccatacataaccttgccaacaagtacagggaggattttaagcttccaaatttgaagataccatataacaacagactaggattttattttattgtaccccagaaggacattactgaaaggctccctaataaatttatccaggtatgtggatatatcccttttaagaaccagccctcttagctaaaccataagatgctaaccaaatatttgtgaatgtgtaatcaattaggtagttagacatgggaagaatgtccactgctcaagcttggagcttgcttcggtaagtttgcatccagtgaattatcatccttgggcatttttagtaattcaacacttactgccacactgcaaatttaaccatgtaattattttctctgggatgctattttcaagtggaataagtgttagtcaatagttattcatttatgttcttttgttttccctcaaagaaagtttatcatcttgtttaagcatcacggagcaaactattcttttgccaaaagcattgggacagtgttatatttttcttctttataagtgtatggtataatttcatcatagctacacgtgaaataagcttttattttatcgattaggatatgacattgaaaaaatataatatgctattggagagtttatttcttcatacggtcacttattaccatgtgctttctacccaaatttgcagctaaatgccaggaataagtctgctgctgctgagtgcttcttgcgcacggaactttgtttggaaggttgccatggccactaaacattgagtattcaacatttttccattggagttttgttactttatttgttgatattgatataggttaagctctggtccagttatcagatacctgttattataattttctagtgataaactagagagttaacatgcaatacatgcatgcataatgtatctgttgcattgggatatcaaattctatatttgttgggcatcctccatataggtagcagctattgtagaacagaacatcatcattcttcttaacttagaatagggatctcctcattttgctttgtttatgaactttttagccatccatttctttgctttcctggcttattttggctgaattggtgggactttgagggtatcatacacttgactaattcaactcacgaacttaaagggaattgaagcttgtggatagtgtaacttgtttctgtgcagcattttacatttcaactagtattattcaagtgtctaaagaaatatttaacttgcataaatctgttctgttgtttcagggcttattaatgagatcagagaagacattggtatattaacgttgcttgccgaagtattatgcctgttggacatgcttgtaaattcttttgcgtttacaatatctactaagcccgttgatcgttacacgagacctgaattcactggtgggcaattcaattcaacactagtaactgatcttgttaaggattttttttagtgatgttgtggagtcctgatctgacagttgcttccaattaagcagatgatggtccgatggcaattaatgctggaaggcatcctattcttgagagcttgcataatgattttgttgtaagttcttcatttgttatttattcctcagtatttacttcatttgtatgtctttttcatcataaatttgttgattgaaatagcaatgatcataatactgtttatatcatgcagcctaacaatctctttctgtctgaagcatctaatatggttcttgtcatggggccaaacatgtgcgttccataaacattgtatccaaatgtctatagcaggctaattatatatggaaattcatctgctctctgcattatctgctgttgcaggagtgggaagagcacatatcttcaacagatttgtctaatagtcattcttgcacaaattggctgttatgttccagctcaatttgcatcactaagagtggttgatcgcgtattcacacggattggcactggggacaatgttgaaaataactcaagcacagtatgcaaattcatctcttctatatggtttatacttatgttatcttgttatttgacttacagaattcttctaaaagcacgtgaaacaataaaatgattagataaagcattcaactgttactgttgatagtcctcaagtaatatttatcccctgagtaccattctttaggcttgtttcctcccagattaattcctatttattatcttaaatctcctgatgcacattatctctattgtgctcaaacctatcaaatttaagatgttttcttgtccatatgaagtataaatggtcatttgcattgtcctgttccagtagttggtgtttttggattccttggtggatttccttaatatagcattagatatggagggtcttaactcctaagatcggtacctgtttgtcatatttatggatgactctacatgaagaagcgcgttgaagtagtggattaaccatcttatctaggatcgcgagagcccatactataccatttcttggtaatatctggatggctgatctggacttttgaattgtttgtatactgtcatttataaccttccttcaagttgtattggccttggacacttgacaaagcaattcacatataatatttcttcgatcaaatcaaatatttcatcaatagttggtcgagcttttcctttgtgagaggcatcttgtagatatttgctttcttaatgaaatgaagcacagttctcctgcgtttttgagaaggaaataaaaacatcaatgctgtatcttttatggagtattagtaattagtctgaagccaattgatgtatagtttatttcaatgctgctaatcagcttaatttctctttgcagttcatgacagaaatgaaagagacagctttcattatgcagaatgtttcttcgaagtactatgggtctaccatgctgcaatagattggattgctgtttctcttgtttccttgtaatgaccatgtgcacatttgcacacttacaggagcctgattgttgtggatgagcttggaagagctacgtcttcctctgatgggttggcaattgcatggagctgctgtgaatatctattatctaccaaagcgtaagaactattaacctcttaagtaccacatttgatccttttcatgcagcataatttgacttatcacagtcctaacttggtggggtctgtatgaaataacttatgtgccttttaattgagtgcttctgaaaaagagatgatgatttgtgtacgttgtcatacttaaattcttagcagacaatgaaatagataagggcagaagagataaactaccatttttctacatgcatgcttactatttttgaacaagaagaggaagctaatatgcattgtaagactggagggagtatcaatattcacagcagatgttttcttgtcaatagttttgaaactgcatgcttttctaaatgtgttgtctaggcttctgttattcagttacctcatccaacatttttgtagcctatttattcaaccatatccatatgttctcatcttgaatcaaatatttgatcgtgataatggttagtacaagaacatttactacttgtcttgtgctcaccttaggccgtgctaccatcaagtttcagatatcatatttatcacagaacctactacttccgtcccaaaatatagcaacttttggctatgtatcttgacacgcttttgtccagatacatagctagaagttgttatattttgggttagatattagcagtaagttcagcatagtgcctgggggtgcttgacatgctgaatgcagctggtcatgtttggttaatcttgccaaccacaatatggtctattagttacagatataaccttttaagacaagatatcatccttgttgagcaaatcctactatcttagaagcatcactgtcgggtcttttcacccaatgcagctacacggtgtttgccacgcacatggagagcttgtcagaacttgcaaccatctatccaaacgtgaagatcctccattttgaagtcgacctgagaaacgaccgcctcgatttcaaggtataacctgaatcgttgacagtcacatgacttttttttttcatgtctcttaacatcatggatcatacaatccctctgcatcagttccggttgaaggatggtgtccggaaagtaccacactatggtcttttgctggcaaaggtggctggtctcccttcttcagtgatcgacactgcagcaagcatcacttcacggatcacagaacaggtaaacctctcagtactgattagagctgatgttgataacacagtgtgtgtgactgcttagattacattatgcaactcaaattgtatgcccattttcttctacttgggtccttttcttttttgactgcacagccttgctcgttcctgctgctggatttgatttcttctactcgagcgcattgatcaagtcaagtttacctgttttgatcccggcctgcaggaaatggtgaggaaggacgacaactgcgagcagtaccggtcgctccagatggcgtaccaggtcacgcaacggctcatctgcttgaagcaatccaaccaaggcgatgactacatccgggaagcgttgcagaatctcaaggacggctatgctgcaggccgcttgacatgagaagaaaaatatatgtaaaaaggagtttttgtttctctctcctacagctggcagcatgtatggattatggtcgtatggatgtagccatgtagggcaccccctcccccccactagcctcgtacaaaccatgaacggggtcgggtagttcctagaaacgggttgcaaggctagcatatattttttggttgccatactttttcacgccacattttagtcatgctacagtttcttagttacgtgtttggtttgctgccacaattgtatcataccttctaaactttgagatccacatatcatgctctcaaatttagagctaagcatgtcacacttgtggccaactatttctaagttacacttgtaccaccatgccacaactagtctaaacttagttatggcaaagttaggcatcaaccagacatccccttatagctgcatcaacgaatagaggtttgggaggcaagaggtagaggggctccggataactcaaaatgcgattatatcaaatgggcattttcagccttcaccaaaacacgcttttcatatcaagcgtgagaagggagatgaaaggaagcacgcaacgctcgtatatgtactctacgattgactatatcttatgcacataaggttttcatgcatagcaactatttcccctgtttcacaatgtaagtcattctagcatttcccacatccatattgatattaatatatatatatatatatatatatatatatatatatattcattaacatcaatatggatatgaaaaatgctagaatgatttacattgtgaaacggaggaagtagcaaatatcataaaaaatatctaaaaaaaattatattacatcgatgtgttaaattttcttttccaattcattactccctccgtccaataatataagggattttagagggatgtgacactttctatcttgttcagattcatatcactaggaagtatcacatccctctaaaatcgcttatattatgagacagagggagtatattttagctgtaacaaaatataatcaatttttctcttaacacccttagattttggtgtagtcagcagttactacagaataagataataaattgcctatataagccactgatctatgctttctgttgccgtttagtgaacagttgttctgctgcacacaccattaacccgactccagtagagaacgcgaccagtttgatccatgttcagtgaagtcctccagccgcttggcataattatcttctgtcgtcaacccatgcaatgtacaattatatttacggcatcgtatatgttttctttctgaaaatgcggttatcaggcgaatgctaaaaacactcgcaaaaccctgaatgttgttagactcatgcaagtttgtcgcggctcttcaatgatctgattatactcgtcaagaactgcttttcaccacggtatctgttgaatgagaaacgaatgccaaggtgattattatattatagcatataaaaagagcgagacattttttttttatgaaatggtgttcttacatctcgagtgatgagaaacccaggcacattatgcctatcgccatgtgaatgggaagggtctgcttgaacctgtttctattcagaaacatcctttcagagaaagctgtggtcaggccagaaatgagcaacacaccccagcctgccggcaagcagtggcggaaagagaatgagccctgtaaaataaagtcatcaggtatttttgttagaacagaaactaaaacaaactatgtgaaacatcaaccgaacctcttaccttgaaatagtctttaatgaatgccgctgaatatgtgattcgcagcagcatatctttacaaacagtcaaggcacaaagaaagttcttaaaagatactttaaaggaaataagatggtagtgattaaccaaaggatactgatggaatttgcagcaatcaacccaactgcaccagcagatttaatcaggacaacatttagcacaatgtaaattgccgagaacaggagcaacatatcatttgactgcttaagcttgtcttcatttgcaacagcatgaaggaaagcttcagatgtgcctgaaagtacacattaacataatcagtgcaactcaatattgcatcctcatgaggaatcaattgaatgtgttactcatgcccaattacatggttgtataaaggctaatatgtgcaatttttaaatatagaacacatcatcaagtatagctaactattgatcaacacaagaagcaatgctacttgttggtacactaactcaattcaaaaaggtcaactacagttcatcatttcagattttttttaatacataatttaagcatgaagacagtaatactgtacaaaaacattgctctactatgatataactggtaaatagaagtagtaagtacaaaccattcattgctaagcatatgacgtagaaacaatagtaacgaagaataactgtagcatctccatcactgtatcttgccccataaagtagtctaagaagggtatatgaataacttggaccaaatgagatgacccccaagcctgcaaagttaggacactttaaggatgactgtattcgaatgagaacgtagagaataaagttggtagctactaaacatgtttactgtacactacatgtactgcaattgcttgcttcttactccctaagaggacacagtaaataacacacgcaaatgcaatcaatatagcattcaacattggataacaaacctatcagcataataagcttaagagctccgagcaaagaaccttccaaattggatatattctggggattttgtcctgtggataaaaggcccattattagagcttttacagaaatatacatctaaacatatgcgtggaacatattgttttgaaataaacaatattgctatgaattctggtgttggtcaaatcaacatttcaaggaaaagttatcgtatcttaaagctgcaatatgaaacaacaataataccaaaagatatattttcaggcagtaagaaatatggaaaatgatcaagtctaaattgtaaggatcaaataatcaagaaacataccaaagttacaatttctgaaaggagtataaaaaaataaactcttttttttaaaaaaaaaaaaaaggatgaactgccatgtttggtgcaatgcctgcccagccaacataggttaattttcattgaataaccaatcaaagagatgttagacaaaacttcacagagaaactttcaagttcagacaccaaagggataaggaatgtgattctcatatctaaatgaagtaaatgcagaagaacctgatgccaactgtgcaaatgtagcataagaactctcctcgaatggcaggaaaactattctaacaaccagactccctgcaaataaacaaaacatgaattgcacatacccggcaacattagaagataaaaaggatctgaaacaaacagcggtcggcatacttacctaatttatccacaagaccataggcagcctggttatatggagtatcaaaccaaacaagaacaaacttttcgccttcttggagcatcagtttcctgaaagtctgtcctgtaaacaacatgcacatgtgcaacaactgtttatcgcagtccatcatggctgacaacctgacaatttgtttgttttaacatcaagtggaaacaaacataaacatgtgatggatcaaacaaaacctaatgatacaacacaatgcaaaggcagacatagaaggaacctgaatggaaggagatcggaaattttggtatttgtaaatataagaaaataggtccaatatccaaagaaaatgcaagctgcatagacaacctgtgacaaagcaaatacaaccaacttttcctgcaagaaataaattattgtttttgtgttgtgttgatcaacaattgaataagaaaagaatgacatgagatgaacaccaattaattgaaaagtaaagaaagaaaagattacttggacatatcactcagcagaattcatatttttgttttgtaaagtcctattattgtcaaagacgaacttaacatggaatttacaatggaggcataaccaaccaaaaaaacataaggtgatctgcttaaagttgaaaataactagattaagtaacactataagtctaaaatacatatagcttaattgttcgatttggcaattagaatggtcagtctaagactttgtttggctagattagatggttagccagattatacacttatatttggaaaaatagaactctaaagaggtttagttgttctatgttatcatattcactttttttgtgggttaacttaatcctaattaataaagttaaaatgtcacaacctgattaagttaatcctctctaacccacatcctgttaaccctgaacaaatgtagctaagagagaaatctcacaccaagttattttctttggtgcatggaccaaaagaacacaatatgaaattggcaatggaactttttgatttgctagctttcacaatgtaaccataaccaaatagatggctataccagtatcaggtgtaaacaacaaaaacaatgtgaacttaagcattttattttatcagtgataacaaactgagacagaaagtgcataataagttgaatagaacgtcaatagagtaaaaacctctgctgttaccattttagaatgtccttttgttatgaagataaaagttgttaaacaacgcagcagagtagccacaggttcagtatacactcttatttgatagtatttcttcctctgggagagaatatacagaggttctgccagtagctccagtacgcaagcaaatgctgtcatattgaatcaactaaatacattagctctcaacgtgaggaaagtggacagaagtcacacaatatgaaaaaaataaggcaaaacatgtggagtgatatcatacaaacaggaaagacaaagccattcatagccgtgcttttatagatcatatccaaatagaaaaacaaatagataaatgtctaaaaggaccatcttgaaatgctacaaataactgtatgcttgcatgaatgctcatctccattttattgatcaagagccaggtgttcaacaattgcatggaagatataatatttcagcaccactaacgagttaatatgtggaatattctaacttaatcaactgattcattcattccaaagagcttatcctcaatcaactgactcattcactctgacgaatttatactaaatgaaatatcagtcaccatattcaggacaaatacacaaagcttgtacagaaacttggttaatacaaagcttaccgataattaatgtagctttagcataggtatcggataaccgcaatttctttaccctcaacacaaataagctgctgataaaggaaactaagatgccaaatgggacaatcatccaagctacctttagtatctcttcatcacttatcgcattgccactgtaatataaatattttaaccatcatcatttaaagagtatattccaatgcaattgctagaaagacctttacaatcccagagcatgtttcaacatgttcaagtggttgaaaattgagaaaaaaaattaatagtgcatacaaactactaatagaaagcaattatttgctcaccgtttgaacagtatgctgagatgacacgttaggacttgtaagaaatgaatgaaattgtgtaattctaccacaagtacagttctaaggtttatctagaatatgtatatgaaaatagattttcacaagtatgcaaaataagaatgtgattttggttgattataaagaaataattaagttttagcacactagggctcaaattcacaagtgcacagcccgcatgcaagataagcctgcggacagagagcaactcacatgggatttcgtcctcatttcactcaaacaggttagctcacagttgttgcattaaaaccctcagcag

SEQ ID NO: 74795 - DNA, 15620 bp, Oryza sativa
atcattagcatatatatgaatatgggcaatgctagaaagtcttacattatgaaacggagagagtagatgatttgtaatggcatttctctaattcgacataactgtaatggtatattgccgccgccggcaggcaactctgtccctacaacatcggatcggaagcgtaatcagtgggcgactcaaaatttgaacgccatcgctgagaaccgtcggatggacttaatttcacgagcaaaacattacggtcgctcgagggctgacctgcggggcccaaggttttgtaggcagaagtcaatcgcgattcaagcgatcaatcttctccctaaaccactgcaactttcttcgctcaaccctaactcgacgaaaccttcagccgccgtgtgccatcctacgtacgccgagatgaccggccgcccagcggcgccaccccggggcctgattgctccaccatcgcacccgcacggcgcgctgccgcggaacaaacaaggatcgggagcagttcaggctgctgctgctgcgcaagacacaggacagcaaagaaggaactatgaccaagataatcggggcgcacaggatgctggacgtggatatacgcacgcggcaggcaaccatcgtcaccaggatcagccgggcgaggcttcaaccggcaatacagaggaccgcaacactgtcctgtcaatcaccggccagctgacactcatgctagtcgccgtcctgatcagagccgcagagaagaggagcgccaagaggttcctgctcgctaggaataggtaactgaggtgccggctaaacacaaagcaatggcaacaactgaggtaccagcggcaaaggcaaagaaaccacgaccacctttttgctacagatgcaagtgcaatggacatttgcctgctgtgtgcaaggcagatttgaattgcattatatgtaacaagaaggattcacatttgtctatcaagtgcccaatcctgaagatgccgaaaccaaatgcgtcgctgcttgggtttggcaagaatgagcttggttttcttcaagtgccagactttgattacaagctcgagactacagttccggcacctacagctttagtcacgatcacgggtggacacctaggagcggatggggtacagacagagcttgccaggcttattcgagcagattggaactgggaggctttgccacacggtaaagattctttcctagttacattcccatcggaggaggaactgaaaagaatggctgatgtcgagtttcgcctaaagaatcatggggttgctctgacgatctccgagtggcaggaagcaggtgatgttattccctcatatgaattggatatggcatgggtgcatgtcaccggtgttcctcatgcttggcggcattatctcggtttttgggcacttggtagtgtaattggggctacagaagaagtagacatgctaaccttccggaagttgggagtgatccgaatcaaagtgggcattatggatagggaacatttccctttcactactgatgttgtgtttgggaagcatgggtatgagctgatttacactattgagcctgaagattttcaacctgccattcccaccccatccaatgatactatggatcatgattctgcgggtactgataatggtagcaacatggatggaggtagtgctgatcatgcagcaaaaaagaagaaggcgaatacatcgacaccggagagttcgaatgctgcagtttcaggtccaactcctatgcagttagcagtgactccttttggggatcgtcgccctgtgccacagagacagcaaattatcctgggcactagagtgaacaagcagcacattgcggtcactccgttaagggtgaccggatcgacatcatacggtcggagagaagtttctctctcgacctcaacagctgcgccagccgcaccgacattgattgtgcttctaccgaagtcttcatcatcgatggatactccacccgggctgacaatggcggtgtctccacctacgcctgcacctttggggtggtcgctcacgtcgaccccacccccatccgctcctgtgcagaccctgccggcatccactccacccatgtagacccgttggcatcgtcgaggcaatcaacatcagcgccgacaaaatctccactagtgccgaccctgccgatgcctacttcactcgtgcaaacaccaccagtgcctactacaacaactcaaactgctgcctatacacatgagggtcatgtcactcagcccggatcgagctccatcaagcactcgaccttcgggcatgtgaggtccccatgcactcctttacaggaggaaaagaccgaagggcttcgccatagtgatcgctgcaatgcagccatatcatctaatggcattgcagcggccgatgaggattcaacgacgaaggctaaacgcagggcagcgatgagaaatctggatgggccaatgatgtccaagatggctgacttagcgaagtcatcactttcgtctacatcataccttgacccttctataggtatgcattctaacctcccatcttcttccattgtttatttatccaatgaacaattttcctccaatttgggaaagataggagtttctttgggtagtggaagtgaaaacgtggccttttctgttaatgctattaaacatatgaaggttgacagatggaaagtagcacctaaaactaagatgaaagctaaggttattgatgaagcgaatgatcaaaatccttttgatgatggtgatgatgaggatgccaaacctgatggcatcttactcgctcacttattcaaggaagtttctgaagtagacttggatgatgcggagcttagcacaacaatttgtgacttaatagatacccctcgaaaatccaaatctgcttcaaaaaagaaaggtcaatcgaccaggaccaaaagtaacaagaacaaaaaaggttgtaaatgaaaggcatcttctggaatagcagaggtctacttgacttggctaaatattggtatgttgctgagaacattaaggaacacaatcttgattttgttgctttattggagacaaggaagaatgatgtgtcaaagacgaatcttgatcgcctagctgggggcgcagatttcatttggcactgtcttccccctcgtggcagatcaggaggtatattactcggtattaatgcagctgtaatggacttgtccttgattgtggaagggaaattttacgttaaattccatttacgcaacaaagaggacagattcgaatggatcttgatggcggtctatggaccagcacaggatgaattcaaatctagcttcttagctgagctagtccgcgcttgccaacaaaatccacatcccacgctcattggtggtgatttcaacattttgaggagtagtacagagaaaaacaacaatagatataatgaccgctggccttttctcttcaatgctgtaattgacagttttgacttgagagaaattgctttagcaggtagacaattcacatgggcaaattccttagccaacccaacttatgagaagttggatcgagtcttaatgaccacggagtgggaatccaaatttccgatagtttcggtacatgctcttgagcgaggggtttcagatcatactcctcttttgcttgatactggttctgcggctttcatcgggaaccataaacagttcaaactagaactaagctggttgactcgtgatgatttccacgaccgtgttgtcgaaatttggaacaagccggtcaaagggcgcaactcggtccaacgatggaacaataaaatgagtgctttgcgtaagcatctacgaggttgggcggcccatatgagtggtatgtataagcaagagaaaaaaagtttgcaatcgaccatagatgaattggacatcgctgcagaggttcgagtcctgactgaagttgaaagagatcaacttactcaagcaagagatcgactagttatgcttctaagagaagaagagacaaagtgatttcaaagggccaaaacttctgatgttcgtctaggagataataataccaaatacttccaaatggttgccaatggcaaacacaggaagaaacggatattctacctagaacaggacgaagggaaaatagaggggcaagcagctctcaaggcctacattactagtttctataagaaactatttgggccacctgaagataacccttttacgctagatgaatctaggactggggatatatcacaggtcacagaggctgaaaatgaattcctaacggcaccatttttggaaaaagaaatacgagatgctgtatttgacatggagcataacaaagcaccgggcccagatgggtttccagcagaattctatcagaaattctgggaagtcattaaacatgatttgatgaatttattccatgaattacatactggtgaattgccattgatcagtttgaactttggggtgataactttgctcccgaaagtcaaagaagcgaatcgcatacaacaatatagacctatttgtctgcttaatgtcagctttaaactattcactaaggtcgccacaaataggattaactcggtggcggaccatgtagtgagtccgacccaaacagctttcatgcgaggacgaaacatcttggagggtgtcgtcattttacatgaaattttacatgaactacatcggaagaaactaaatggagtgatcttcaaaattgattttgagaaagcttatgataaggtcaaatggccatttttgatgcaagcacttcgtatgaaaggattctcaaccaagtggatttcttggatcgagtctttcgtttcgggtggaagtgtatcaataaaagtaaatgatgacgtcggaccttttttccaaacgaaaaagggccttcgacaaggtgatcctctttcgccgatgctttttaatattgtagctgacatgttggttattctaatcaatcgagccaaagtagatggacagatttgtggagtagtccctcatctagtggatgatggcatttctattctacagtacgctgatgataccattctttttatggatcatgaccttgagaaggctcgtaacatgaagcttctgctttgtgcttttgagcagctctcaggtctcaagattaactttcataagagtgaattattctgttttggtgatgctcgagccatggaagaccaatatactgatctctttggttgtgcttctggcgaattcccattatgctacttaggcattcttatccattataggaaactaagaaatgcagattggaaaggggtagaagaacgctttgagaagagactcagtagctggaaagggaaactactttccacaggaggaagtttaacattgataaactcagtgcttagtagtcttccactgtatatgatgtctttcttcgcaataccgagaggtgtacttaagaaacttgattattttcgctcgagattttattggcagtgtgatgatcaaaagaaaaggtatcgtttgacgaagtggagtattatgtgccgacccaaagaacaagggggtttaggaattcatgatttagatatgaaaaacattgcccttcttagcaagtggttatttaagctactcacgaccgatggggtctggcaacaattgattcgtaacaagtacttgggctcaaaacctgtgtcacaagttgagtttaaagttggggactcacaattctaggccagccttatgaaggtcaagcgtgactttttacgatttggcaaattcattatgagagatggtgcccaaatcaagttttgggaagacaagtggttgggagaagcaccattgcgagaacaatatccttgtctatacaatatagttaggaataaacatgatactgtagcaaaagtgctacaaaattaccctccgaatgtatcttggcgaagggatctcattgggccaaaattagtggtgtggaataaccttcttccacgaatcgctaacctagttcttactcaggatcaagataagtttcattggaatttaacccaaaatggagaattttcagtgaagtcgcattatcttgccttggtacattcagatttgcccaacataaacaaagtaatttggaaattaaaaataccgcttaaagtaaatatcttcctatggtatttacgtcgtggggtagttttgacaagggataacctagctaagcgcaattggcaaggaagtaagaattgttgcttttgtcacaaagatgagacaatattacatttgttttatgagtgcagatttgcccattttgtgtggtgcattatacaagtggctacatggcttttcccgccacgtggtgtatccaatatgtttggtaattggctacggggaattaggaaagacttgaagtcacttatcctgttaggggcagccactatttgttggtcattatggctttgcaggaatgatatggtgtttgacaaaagaaaaatctcttctcctttacaggttatttttttaactatccacttccttcgtacctgggctatccttcagaagcctggttcacgggatttggttgcagcggcgtgtcagcccttggagcaggtggtcagggaatgttttacccagggacatgggtggcggtctagcttgaagattggtgctccctgatttttactgctttccttctattgttacaaactcttttgtgggtttgtgtgttttggctgtgtgcatcctagttatgcagaggccgggagttttcttagtatggttctatcaacaatgtaatcgtctgagattaataaaagcttcctttatcaaaaaaaaatatatccaattaacaaaaaaaaaaaggacatgtattagcagcatgacaatctacgtaatcagagcaggaaagcgtaattctatcgaccacaaaacggacggctcaaaggggaaggaaagcagataggcccgcgatagcttaaacccccctcctcctcctccgccgccgccgccgcccgcgctcgccgccgatggcggccgccgcggcgacccgcctcctccgccttgccccgcgccgcctccagggcccacccagggcgtgcccgttcgccgccctcccgctccacccgacgccggcccggctcgccgccaccacctcgaggtggcgccgcttctgcgccgccgcgcaggcctcggcgccgcccccgccaccggccgccacggcggcggcggcggcggcctcgggggaggccgtgggggagttcaggagacggacgcgggtggcggatgtcaagggaggggaggacgagggcgccgcgtgggttggaaagcagctcgccgtgcgcgggtgggtgcgcacctgccgcgcccagaggaccgtcaccttcgtcgaggtgaggggaagctttgcgtttgcgctctcgcatccctttctgtttgaagcgtgaattcgtgatggtggcgctaatggttagcggtcttgtgtttgatgaaatgaacggtgcgaatgattagtttgcgcacattgcataaaattgcattgtggactaggaattgggagtgctggaaaagatgctttccttcagtgcactattcacattgcttccccaatgtcgttgatcattttacatttcatgaaacatttcgatccatggttatgcgattgtactaaactagctttcattgtactacttttgtacaaattacgataacaagactgaacttctggatagatattacagaaatcatttttgtgactgtttgataagtcgtccttcttttgatgagaattgcagcctgtttgacttgcataccagcagttctgtggagtgtgccattagttgtttggttgatgcctaaccttgccataactaagtttaggctagttgtggcatggtggcacaaatgtggcttagaaatagttggccacaaatgtggcatgcttagctctaaatttgagagcatgacatgtgggtcccaaagtttaaaaagtgtggcataacacaattgcggtagcgaaccaaacacatgcctagaaaattgtggcgtggcaaagtgtggcaaccaaccaaacagcatgttacttgcctacttttctctaaggcctacttttgtgttattaactgctttgaagttagaaatcaggacaatttctctaaggcctacttttgtgttagtaatcagacttcagacagtctttcatggaccagcaatactaatctagtaatctgcatgccatgagtgcacagtataatgaatcagagtatctcatattctgaatgcataggatgttaatactgtcatctggagactttaaagttccctgaaataatggtaatgactattggcttttactttaaatctctaacgcgtcctaaaatttaaatttatttcaggttaatgatggttcttgcttgtccaacatgcaatgtgtattgactcctgatacagaaggctacgaccaggtaagcaatcattcagggaatcagggtacaactagatagtagaaacaatacatgttaattttgttttgttattctggtcaataaaaatagtttgatcaatccaatggttatcttgtgaacacagaaaataaaactctgataattgtgacatggcaccaacaatgacaccagcgttgtctagttatgtctcaattccttttattttccttgctatagttgcagccaatgtgttcttgtggctatagtacattttactggtcaatattttcattggtggatgtcagatagactctatcactactggggcctctgtgttagtggaaggagttatagcaagcagccaaggtggtaaacaaaaagtggagttgaaggtttcaaagatcagtgtggtaatggtttcattctgcctatagtttcctccttttcctttttatttccttttttctttgcgtgcctcacaaatctaaatgaaatgtggacagattctggagttaactagctatttccagatatcaaaataaaatttctataatttattgatataggaaaatacttgtggagtagttaaggtatctctttttgtatgctactatgctagtcttgtactcttgttaaagacagatatgagcgttaaccgaacactcctatatcgaataagttatttgatgatccctaacgtggtaacacacaatgcacaaaaaaattcgcccctatgctttctttttatataaagaaatttctgatggcatgacaaaaggatagacctatagactgttaatgttgattgagaatctgcagttgcattttgctttatcaggctgtagacaatattatcccaggtaagcacgcttctagtgcatttttttggtgtgttctgatgtaggtttcacttctttgtacagattggagaaagtgatccaacatcttttcctatacaaaagaagcgggcatcaagagaatttctgagaactgtagcccatctccgtcctcggacaaatacttttggcgcagtatgattttactcattgctagttcttttctgatactttttttttgctcagaagctactaaatctgtagacttgtgttatgccttggaaatgatcatgccctttctgtccacaacttttctacaaaatgctcatcattatccttttctagatgcgttgttaattccctaatttagctcataaattagcatacaagttgtgacaaggtttgctatgcaaatattacaaaataagtggcatgtttatagatgacattctgtccaatccaaccttggatatggatctgccaatgtggtgatgaaatacatacattatgtagaattgcaatggactatgatcaatgcagccatggacaggaaatgtgtgtgattctcatattggcaagaatccaacaaactgctgatatagcatcatattctgcacatcaaaatagtgcaaacgttggtagttttatgtgttgtagtaagatgaacttttgcgttagaaagtgcctttttcttatgatgaagaagctggctggtgtccaacatttttcatctctctagttatgtaacttattctatggaatttttactgtactgttgtacttatttaggtggcaagagtgagaaatgctttggcatacgcaacccacaaattttttcaagacaacggatttgtttgggtagcaagccctattatcacagcatcagactgtgaaggagcaggggagcagttttatgtgacaacattggttagtatttcgtcaataagattctatagagtagtgtatagacagattgcttggtatgtaacaaatttactgtttctgggggaatgttctgctcataatgtcatttcctgtactaacatgctgttcatattgcaacacacattttggtcttctctatttttacctcaaaaccattagtgtactttttgctccagttcagaaattaagtgctctttttctttttttcctcacaaaaaaaaaagaaattaagtgctccgcatcatcctgtactaatatgcttgtccaaatcagaaactacttgaagttttcttttagttttgtacttctgtgtctgtttagaacagcttcactatgttattaggtgcactgctaaatcagtttgaattttccatctacagatttacttatttaaaaatcattaaagttctgctataacagttgattaagtttgtcatgattggtttttatgtatctgtctatatttaaagatatttatggctctgagtatcacttattatctttttatgtttacaatatattccatggaatgatcagagctctccattttggtttctaattgccataacccctttcattatgtttctatttaatgctgttagatttttttccctgtcatacagatttcgaatagtgctgaaggtggttctctagtcaaggatattccttctactaaggatggaagggttgattggtcacaggtaaaacttcagaatgaatgcttatgcaaccttttgttgttaaaagtcaaatgtttcttccccattttaagcaaatttacccgtataatttttgtgatatgctctgttatactgcatgccaacagctgttcaagtaatccaaatgtttcaatgtctttgtggttttcgtaacaatggttatttgcttgtatctatgctaggatttcttctgcaaaccagcatttctgacagtgtctgggcaactgaatggtgaaacatacgctacagctctatcagatgtaaattttcatttgccagattcatttgaaataattttctgtcgtatttgatatagctgtaaccagtgtttctgtttcctgacattgcttattctacaggtttacacttttggtccaacatttagagctgaaaattcaaacacctcaagacatttggctgaattttgggtatcgcaatattcttttacatttatgtttctttcagaattttaaattccagaactcttaatttacaggttttttttttgttggtttgtgttccggggaagatgattgagcctgaacttgcctttgcggatctaaatgatgacatggcatgtgcgagttcatatctccagtatgtagtaggtgcccttttttgcttggtgctcaactctgttagtgattatttcattcagacaatattttatggatgcttcacagttactgacttgctgaattgtggggaagatgtctctatatgcttacaccatttacctagttactgcttgtttgatacaggtgaagtatgttctagagaactgcaaagaagatatggatttctttaatacatggattgaaaaagggatcatcgatagattaaatgtattcctctcagatctttcttctgttgctgcactatggattgttttggtcaagtttcatgctgaaatattgaaaatgtttcttcttgcaggacgtagttgagaaaaactttgttcacttgtcatattctgatgctattgagctacttgttgggtccaagaagaaatttgagttcccggtaacacacaaattcaattatttatattctcatattctcatttggactacattacaattttgttccttgtgttctatttaaagtcctaaccaggaaacgaaaattgactgcatatctgtctttggtgttggatggcatgtcaacatgcttgttgatagaacaaatgcttatactttttgtagttactgataatttgatttgtttaattttaattagtgtgcacaaaattacctgtttgttttctacttctacatactcagttctgtgtactgtggatccttcaacaactgtccctgagtaggcaaatgggtaaatgcaagaatgcgagtgattattttacaaaaataatgcctctttcttttgtcttttgaaccatccataggtcaaatggggattggatctgcaaagtgagcatgaaagatatatcacagaagttgcttttggtgggcgcccggtgataattagagattatccaaaggtttatatcgtcactggtctgtgattaactagttcattaacaaagttgtcatacttcaaaatttccttttattttgcttaggaaatcaaagctttctatatgcgagagaatgatgatggtaaaacagttgctgcaatggatctattggttcctcgggtaagcatatacaccaatagctgacatctcaaacaatacatcatatgtaaaattccgagtatataaatagacaaaatggaggcaaagcttctagcatatttgaattagttgatttgtaatataactcttttcctgttcaatttcaggttggtgaactcattggtggaagccaaagggaagaacgtcttgattaccttgaagctcgcttggatgagttaaatcttaacaaagatagctactggtggtacttagatctacgtcgatatggatcaggttaaatttcaaatatcaaaatgagctggataatgcaatttctccttttacattacagatcatttaaaatttgttattcggtagcatgatttcccccctgtcatgatccataacgaatttccaccttttctgtaacagttcctcatgctggttttggtcttggatttgaaagactagtacagtttgcaactggaatggacaacattagagacaccattccatttccccgggttccaggctctgcagagttttagaatccaacattgctcacaaatactttttgcaacattctttcctgagattgggatttcaagaaaagtatacactctactgtttcattgtacagagtttagttaagttattgcttacatcgagcaaaacaatattgttccaaattttgttgtttggagtaacgtgcttgcaaatttcattgaacttccgatgtacattattgttactggacgtgttataatgatcacctgatggattgatatagtgcatttgatctgttttaccgcatagcaagaattttgtctataccggtcctgtcagaattttatctcaaggtacgatgatttgtttcacaagtaaattttgctgagaggagttatgatagtacttaaatttaccacatagcaaggaatgttgtggtctagtcttgcccttctggtgacaatgttttgattagcaagctcatttaaatggattttttttggttacccatagcgccctaaatattctttttcaataaaatacctttcagacgctatacaggaatcaaaggaagaaagctatacaatttacacgctaatcttgaaataacagcggtttctctatatcgttggctgttccgtcctcaaccattctgtcaacctggcattctttcttcttagcccacagaacgacataaaggccggagaacaggaaaaccattcccagcatgctgcatgcatccatacataaccaagagcaaatcagtttgcttttggaaaatctagcacgaactaaattgcagtcatgcatatctaagtttctaaacacaagcggtacacattgaacttatgttagcacaattattgttgtttcaagaggtcctacatgtcatgtttcgcttaacatagattagacccaatgaatccattagatttttaggtatatactacttttgttttttcaaatagataacactgttgactttttatcacacatttgaccattcagtttatctaaaaaatttacgtaattatatattttttttgttgtgagttgttttatcacttaaagtactttaagcataatttatattttatacatttgtataaaatttttgaataagatgaatggtcgaccatgtattcaaaagttaacagcatcatctatttaaaaaatggagagagtgagtatatgggcctgtttggcacagctccaactccagagctggagctcaaccaaacagtttcagctccaccaaaattgggagtggagttgggtggagttctctcacaaaatgtactagagttgtggagctgggttttggcagctccacaactccactccaaactcaactcctggagttatatttaggagttggagctgtaccaaacatgccctatatatgcacatagtgagagaagaactatacctcactgggtggaccaccctacccaagaacaaggccgagaagatcgccgatccgacggtctgcgtcgggctaaagagggagaccaccacgggccctttcttctccagcgcccatgtctggaacatcacgcacaccgagcttactagcccgccctgcatacatacgcctccatgatccatccatcaatagtcacccgtagcatccttattccttacactaataaaacaaacattaacatgcatgactcatcattgccagttcacctcataatgttttttttctcctttttctaaagtctaaaccggtatgtatcaacagtgatacgatcaatcactactgattgctcgctaccggataataaggaacgatagtgatgctggttatggaattgagatttgcttgatagtgcaatagtaaaggtgtgtgtggtagtgttcaaccctaagatcccccattcaatctccaatacactcataatttcttcttaaaaaatatttggaaaacgtctctcctttcaaagctcgtttttttttaattatgctgattgcgaggtggtggtggccggttcaccgctagcctaggcaagcgctagtgttgatcaatttgcatattcatcattcatggtttaatttgatgtgttaactagtatactccttccgtactcgtaaaggaagtcgtttaggacagcgacacggtctctaaaacacaactttgacttcttttttctataagaatatttattgaaaaattgatatatgtatacttttataaatgtatttttcaagacaaatctattcatataatttttatatttttaaactcaacaacttgagagttattcatgatttatatttcaaggtttgacttaaacattatcctaaacaacttcctttataagtatggagggaatatatactacttcactatatataatactccctccgtctctaaatatttgacgccgttgacttttttaaacatgtttgactgttcgtcttattcaaaaactcttgtgaaatacgtaaaactatatataaacataaaagtatatttaacaataaatcaaacgataggaaaagaattaataattacttaaactttttgaataaggtgaacggtcaaacatggtgaaaaaaggcaacggcgttaaacatttagggacggcggaag

SEQ ID NO: 74796 - DNA, 87218 bp, Oryza sativa
  unsure (1)..(87218): unsure at all n locations
agtcgtccgtcaagcgtgagtagaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcaagaaacacttagcatatacatgactattttagtcttagcatgtaatattgtttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctgtcagggcacgttccgaccagacagagatagggacgagctgacactcaccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacagacccttcaggtacttaccactgcaggccgattccagcaggatactccaaggtcgaagttgagttggtcgaaggcgcgtacgaggacctcgaactggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggctatcaagctatcggactatgagcgaacgctgaagaaagcatcttctggaaagtccaaaccagtccctcagcttggagagcaaccaaaccaggagatcgagccgttggtgaccggtaaagaaatgacaatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccatacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatacatatatatatgtatgcatatatatgtattgaaacatatatatgcatggtttatatatatataaaccatgcagcaacaggggcatgcaaaaaaaaaaggtcagctcgatctttagtcccggttggtgttaccaaccgggactaaagatcgatcttttactctcggttatttcacccgggactaaagatagcgatctttagtcccggattggtactcccggtttggaaaccgggactaaaggggggttacgaaccgggactacaaagggtttctccaccagtgagccaacaggtcggctataaggtgacctgccggcggcaaggtgagcggtacctacacactgatacaaacacgacaatgacatcgtcttctttctcatatccctcgtcttccctagagataatcgatgccgaatccttccgcgttcactcggacgacaccttgtttccattgaaggcaaggtgtttgaggacggcgtggtaactctctttgtcctggccatttcatgctctccagattatccgaatgcatccgcttcccgacgacaggcctccttggccgctagatgcattgccttgcagcttcaaattaacaaaatgtacgtgagtcagcagtgtgtgtacgaaatgttatgttcggtatatactagagtacgtacgagccacagtacaaaagcaatgtacggcaggacaatacacaacataacatacatggcgcataggctgaggaggtcggcaatggactccatcacggtggccgcaacgagaacgaggcccgcgatttagacgagtatatcatggcaacaaagcacatgacatgtctctgtgaaagacgtggccacgttggtgtttgtcacgttcgactcgcccacatgcaatgtgaccgcggcctgggcaagcgcattctcggccgcttcgtccttgtccttgaaggaggtagccatggagatagccccgtgttggctcatggaacaaggttgaagaagaagaaaaagaagaagaagaagaagaagaagtggttgctgagcgagcgatgggaacttacggttgtgaaaccttgtggttctattgttgatggatgtaaatgatataagtataacccaatcacggcgattcggaaaattcacgcggtgtgcgacgctttgttaaccacattttaatttgcacaacgtattgtttcacatcagaatttaattttcccttgcgggcgtaaatggtcatgtacgtactacgttgcttcgttaaccacgaatggcctggccgttcattggaactcacgtaaatattgtgcggttaccgagaatattgcaaaaagaatgatggaatggaagcgaaaccaatgggatttcccaaacgtccgtacttcgtgggaggtggtggtttgtgaccagcggtgtgaatggggtcgatatatatgcccccgccccgcaccactccacagtccacacctctcagatcccctactcccccattccatccctccctccatgtcccacgctgacatccccccactccctccctctcatgccggcgcagacgttaatacatgctcctcctagagaaagtcaacgtggaccttaacatagattcagtgctataataagtaaaggaagtacatagattcagtgtcaagctgtagaccttaacattttgttgatatgtttatagaaggaaatcttatgctactgatgtacatcgcatactaaaaacttgatgaagataccgtttttcctcgatttccgttagcacggttctcaaattactaaatgatatacttcttcataggcaaaaactttttgattataagttgttttagaatatcatataaatctatttttaatttataattgttaaaacaccattaatcagttgttaatgactccagttttatgtgccatcacttaatcttcgtatttcaaacgggaaatagatcatcttcacgcgcgcgctgcctgtgcacacaagcatatagctctgatattgctcagaagtgaagaataatcttgtgcaagttcagagcaaaggtgctgttggaaattcggtcataattcggcatattttaatccaaaatattaagacaataaacatgacatttgcagtatgagtagatctagtgacagtgctagatgtatacaacttgagtatgcttaatatgaaataagcatcaacatttacaaagtaacgcaatgctgccattgcaaagagtattaacaaagaaatatctaatagaatcgggagaatgaaagtataccccgagaacgtcccaccgctggattttgaggcagtattgcttccgttgatgtcgttcatcttcttgtctccaatctccgttgacatcttggtgaaggtgccgatgcagcagcagtagccacgaagaacaagagcagtcgcgcttgaagtgctatccaaaaacttgatcgcccgcctacccgtgcaagttctcaagcggacggagttccggaggcacctgctcgtcccatacacctgtgcacgcaggtgaatagaaccggggaaggattctgcagctcaggaacagaggaggaggaactcgaagtgcaagagtcgtgaagaacttcttccgtccttctggtcgctgcggagtatacatatgcgagcacgagagtaacgttcggagtcatcaaccgcggtgtttaatttcgtaaccgacgcgctcgttaatacggaatcaattcacgacgtttaattccgtaaccgacggaatcaatttacgacgtttaattccgtaaccgacggaatcaattcatgacgtttaattccgtaactgacgcgttcattgatacgaaatcaattctctgtgtttattatcgtccgttacaaaacgagagagcgcagcagcagcagttgtctgcctcgcctctcctcgcctcgccccgcctggttgtccgcgcaccatctcaaccggtcaataaagactctccactagcttcgtatttaagttgagacctcttcacttagatttccaaggtgatattattactcatagcacttaatgtgggccaatggaatttattaggatttaattgggcctagcccattaatctaacaatccccaccaaatttcatggctcacaggaaatgctctcgattctgatcctgtttgttataccagtgtttcggtggagactgttaagttgaacttccacctaggaaaagagctacaccagatcacaactgaataatggactatgccttgaattgtcagtctagtgcgattcaggtttcactcaaacccttaactggtactaggcagccgtttgcatcccctctgtttggagcgtataagtcatactcctggccttttcatgagtatctagatatcacccagatctcatagactgtgactagcagtcggactcatataggtgtgttccttctaagatgttctgtaggccaacatctctgctttatgaaaagccactcggatcatattaaggtgtataccatcctaccatacagattagaagagaagtgcatcatgaagataaagcccattttagggtctcttctctcagttacacaatagtttgtttcgccatccaaattcacgggatctccgatcacaatggacaggtttccaccatgtgcaactctaagtgggtctcaagcccatctccctcgatgcacagtctatcacattacgtggtagccccttggtaaactgatctgccagatttttagccgtctggacatagtccaatgctatcactccggaatttttctgctttctgacagacttcagtcttcttttaacatgcctggatgacttcatgttgtccttcgaactgttcactttaataatcactgtttgattatcacagttcatcaggattgctggtactggtttttcaaccaccggcaagtccatcaggagctcacgaagccattcagcctcaactgtggcagtatctaaagctgtgagctctgcttctattgttgacctcgttaagatggtctgcttgcaagacttccaggaaacagcgccacctccaagtgtgaacacatacccacttgtggcctttatatcatcagcatcagatatccagtttgaatcactatagccctccagcacttttgggtacctggcgtagtgaattccatagctcattgccccttttagatagcgcattactctttcaagagcatgccaatgatcatctcccggatttgaaacaagccggctcaacttgctcacagcaaatgagatgtcaggcctcgttgcactagctaagtacatcaatgaaccaataatctgggagtacctcaattgatcccttgctattcttcggtttttccttaatagcacactaggatcataaggagtaggagctgccttgcagtcactataaccaaagcgactcaagaccttgtccacatagtgagattgcacaagtgtaatcccaccctcaactcctctcagtagtttaatgttaagaataacatcagccactcccaaatccttcatttcaaagcttttggacagaaagtccttgacctcctcaatcacattgaggctggtcccaaagatcaatatgtcatcgacatataaacacaagatcactccctctcccccaccatagcgatagtacacacatttgtcagcttcgttcacaacaaagccagcagatgtaagtatattgtcaatcttctcatgccattgcttaggcgcttatttgagaccatacaaggacttcaacagcttgcacaccattccctcctgacatacccatctggttgatccatatagatctcctcctccaactctccattgaggaaagctgtcttaacatccatttgatggacgagtagaccatgagaggctgccagagcgagtagtacacgaatcgtagtcaagcaagcaaccgatgaataagtgtcgaaaaaatcctcgccttctttttgggtataacccttggccacaagccttgccttgtacttttcaattgtaccatcaggcctaagctttttcttgaaaacccatttgcatcctacaggcttacacccatatggatgctcgacgacttcccaagtaccattagacataattgagtccatctcactgcataccgcttccttccaatagtcagcgtcaggagatgaatatgcctcttcaatggttcttggagtatcatccacaagatatacaatgtagtcatatccaaaagactttgcagtcctttgtctcttactctttcgagttgctacaatgttatcctcctcaggattttcctcaagcgtttgatcaatgtgttctatcggcacaaagtgctcaggggataaaataggttcttgactagaagtgctaggtgcatttttcataggaaattcattctcaaaaaatgtggcatctctggactcagtaattgtaccaactcgcatgtcgggtactccagaatttactattaagaacctatatcccacactgtggatagcataaccaaggaacacacaatctacggtctttggttcaagtttacgctttttggctataagtacatttaccttggtcaaacagccccatgtgcgcaggtgagagagatttaatttcttcctttcccattcctcgaatggtgttacttccttatgcttagtaggaattctattcaggacatgacacgcagtcaatattgcctcaccccactattccttggaaagtcctgcagtgtctaacatggcattcaccatctcagttagagtgcggttctttctttcagctaccccatttgactggggtgaatagggaggcgtcctctcatgaataattctatactcttcgcaaaaagaaataaactcattggaaaaatactcaccacccctatcagaccttaaccgtttgattttcctttccagttggttttctacctcatccttatagatcttaaagtaatgtaatgcttcatcctttgttttcaataggtacacatagcagaatctagtgcaatcatctatcagtgtcatgaaatatttctttccccctttagtcaacacgccgttcatttcgcacagatcgaaatgaacaagttctaatggtgccaaattcctcgcctcagatgccttgtgaggcttgcgaggttgtttcgattgaacacaagtatggcacttagagcctttgactaaagtgaattttggaattaaactcatattggctaagcgtgtcatacaaccaaaattcacatgacaaagtcgcaaatgccacacattggactcatcatcatcatcgtttacatggttcacaactttattacacatatcatccaaggaaaagcgaaacaaacctccgctgtcataaccttttccaataaacgttccatatttagatacgacacatttattggattcaaacacaagtctaaaaccatctctacacagtagagagccgctaactagattcttctttattgaagggacatgctgcacattcttcagctgcacaatctttcccgaagtaaactttagatcgaccgtaccaacaccatgaacagccgcaagcgatccgtttcccatcaaaaaggaggaacctctcccgacttgataagaagaaaacagggaaatgtccgcacacacatgaatattagcaccagtatcaacccaccaatcaggtgagtgacacacagagagaactgtaggtaaaaatttaccataccccaatgttcctctaccctcactaataaccatgtttgcaaacttcttgtccttgtgctcaggacaatccttggcccaatgctcaggcttgccacacaaaaagaaatctccttttacctttcccttgcctttcttcttaaaattggttgtagccttgggtttgacgtcaggtttgactttcttgttgttgttgttggatgcgtgagggttcttcttctgcatcaaattggcgctagaacctccctcgatctttttgcaccggttatcctttgccctcaccttctcctcaatacccaaagagccaatgagatcagtgacactgaactcttgcctcttgtgttttagagaagtagcaaaatccgaccaagaaggtggcaatttggcaataatgcctccagccacaaacttgtccggcaactcgccgttgttgttctcaagttccttcagcatctgaatctcatgagcctgttccactacagaacggtcatcgaccatcttgtagtcatagaactgttccatgacatacagcttgctgccagcgtcagaaaccccgaacttggcctcaagagcatcccacatgtccttccctgaaggtatgtgcatatacacatccacaatattatcggcgagcacactgatcattgctccacggaacaagcaatctgtagcctcaaacttagcctcctcctcaagagagagaggcggttcactcggtttgccccgtgagacaaagaaacaatgcatcaccgtcaaccacaaaagtgcacgtgctttccatcttttataatttgaaccatcgaaagcatgtggttttagtgatgcagcaaagccaactaccgaaaaagacctaacaagtttttggattgttggaaatttggtcataattcggcatattttaatccaaaatattaagataataaacatgacatttacaatatgagtagatctagtgacagtgctagatgtatacaacttgagtatgcttaatatgaaataagcatcaacatttacaaagtaacgcaatgctgccattgcgaagagtattaacaaagaaacatctaataaaatcgggagaatgaaagtataccccgagaacgtcccaccgctggattttgaggtagtattgcctccattgatgtcgttcatcttcttgtctccaatctccgttgacatcttggtgaaggtgccgatgcagcagcagtagccgcgaagaacaatagcagtcacgcttgaagcgctacccaaaaacttgatcgcccgcctacccgtgcaagttctcaagcggacggagttccggaggcacctgctcgtcccgtacacctgtgcgcacaggtgaacagaaccggggaaggattctgcagctcaggaacaaaggaggaggaactcgaagtgcaagagtcgtgaagaacttcttccgtcctttggatcactgcggagtatatatatgcgagcgcgagagtaacgttcggagtcatcaaccacggtgtttaatttcgtaaccgacgcactcgttaatacggaatcaattcatgacatttaattccgtaaccgacggaatcaattcacgacgtttaattccataaagttcattgatacgaaatcaattctccgtgcttattaccatccgttacaaaacgagatagcgcagcagttgtctgcctcgcctctcctcgcctcgccccacttggttgtccgcgcaccatcttaaccggtcaacagaaactctccactagctccgtatttaagttgagacctcttcacttagatttccaaagtgatattattatccatagcacttaatgtgggccaatagaatttattaggatttaatacaggtgctcccttatttttgagtgcaggtcacggcaagacaggaaaaggatttgcttaatgttaagatgtcacgctaagaaaaaaaaaagaagcatgtgctccaactccaacgctttgaaagagagtgaattttctttgtacaaccattatattgcaaatgtaaaaattatgttatttgagaatacaatagtgtaaaagattggcgctcctagatttctaatgccattggaaagcacccaatacttaaaaaaaatagggcgtctggttcttgccattgccattttattgaggtgtacgtgaggctcgaaattaggccaactagcccaccacttagaccaactagaccaaatagccggaaaactccaactcgagctatgctttaatcaactgtagagaatggttcaatgaactgactttggcctgatatatatgatccctctagtcaaaccaaccatgataagtacgatctttggtgaacgtcatttaagtgtatccaaaccaaaaaaaaaaagtgtatccaggcttggtttaagcacagtaggtggcaaaattaccagtacttacaggaaataagttaaataaatttagttattttgtgtgattattatgtaaaaaaaagttattttgtgtgattttatagatttgtactccctccatactcataaaggaagtcatttaggacagcgacacggtctctaaaacacaactttgacttcttgtttctataaaaatatttattgaaaagtaatatatgtatacttttatgaaagtatttttcaagacaaatctattcatataatttttacattttcaaactcaacaacttgagagatatttatgatttatattcctaagatttgacttaaacattttcctaaacgactttctttatgagtacggagtgaatatgtaaaattaattcaggacgtgcagttctatcggttgcatttatgggtagcggataatattccacgctaacaacaaacaggtagaggtagggcacgcagtaggctgtagttataggattgaaaaatagggggtcggtagttggcgcgcgtgttttctcaagtaaggtagagataatttcggtagtagttaagattttcttttttttcacgagacttttttcaactaacaaattgaaaagaaatctatatttgaaattaaatttttaaaattttaaacctatatttgaaaactttcaatccaagatttgaaaactttcaatttgaggtttgaaaattttcaagtttagatttgaaaatttttaagttaagatttgaaaaattttaagttaagatttaaaaattttcaagtcatgattttaaaactttcaactcaaaacatttgaaaaaacacgtgtaataaaaaaaaagcagaaaataaagaaaaaaatatcgccaaaagaaaaaggaaaaaaaagggaaaattgcaaaaaactaccccaaatatcactataagtttgagatggcccctataagaagatttgttgcaaatccccacctctccacctcctaattcaccttggttcgatttaggcaccttctctctacacatgcgtgatttaggcatctcatggcgtaattagccaagtcccgctcatcgtgatgatttgtcaacaggtccctttttgcattagattgtgtggccttaattttctgattaaaccgtactaaacttgctattttgggtcatctgatcaattacaacatatgaaatcatcaggtctaatctaactatatgattactgcttaatgttcaaatgtttctatatgctcattacgtccctggaaaaaaaaaacggatatgttgttcagtccaaaagatatcgatttggaatatatagctaggataccataaaaaacacagtgaaatggtcatgacatcacaacgaaatgatcagtttatactgaacaaacatcataatctcttgcacccgccaagtgggactcggttgattttgccacgagattcttcaggaatcacgcacgtgtggagagaaggtgcctaaatcaaaccaaggtgaattaggaggtggagatttgcaacaaatcttcttatggtgaggcatctcaaactcagagtgatatttggagtgttttttgcagttttcccaacgagaaaaggtcgtgtgggaaggagccaccagcaatgttgctagcgcgcgaattagcaatcctgggaaaatagagcttttcggtccgctccggagaaaaatcaaatacgatcgtgacaaatctctgttacgaatatggataatttctaccaaatatgaataggaattttttttgggaggagatacgaatacgaatatactaacatttctgttcctggcagatatgcggacgttgttgctatacaagtatccacgcgaacacatagcgtatctctggctcctttctgccaattttcttagttctttaatggtattttagccaccaccaatatggttgtgtttagtttacctgaagtttagaagtttggttgaaatcggtacgatgtgataaaaaagctgcgtgtgtatgaaaggtttgatgtgatgaaaagttggaggttcgaaaaaaaactttggaactaaacaggacctatatgctacaattatatacttaaacatccattaaacctcctacaaacactctcaagctgtcacatggccttttataaacgctcataaactatcgtgtggtgttctaataaattagaaaaaaaataaaaaaaaattgataaatatctaaccattgatttcttattaaattggtgcatccataagttttaaccattaaatctcttaaaaatgggatttactatagttgtgtcgacagttttttcttctatggttacattcagtactctagctgccgttggatctatgttaaagatctgtgcttccatccgacttttttctcgggaagagtcccgcttgcagctatagcagctaattttgtgctacatacatgcattctaatttagcactaactttcaaatacgaattcctatatcttttttccgatgtactagagcatcaccgacagtatttcaataataaattcctaaagtgagaaaacctatagaagagaaggcctaaaattaatttcctataatcaaaagtgggccttttctactcctcacgcgcgcaccacgtggccagctcctccttcatctcattattttttttccgtgcgcggtcattttttctccttgcacgcacaagagagagattgggaaaaaatcgttctcttgaggtgaggaacgagatatccggagttgagaacctggatcactgggagaggatactaaatagaatggctgcgcgcgttcttttctgtggattgaaaactatttccctccgcacagaaaacagagcgatctattagcacgtgattaactaagtattagctatttttttaaaaaaaatggattaatatgttttttaagtaactttcgtatataaacttttttaaaaaaacacaccatttagcagtttgaaaagcgtgagcgcagaacacgatgtagaggggttgggaacagtgagcaaagaacacagactaaggaagctgttggtcatgctcctcggatttaggaaagttcagtcaaaaattgcatccaacgtaatccctaacctgtctcccaataatactagttcccaactccggatatctcgttccccgctttaagggagcgattttttttttacgaattgctctctcccgtgcgcacggagaaaaaaatcgcgagatgtaggtgtaggggaggagagaaaaactaattttatctgttggtagttaaagggagtgcccacttttcattacaggaattaattttaggctatcttttagagtgagattagttttctcactttctatattctgtttaggagctctgagaaaaaatagttttgagaattgatcattgtcaatctcttggtgatgctcttagcagtacgtacggttgactctaactttcaaataattattgtcaacgcacgctaacatgttgatcaaccgttgatctgtgaaatccaagggctaaaaagctgattattatttttttgccaaaaaatatgtcaacagatttatagatttatagatagtcccaaaaacacaaggtagcctcacccccactgtgggcaagtacgtacgtactctctctatccggccaccctccaaccctcctactctatatcttctcctatttttttaagctaataactatatttacattatacatatcatctcatctatgacggcccctcacatgtttgagttttgcaggccgtcacaatgaattcatctcaaacggcccaaaaaaaagagaccgacaaagatatactcgcatagacatgttagatatgcatagaaatcgagcccgtcacatatgacacctatcggtgatgagctccaacttaaggcccgacaaagataaccgatgatatctttgtgggccctaatagaagcccgtcaccgatgtccatcattggtgacgggctctaacttaaggcccggttgagataactattaggctcatcattgatgacgagcttttgcttaggctcgacaaagataactgaaacccatcactgttgtaagttttttttggccgttatagatatttattacagtacaaatacccgaactacctagtgtaatggttatcccacttctcactattttgatgggagtgtgagcgggccgatttttgtctctgttttccaagaaaatcataaattgcaaatggaattgaaaaatagtagtcaattctcataaatttagtaaatacttacctgcaaaatttatatataatacttttccacttttttcagctcagggatggaccaaagttggatgtatgggaaaaactgtatgacgtcataccaaggagtatagaaatggtgtattggatattattaacgtcgcggaggaggataggaaaacaagaaatagcgattacatgtgttgtacatgtgcagattacaaacatgagaatatatttgatagcagagtggactgtggacgtacacgcttatctgatacaaagaggtttcatggaggactacacatgttgggtgaagcatagagagcaagaatcaggaagtggtgcacaaaatcaagaagatgaagatcatgagcatgaatcaggaagtggtgcacaaaatcaggaagataaagactagggttcactctcactcagatctagatcgaaaatttttctaagctctgccactctctgaaccctagcggcgccgccctctgggagcccgctgccatccccgagcccaacaccgtcgtccaccgagcccggcgccaaccccaagccagcgtcggccgccgtcgacctcctccacaccgtccttgcccccgtccttgccaccaccgcatcgacgtcccccgccgtccccgagcacgcccaccgcctcacctcctcctccgctggttagaaatttttgtgaattagtaggatttttaggatatgtttttgaattagtaggattttttttgaattagtgaaatatatttgagatgtttgtgtgtgatggtacttagtgaaattgttgtgaattagtgaattattaggatatgtttgtgaattagtgaattattagtatattttttgaattagtgaattattaggatattttttgaattagtgaatctagggtattttattgatgttaaggtgatttagtgaattattaggatatgtttgtgaattggtgaattattaggatatgtttagtgaattattaggatatttttatatatatgaattagtgaagtattaggatatatttgtgaattagtgaatatatatgtatggatgatggattttagtgtagatagtacgtaggttatcaaattatcacataatacaaggtgcatagggtccgaatttggttttatcgagttagtgcattcacagaactgattaagacaccttcggacccagcgcacctcgtattctgtcatttttttgataattattcatttatgtatggatttagttccttggttatcaaataataacacaatttgaggatcatagtgattttaggatttagtacctaggttatcaaaccatcacaaaatacgaggttctttgggtgccaagttggtttggtcgggttagtgcttggacggaaccgaccacgacaccttggcacccagagcacttcttattctattatttttgataattaaggaactttaataggaaatatgtatgtttagggtattttaggggtttaatgcaaatgtatgaaatttgtgatgtgagttactaatttaattaattttgtgattttgtaagttatttagacgatgcctcagcaaggcgaaccaatattgatgacaactagagggtccacaaggacacggacccctaggatagggaacaaattaaatccctaaggaacggtacaccataatagaggtgaaccacctaggagtgttgataagtcccccaaatgttctgaagaggtacaagttgatatgcggggtcatagcgagggagaccttcatcattttggaggatgacatcaacctagtacccgaagccgagaagaacgctgcttagctaaaattcaaggagagcttcgactatcttgcagccgatgaggataggctcaagagggcggctttcaagaatatgggaaattcttggaaaaactttaagtccaggatggtcagtgagtacgtcctcaacccggctactctggagccatttgggaccttcccgttcatcacacgaactgtgtgggagtagttctaagacaagaagtcgacccccgaatcctgggccataagcgagggttatcgggcactccagggtaggaacttgcacccgcatcggcttggcaccggaggatatgcctgacagtaccctcggcataacacaatttacagcagcgcaccgtatcagaggtggtctctcgaaacaccaggaggacatagttagggggtattggctacatgattgtatactaacaagtgtaaactactgacaactatatattagaagtatatgaacgattcttttttttattcatcctccacttagcctagattatattttggcagagtagttcttagttctttcttctgtgtgtcacccttatcatactcacgaattaattaaccccaacatagattttgatctatacaagtaatatatgaattattagcatagtactctcttatcatatgttccattgggattaaataaatatgataccttggattactcatggatgaaatgctacaatggtatatacgtgcgattgcggattatatctgtgaccataaatttaccaagaatatttcggtgtcattgctttgaattatatttctattaatgttgttaagaaatatcaacagggagttggcccgaggagggaggaagaaaaatagagggacgggaaggggactttgggctgggaagggagaggggggagaattttgggcttaaaaaggcccaaaggagagacagaattattttatatttttctttttataaaactctaaaaattggttatgttgattagaattatttatagtcctatgaaaattgaagcaaaattttagggttcattttaggctatggagaatttaagaaaaatacattcgaacttttcttgttttattgtttgttatattttttaggattttaataaattctattatttattttagagaatgatttataatttgggatgaatttatcatggcacgccaaatctccactgccgcagaggcctcctagcaagttctttgtattttccctttgccttcttcctctttaggtaacattttgattggtgtggtatgtgctcgatggaatctccttatgaggacagagaaaaggagatgagggaatttgtatgtgaaggaaacagttcaaagtcccgtgtcttttattacgatgtgatttcctcttttgtgattgtatccatggacctccgaaaggattgtatcactggtataagcctctttcggcttgactatgtggcatgtccttggactgaaacacaagtgctcagtactagccttgaattgtgctctttcttcttgatgaaacatatacatagaggagagaaggtagggaaaacaagaacaaggatgcctcacacgttctcggacacaagggttccatttcaatgttgttggaagaaggttatggtatgtgttgaccacgacgatagcgatagccatggcgacaataggatcttagtgggagccattgaaggtagggtaaaaatttaagggttaattaaatccatgccactgcaactttgctaaatttaaaaaataccactactattcgtcgtatcggctacatgccactgaaaagttctaaaattagaaccataccactcccgtcggtttttctgtcatcctctctcacgtctatcattggtttctagattttggatgtagtttttatttatatttttatatcacggcgttctacgactactcattgatggccgcgatcgacacggtcgtgctcctcatcatggtcgctgcgctaggtttcctcatggtgccttatgcgaaactgtagatccgggggttggggctcggtggtagtcttgacatgctcaacttcatggcgctcctggcgtggaccgagttcgaccttaactggaacaacttcaccagtgcaatcagagagcagcggggaggcattgtcagcgccgagatttgggtctgagaggagcataagcagagaaagaggagagaatgaggaaagacagaggtagaagatggggacattttcatccaatacatacaaaatactatcttagtggcatcattatagatatgcaaatagtaatagcatattttgaaaccacctaatttctaatggcatataggagtatctaattaacaaaaaaggaaaaggaaaatcacctcactctcccatcccccttctgttccacgacacggcctgcccacacggcacggtaagcccaacccaagatggaagaacccgccgccgccgccgcctttcccgatccgccggaggacccctccccctccccctcctccgcgccttctccggccgccgcggcgcctcctccggggccgagggagctggcggcggcgatggaggcggtggagcgggacgtcgccgccatctccgacagctacgcctccctcttcgcctccctccgcgtcgccctcgccaacgtacgtacgcactcacgcacgcgtaactggactaagctcccgcggcttcttccaccctccacccttcgctcgcttctcccatttctccgcctcgcttcgtttgctgctcgttcgcttcgctcactgatatattgtagcctaaccctcttgccgcaaaattgaattttaaaaaaaaaggtcacctcgacgtcggcggagaacatggagtgcctgggagacgtcgtcggccgcctccaagaatccggtgaggatgtttgcttacgaatctgcaaatttctctcgatttcatcataagggtaaacgattggggggaaaaattatgttataggggggtaaggctgtaagagtgtgcgacatttacctctgaatgctaattcttgtatggtagtagtttgcatccggacatggtgccctttattttgatattgtagttggtaattcgatcatttcgccaggtttgcttgcgcattggactgtcatattttctctttgtacagttggggtgtcctaatgttgattgtatcgttggttggttgctttatttttctggataaaaaagaatgattagattcgaccaggtggcgatttttacctttttactctgtccctgcagcactcgaagcttcttcgaaaggaaataagtacatcaattcgtgcttgaggtgatcactttcagctaatcttcgtcatctttccgttttctgctacatctattttttctctatgaatgtagatgggctaattgtagtgattttatagcttattgtatgggtgttccctttcctgtttcatctgtaactgtaaaagcattcatccttgaaactgtggactgtttatatatgaaatagtaattttgctttcagttccttcatacattattttaatgacctatattgcaggttgaatgaggaaatgagaggtctggaaagcctagccatgcaactgtatcctttgttagtttttataaatttgttctcctggatctatgtcatataattaatcaaacaccattttgctgtgcagttttattagttctgaagtatattctgttattcattttgtaagccttaatatttgtaaaagaaagattttacggaagaatgttgattcactagacttggctgtcaatcagttgctccgcctcccctagtcagttgctgttatccagtaggcagtagctaatgcaaggtaactaccactgctatatgatttttggggtcatatgcttttaattcttttttagttttttatatgtgcagtaagtgtttaatgctttcacaaaaagttaacagctagaaatggtttttagattttctgcaatttggtttcaaagcatggacatgctactccacatgtggcctatctgatgatggaccccttgttactacatctcttttataaatgcaccattattagctgttggggaaacacgagctttattaaaaagagataaattaattgttaacagagagtgttcattcatggcctgatggcctcatgaattgactacccgaaatatatatttattatgtatatctgcatactgatagtttatattctggtatgttgtgttatgtactgattcttttataaatcatgtactgcaggaacatgtaatgacattgtttcagcaattatacataataactcgcgctccaagacagcaaatgctataatctgaaatggcacacaccagcaaaggagaagatttaccttgtgtggcaatataaaatactacatccagtgtttcacttcatttcctcttctatatgtgtgcttatgagctccgtatttgtatagtgggttattcaattcaacccatggtgacataatatcattatctgtaaattggctataaagactatcttcatcactttgttctaactccattcaaaagaaagcaataaagatcctttttattgtttgtttgtttgtttgttctactattaccctgtctccgtttagccatcatttgatctatcctatgtgatcacttgattgtgttaacacatatacaatttcttgacgtgttgtttgttcggtcaacttattttaaagtttaaatattctcatatgaataggtctgcactcaatagctacgctagttgcattatgaagggaacttaaagagtgttatcttatcatggacacttattggacgtgcacatagtaccttttcatgctattttttgctcttcatgcttatgtttgtacttaagcagattccatgtgattgcatgatggagccagaaaagatgaaggtctgtgctactctcaaatttgtaaggcttgtatagtgttttatctgctcctaattgctatggttgatttttacatttttattttattcttttacttaacatgacttgagtatgttaaaaaatgtgaatcatagctaccactagtttgcaggcagccttgtaattccatcactattgttgctctccaatatgttggttgatgccatatatttttttggttcttcagatcctaggagggtaaaggtgctgcttcaaatgaagagcacagaatgaatctccagatttttcataggcagtaggtactgattctcatgctcgtaatacattcagatttttatgctcagatttaagcacggctatttatttgaaagagactttatttaagcacggctatttatttgaaagagaatttattcaagcatgagtattaatttttattgaacataggatagattcctcagacgtatcaaattcggtactccttgattgtgccaatgttgattcaattggacaaactactgttgataatgattcttgtaagctactcatagtatgcaatttgaatttcaatatcaagtcaagaaaattatctgttgaactggacttattttatcctctcagatgaagcaacaattacaaatattaatgtatttcccttaatgctatcatacaacaatatactgaaaaacaaaaaataaatacacaattggatattgatctctgaaaatatttatagcaaagaatctgtctttgcaggtagcctcctgaagaagttcacaggtgccgatggaaccttatgacgaaaccgtgggtgcctcatccagaagaaaccaaggcagagtgcaatcacttggaatggtgtcacatacaagataactgcagtaagcaggcaaaacaataggaacatagatgttgcccttggatccctccagctgagcagcgactgcagcctctctccttgagttgcaatgtccccaacaactgtctgtatcctcccagcaacatgccgtagcctgtcatacctcatcctaaccagatctggactctttgatgttgggaatgtatcaaattcttcatcaagctcatctgggtttgtcatatcggcatgagatatccttgtgttcatatgaggtgggaaacgcggccggaaccggtaattccacaatcctatcaagaacatgtagaggaagattgttgggaggataaggtctgggtagaagacaagcatgataaatagcacatgaactaaaactgttgtgactgggtttttccactgacaaacgtcgccaaaccactttcctgcagcaatgaatccggagaagacttgcataagacggaagaagttagccttgcttcgccgcatgctccacaggtgtgagcgggcatctgacatgaactcaacaacttccctgcgaactggtggctccatgcgccctagacgctgtgcgacaagttgcacagcttggtggcggagcatttcctgctgcactattgacagtggttgcgcgtaatgcatcttgggcaagaggggccgagaatatgtgaagagcacattgagaagggatgtggctgtgaacctgatggccaggtggagttctcccattttcttaactcctgatgggtggaggacaagtaatggatacgtgtgtgtgtacaccctcccagtctcaagagttgaaagccgaattcgcactttcccgatgggcttgtccatatggccgggggaactactgtggttgctgtctgcagatatgtggcagttgtcaaataaaccaatggtgagcactgttccatggtcgaagacatcccatgtgtactgttcattgaatctagggttcaagttgtcaacaatagtacgtgtccgcacccatttctgaccatacttggcaacacaatatgcatcgcatgacccccgctcatgcttggtctttgttggattgagcccatttgcacttagaatgccaacttcaagcagaccgattggtggtttccacagctgcttcattgttggccggagatcgctacagtactgtgtggactcatcgagcacatggtaaccaccttcaaggcaaatacgaagttgcacctttgcatagaatttatcttcctttagttggttcagatcaatcagtcctggccttctgagatcaaaccatgctggcagcactggcttatggtcagccctccttggaagccttgcgagaggtatcatagtttcaccaatcacttcatccttgttctgagcaactcgatcctctatttgtatgatcaagtcctcctcgaaaggctctgccgcgacaaacatcatctcctcattccacatgaagtttctggttggtgagcgagctggccttgtcttcagcatttggtggcccagcctcaccttaacaaatacatcaggtatgtggttctccattggaaatatatcctgtgccccaattacattgaccctcacataccacattctgggtacagggtagaccttcccacggatgtagttgtgaagatgggaatcaattggttctgatcctgcgtggatggcacttgggaagcactcatctgcttgagttccataccagacagcgagcatcagctcccctttatccctgtgcccttccttccccacaagtcgataccactctggtgccaatgggctgtcaggagggacccttagtggtacctcatttagatctattgacacccggccaacataatcatcccgaatgaagtccttatccttcacaataacttcaagtgacgttgactgcattacttccctagggaaagcaaacacctcatcccactcaggcctctggttcttctcaaagtgccttgtcttcattttgtagtttccgaggtgcacctcaacataaggatcaagactcccagtgatgtccatgtggggcagatcacgggccttaaccacacgcacaaataggtactgcatcttctcaacaaggtcgtatgcccctgccttttcaccggggatcacccggccgccaataacacgtccgccaccaagtgttgggcttgtttccttcagctggaattctacaggctgctgctgtggaccttgagcatacatcctcatgactggaggtggaggaccttcagctttgttcccgacagcagagtaggttttctgttgctgttgtccgtatgaactttcagggtagtatggctgcgcagtcattggctgcggacggtgctggtgctgttcttttggtaagtgttggaattgcctcacttgatctgctctggtctcctggaaaggatttggaatggcattggcggctacctgctcttgggcagtcgtaggcgtgcttatgaagtcgaactcctgaccaggagcggacactctgactgatggatcatctgtaaggaacaccctgagaccgagctcaccacgagcacgggataagatcgtgcgcttctccagggggtagtgaagaggtgtggcatctgagtggctgacaaaggatgtaccggagatccgaaccttgccaaggcaagtcttggaattgctggcgcggtttgcgtggtacacatacgcctcgaggtctttctcagtgaggcgggatggatcagatatgttgaagtagaactgctcgttccagacagggttgatatccctctctttgatggctgtgcggaacttctggtcatcgaattcgatctcgacataggggttgcatgtgccctgctcttttggtaggaggtcatgagcactggtaacctccaccccaagcttaagattgctcatcatgttctgccactagatcttgtacctctgcagcagattttctttatcctgaaattagaacaagaacatgtatttagaaacctgccattgctgaaaccagagaggtagctggcagcgtaactaccactttgacaaatgttcttggttgcaacaagagatgaaaaaacaaaagaaggttattgcagaagaaagttgtgccagctaaagttggttgggaaagttttgttgggatatcgaatgcccacaagatttactttttcccaaggaatcataagattggtagtaggaatcatcaggttgtttgaagcatatcccgcacagaatgttcaacaagaaaagtgttgacaacaacatgaaaggataaagaagaaaaagtatgtctcctttctgcagatctttgtattcacatcagctggatatcagtttttaactccctgtctggaatttacatctttacagatggaagctatctatcatgataggagtattctgcctcaatttcaaatctttggagggttgctacatacgtgtacgcttgaaatctctattaattacatcctacaagtatctttactacaatagaagtatctttaaaaaattcaattatacccagatgatgacatgttgatgcacacatagtcatcaatcaacatttagactctaaacacatattaaattcaatccacagatagctgcatgcatgcgtataaaatgtgctgaaataataagttacaagtaaaccctcagcagcatttggtagaccagatgtgaggggtagggaaagtgagaggccaccggccaccctcttttctgattgggacatccattgtaaccacataaacaattgatcaaaaatattattataacataacagaaacatcaatttttattaaaacaagaaaataagaagcataagccggtatgaatacgatgcctgtttactattactacagcctaattagcttcctggaaaacgctttgattaacagtgatatgtggtcagatgacataaatgaagaaacaggattctcaggtctgaaaggtagcatttgaattgttcaattaaaagcacaaatgggcatgagctcagaatggagaaaaaaaagtaagagaaactttgatggatggacaccatggagcatggaccatttcttgcacctttattggaaaaggttggcaggtgatggctaagagatgggggagggtgtcaccattggagttaagtgaagtgctccatgatgttgcatccatccatacatacatcagatatcaaaatcatgtttattcatgtgatagtctctattctctaggaagttcaggcacttcattaaatagatggagcaaggaccaaatgaaattaaattggagatctcaacagagaaaataggatctgttttcacatttttgtgcctccttggttgaactttggacggttttataggaactgaaatttcatctcccttcctcaactcagagtaccataaacaaatctgcagccctcatagtaaacaatctaagaattcttcctcccttacctagttacctaactaataactttcatccgttcaacaaaaataactaatacaaatttcaaaacaaaagaggggggtgaagaaaaagccaagacaaacataccaaaacttctctcgggtacaaaaacagaatatgattaaattcacccaaaaacagactaaatcagccacgcagaagcacaagacggactctagaaaagaactaaagcaaatccggaatattcagagcaaagcaaaacatgcagaggtgtcagcagggagggtggtaaccttgagagctacgatagaagccggcagagaagcttctgctccacgtgttcttgatgtcttcttcttcttcttcttcttcttcttcttcttcttctccgttttgattgattcaaagtggagaggaaagagagagagagagagagagaaagagaagcgtacgggactatgggttatctatcctcttcgcggcaacaaggagagaggaggaggaagatgaggacaactggccacacggaggagcagccggagaaaaccccaacgtatggtagggaaatgaaaacggcaggtagctagcgagaggaggaagaagaagacgacgaccccgaagacgtaagagagagatggacagggatagatatagagaggcagatcattaccccagcctatagagcgagaaacacatgcaaatagttgttgcttaattgcgtgttaaggttattaagatattattacactgcttgggaggagctgagccgaaaccagcgtgtgaaaaggggttaatttagaaacagcagtgcctatttaaacaaggattaaatgctctcttaggaggaacccaaacaggattgtgttttgttgtctgtacttgcattgctagtataagggtgaaaacagtagaacatggtcggaaacagtatattattttttatgggaacggtttttggttggtcatgaattttttctatatacatcaacttaactatttagtgacgattacaatatagttctgatagatatgtaaaaaaaaaaatcaaaatttatactttctccgtttcataatgtaagactttctagcattgtctacattcatatagatgttaatgaatctaaatatatatgtgtgtctagattcattaatatttatatcaatgtgagctaatgttttacattatgaaacagatggagtatattggttgaaaatggtaccacttttacgaaaatgatatttcgaacgctcaggaatttcagccaccgtttttgttataaatgaacaatgaaagagatttcgttttaggtaaaattaatcaaggattgttctgttcaaaacttactgttttttaatatgattattagatgtgattaaccaagatttttttatgtaaataatcaaaaggattgggttaacagcgacaggtggaatatacatacacggatcagaagcgtggcgacggatcaacgagaggctgtcatttccgtcgcattccgacgctgacccttcactactgtggctggccactactgttttgtctgtttatttcttggtgtttgcttgcttgattattattccccttttttcctgcttgctttcttgcacactaatacccccatttacttgtggtccttttgtgataattatcacgctgaatcccatcgttttttttaacagtccttacctatcattgcagtgctagtcaaccgtcaatgcactggcggtttttgggggcattatactggcgctgatttttttttatttggttttgttttaacaatataactacctaccccacgatgtaatactgctagtttatagtttagcagattttattaattagtcgtcgtatcatcacatgataattgcagatcagctctcgttttctttcttgactcgacatgcactaaccaaaaaactagtcggggactgcacgcacgtgccggtgcaaccagcctctctttttttcttcccatttagcaccagttaatttgtaagaaaaacgtactctctccgttttcaaaatatttggcactttgactttataataacgtgtttgaccattcgtcttattcaaaaaatttaaataattatttattcttttcatatcacttgattcattgttaaatatactttcatgtacacatatagttttacatatttcacaaatttttttaataagacaaatggtcaaacatatgctaaaaagtcaacggtgtcaaatattttgaaatggagggagtagaatttagaggattttaatctatatatgaaaatttccaaaggaaaggtctttgaaacgattaattaatcctatcattttcttgaaatcctataaaacagataatcctataaaattttagagaaaagttaacaatagctccaacctcttaaaagatatttatgtgagtctatctctctcccttgtctcacgtctttcctgtggtagagtaaattgcattggtggtacacaaacttgttaggatggtgcaatttagtacataaacttataaaatgcccatttcagcacatgaacttgtctagtttgtgcgaacgaggacctaaatatcattgttcggtttttttcatctttttctactatcactatatcatattctattttttattgagaaggtgtatgtctaatagcaaccttcctagatataagtttacatagtatattaatcagcccctgaataataagattagccatgtagtttccttttcgccttcctccgcacgcaccagacaattttatgcaccaaaacgagtattttacaagttcatgcactagattgcacccacttggcaagttaatgtatcggtgatacaatttacatccctgtgatatattcaaaggacattttttttatttttcttgtattttacaatcctttattttgcacatgcattcctatccaaatcatgcaatttttttatattttcttttgtataagagaccacttctcttttcaaaatttatgagcaattgcttagttttgattgactacgattttgttgcttagttttcgtcaagtcaatgagcaccaacaacattttgtcattgacgcgtgtcatgtgggtttgctagtataacaaccatcattattttacaatctcggaaaaaagggcgttttcatgctaatctaggattgatgattatgagctactagtatctatctattgcatcggatccaatagtttttggttccattatactgcacctattaaaatgggtttataatttttacagggataactaaaattaaaattggaaggcatgactgtagaacaaatatactccctccgtattgtaatatatgacgtcgttgattttttatgccattcttaaagaacatttgatgataaatcaagccacaatgaaataaatgataattacataattttttttgataagatgaaagaccaaaagtcgacaaaaaagtcaatagcgttatacactaaaatacggagggagtactttcaaatagattacactataatagattaatggtttaatttattcctttaaaactttcaaatatttttttaaaataattatggaaactaatggttagatttagattctactgctccctctattccaaaatataattacctttaaattttaaatttattttaaatatagctacctaatattgccactcttacaagtggtgctaaattatttgccactaaacccatatgtcatatacacatgagggcccacatgtcatagacagtgagtggcaaataattaattaccacatcttaaaaatggtaagaagttaaatgtcccaaaataaaagatgatcttactttctcatcctacccctaaccatctatatcacaccgactacttaactctaagaatataatgaggggtcgttttatcttgcaccataatccttaatatcctttaaaaccttcataagtaactataactattttgatatggagggagtactatcatttcagttaggacagagggtaccataaagcaagaaaaaaaaggatttgatagggttgtgtttagttcacgtctgattgaaattaaaacgatgtgacggaaaatttagaagtttgtgtgtgtaggaaaattttgatgtgatgaaaaagttgaaagtttgaagaaaaaattgggaacaaaaccaggccggagtactatcatttcaattatctgctgaacaatttttgcaggggagtcctggactgagtagttctagtttgctggtacactgcaaagaaaattgaatatggagtggcctggttgaatgtgctgagaaaataatgcagggtacagctagcgcgaaggaacaggagtatgggtccagacttgagagatactcaacgtaaaccatatggttgactgacttgacgttgacatggacttgttagagtacaagtcaagaaaataaaattcgcatagtactccttatgtttgtatttactggtcgctattacttttactgttcaaattttgactagtattagattttaaactgttagaacactggtggagaaatcctttttaatcccggtttacaactcctgtaatcccggttatgcaaccaggactaagaatctaaaactaaagatacccatctttagatctggttgaaataaccgggactaaaaatgaacggtatagtcccggttggtaactccaacaggagtaatatttttttttcttttttttcctgctagtatgatttcgaaatacacaaatcattcataaaattatccacaaatcattcgaacaccacaaatcattcacaaaatccccaaatacatcaagttgcattttctatatatccccaaatacatcagaaatcattcacaaaatcacaaaaacatctccaaaatctataacaaaattatccacaaattcatccacacatcacatgtcacacagatcaggaaaaaaaaatccacatcgaacagatcggctgtacacatcgcacatattaaggaaaaaaatccacatcgcacagattttacagatcaggcgccggccgtccgccgcctcgccggcctcccgcccagctgcctcgggctccgccgccgcctggggaacgcgccgcccaccgcctcggcagccggcgcccgcccgctggcgcctccccggcttccctcctcgtgcgacggccccgccgggcgcagcctctgcgcgccagccgccgccctccgcacaccggccgcggccctccgcgtgtcggcggtcgccgccctccgcgcgccggccccgcggacctcggctcgctcgatctgcatgcagcaaagaaaaaaggagatgaggagttgaaggagaggataaggcaaagaaaaagataagagagagtaagaataggagatgaggagttaagaggataagtcctaaggattatatacggtacatcaaattttagtcccggtttgtgataccaaccgggactaaagatcacggtgatctttagtcctggttattaacacaaattgggactaaagatccaaacggaggggcctgacaacccctgacagcatgtgaaccggggctaaagatcacatagccccatcttgcttataaactaggactaaataccatctttagtcccggtttttactgcaaccaggactattgtggtttttggccgatcaggcaaagatggtttcttcagtagtggatgtgataccagaaacaaaagtttatgtgaaggacaaaagtcacaaaacacactttgataatactgttgacagtaggaatcggcaataaaaaaaggtagcacacaagagctaaaataaatgggttgtgagacaaagttttactagataggttcggaccctctctatcgacgggggatacccgtaaaccggatatagagggtattggggtacgttggtacgaggatctatgtaatacgacatcaagcaggcagaaaacaaagattatactggctcaggccccttggtaggtaatagccctaatccaattgatatgggattatatgatggaaaccacatattacaaagggaatagtggaactcgatggtattgacaagatcgtagtcaacttgatccgactagatcctcggcgacttggctccgataagctctggcttcgtaggctgtggtggatgtgttggctctgagattcgatgccttaggtcctcccggggggtcccttttataccataggtcaactggtctccaagtaggactcggagacatcagacccgatacgatacaatgacgacccagttctatccgagtaggactccttacatctgtgaattccgtaatggatttccccaacttatgccgaaaacgtccgcatacgcgcaagcataccatgttgatatgtgacgtatatcaaagggtagagggtataactttcccgtaaccctgacagtagcccccgacttctgcttgaataaactcgtgaaaccgatcgcgacttctgatgtcgaagttgtcgtcgttctcggtgtgatgaccgagagacaagaagtgatcgacaatgccgggtgaagctcaatggtcatgagtgaatttaaattgaagtccgagaaactgccgcgcgtaacggacccagaaatttccggcggccatctctcccctttccttggaattcgcaccgtcaaaggtgcgtctatttaagggagttttggttctcgattcacaggtctgagcagcgaagccgtggagcgctgtgtcagccagatgatgatcagtggcccgacaatggcaagaacgtccctgttcccctttgcgagaagggggcagccgaacgcgaagctaccatcaatgtaagtgtactcgacagctcttttgcacttttttcccaagatcgcatcgtgacttcataaagcgtaggatctctctctgactgacatcatcggaccgctcgtggatcacctggcggcggcgtcactgaaggagaacatcgccaaggaggtgtccgatgttgccgccgctgctgccacaacgagtggcggcaacgttccgaagagggggaggaaattctcctccgtgatcggaaatcgtcggaagacacccactccctcgataagcttcctggtccttcatcgcgtgatcggcaaacttccaacttacatcatacccgttatgctccaggcctcagacgcgtctcccccgcctccgcgacagcggcgggttgtgatgcttggcgagaagtaagcggatgaatttgaggttttgtcactttgccaaactcatttagcctgtctcaattgcaacctttcgcagagcggcgcaggcaaaggcggcgcaagacgggtctggaggaacctccagcgcgtctcctgctgtggcctcgacagacgtcgtggccgtgcccaggagctgcgaagcgacgcctagtggaccggccagtgatcttgcggctggtcggggtccgccggctgccgtcctcacctgggaggagctccaggtcgagatggggcgcctcctcggggctggtgctcgcggcattagttgtgagatcgcggaggcgagggcggcggtggcgtcgtcggcgaatgagcgcgccgatcggctggcgcgtgatctggcagaggttcgcgaggacctccagaagatgagagaactggtggccggcaacgagcgacaacggcaggggctcgagcaccgcatgtcggagcttgagaacagcttgtcggaaatccgtggctcgttgcaggtcacctatactggtctgcaccagcttgccggggagtgcggtatcaagtccaccatcccggcgaatcccgatgagttctcgctgacgtcttctcttgcggagctggtgacggcgatggaggaaattccctccaagcatgcggccaggatcggagaagagacgtctaacgggatctacaccggggcgtgccacgtccttgcgtgtgtgaggctggcgcaccctgaactcgatctgtggaagatcttggatcagggggtggctagcgacgcgcacaaggatgtgatggaggaggtcggcgatctgggggagtccgtcctcccgcttttttaagagtagggtcttagctctcttgtactctttagtcatgctttgtaaaacttttattggtcccaaccgccctagtgtgtgcggtcattgccttagctttctttagcattttgatcttgagtgctttgttgtcgtttgtagagatgttgatgtcgaggatgtccagcagcgtgggcagcctgagttgccagtggtcgttccgttacttacgtccgagccaaatgtgccggagggcgatgtagatcgaagttcgcctgtggaaatgagcatggcgacgactcccttaggttggttgtctttgttatcatttccttttcccttccgtctggatcgacttgatttgttgtgctctcgggagagaagagcagcttgacttagtcgtttccatgctgagcaaatcccgagagtgcgcttgctgaccaggattgtcgcatccagtattgaaggacgaagtttgaggtcgcgggactcgagaggactatgctggaagtgagaaaggaccaggccatggagacactccggggtcgtgaggtgtggttcaactcgtatctgaagagttgttgcacatccatgtcgagagtctgtagagagctccgagtaccccgtggggatcccgagggatcggcagccggatacatctcgtggctgaatggagcctgcgcctagctcgaaggcatcggtcaacgtctcgacgaggccttgaagcaggagtgtcgtcgctcaagccgatatgctgaggggcacgtgttggcctgcatacgagatcatcatccgcagctgcaccttgagttcctccgcgaagggttttcacgttctcggaggaaccctgcggagatagatggcctggcgaagttgatggcgccgctagtggagaaggtcttccagtcgatggactggcgttggccttcctggtagtctctgtgttctatcacaaatgtcttaggaaaaagtgtaatatagttttggactttgatggaattgtaagaaatactagtggaatagaaaagaaatctatctaactaagctttcttactctggatgtagtgtgtatgagtgtcttctcacttcgcgactttgatcagtcgtttgagttatacactctccctagcccccagccttgtcatcggagaattcttctcggaagataaggctcttggacctttgacctgcctcggttgaacaagcactgatcctagccctcagtcatgaagttggaaagtttatttccgattacacggcttggttaatacgcatggcgagaactcttacacgactagatcttacatggtctttcatctctacaggatccgacaaggccttatcggctctgggcgtccccagccgaagttcccttaggttcctcggaggccttgtcaagatggcgtaaagggacatgaggataggtttcaatgctaggtgtcatctaggtacgggatcataggaaaggaacactttgattgtggtcttgacctgaaaataggctttattgaagctgtaagatgtcttacaagtatggatactattaacttatacatagaatttacgtaattgatcaatgttccaggaatttgccaactcgcgaccatcgccgtctgcaattttgaatgcgcctggccgcagaacttgtgtgatcgtgtacggtccttcccatttgggtgagagcttgtttcgccctgcttggctttgaacccgtcggaagatgtagtcgccgattgaaagcgtgcgtgctcggatgcgcttctcgtggtaacggcgaagggcctgttggtagtcggttgcttgaatggcaactcgttcgcgatgttcctcgagtagattcacatcgtcgtttcgctgctcctcctgatcctcatcggaatacttctgtacttgtgtactttgatgtcgtagctcggtggggagcatggcctctgagccgtacacgaggaagaagggtgtctccttgttagacgttgtcggtgtggtacgcgcgacccatagtactgatggaagttcttcgacccacttcttgtcatgtgacatgagcctgtcgtagacgcgtgtcttgattccttgtagtactatgccgtttgccctctcgacttatccattgctctgaggttgagaaaccgaggcgaaacagatcttgactcccagcctgatgcagtaatcttggaaatcggcattgatgaactaggagccgttgtccgttatgatacggtggggcaatccgaatctgcagaatatccctttgatgaatttgatggcgttgttggccttgatttcccctgtgggtgtcacttcaatccacttagtgaatttatcgattgccacgaataggaacttgtagccgccctgtcctcgtgggaatggcccgagtatatctagcccccagcacgagaacggccaagtaagagggatagttcggggtgcttgcgctagcagttttgtgtgtttactgtggaattgacaggcttaacaccgctgaaccatgttgcaggcgtctttgagggcggttggccagaaaaacccttgtcggaaagcttttccgactaatgtccgaccggcagcatgtgacccacagatcccttcatgtatgtcgaggaggaggtgtctgccgtcgtcggacgagacgcatgttaggagtaccccgtttggtgccttcttgtatagatcgttgccgatcatacagtaggacttttgctttacgggatattttcttggcttctgcgtcgtcttcgggcaactcttcgctgcttatgaatttaatgagtggggtgcgccagtcgtccgtggtctcaatatcggcaacggcgcgctctgcctctgtagcccaagagctggtgtcaggggcgaccgggctatctttgccgcttgcctctttcactgatggcgtcgtcaggacgtctagaaaggtgccaggttcaagtggttctcatctggacgcacgtcgtgctagatcatccggttcgatgttgtctttgcggtatacatgtcagacctcgatcccatcgaaccttttttccagcttcctgacttctgcgagatacttggataactcggggctagagcacttgtaatctttatgcacctggttcgcgactagttcggaatcccctttcacgatcagttgcctgactctgagtgcagccgcaactctgatcctggcgagtagtccttcgtattcggctgtgttattggttgccctgaagttgaggtgaattgcatgcttgaattgatctcccgaaagtgatgtcaagatgaatcctgcccctgctccctggtgttgatgaaaaaaatcgaacacaccggcctgggagatctgcttagctccagtgcaggtccagagattgatgagatgcgagcgtgccagtcagtttgatcctgcaactgacaagatatacaaatagtagatcaaaacagccgatcggctgacaagccgatggagtagttccagccgatagcgataatagccgatgccgataccagccgatagcgatagggtttaagcaatcggctatatgtccaatgtagataacgatataaaggcaatcggctgatgataataaaatataacaataatatagtccagtagaaaccaatcggcaaataatgatatgacaaataagcattgatccgaaggttaaagcacacatcggctggaggtccgatgtcatgaaatccacaagattagattaaacagtgaaacctttgttgccatcggctaaatccaacttatatatatatgcaatccttatgagccgatgcaacgtccagataactcaccggctgaaaccccgatgaaacccttattagcagtaaaaaagcaggctagagattatggttctaagcacgacttagtagatcaaacttaactgatgcagcactaagtatgaaaagaaacataatatctagacaatcaagccgttgactttgttttcagggtggtagatgtctaagctaatctaatttagcaacacgatttagccgatacctgcagaaaccctaaaacgagaagcagccattagagctaaattgatatgctaagactagattaacagagacatatgataaataggtaggcaaatatatcatccaaaccagagcaatccaagaggttgaatgtactcatgcagccttgaacgacgccaacgtagacgatacaattgcctggaccaacggaacattggacttaccccttcaccggagatcgaacaccgatgcagccccgcgtcgggtgccaagtcccgctggacgataaaataaagtagaaaaggtaaaaggtggcgatgcgccgaattgtattgatcgtgaggataaattacataaaccccgggtgtacatatttatacccatgggttgatacaagtccttgtcggacaagaaagaaactttactaaagataaaaggaaaagataaagtccttataggacactaaacacactttcctgaagataaaaggaaactaacgaactattcctaattaatagataacttgccatgccgcattctctttgaactcagtctcttctggataagcttcctttagtagatcaatttccttaaccgaatatagcaagaatccgacaaccgacgacttgacaactctcatcggctaatctcaggacatcgaagccgatgctgactctaagccgatgactactccgggcttgccaaattccactgttaacacctggctgttgagtgcgcccgtcaaacgccattgtccacgtttcattgtcgatttggttgtctgacctattatcaggcatggtccaatcggctacaaaatcggcgagaacctgggacttgatggctgttcatggcacgaagtggatatcaaattgacttagctcgactacccattttgcaatgcggccgacaacgtctttgttcctcacgacttcgtcgagagggaaggaggagacaactgtgaccctgtgggcttggaagtagtggcgtagttttcttgatgtcatgattactacgtagagcagtttttggatctatggatatcttgtctttgcgtcgtggagagcttcgctgacatagtagactggtcgttgcaccttctctctcgacaataatgacagtgcaaacggaatatggcgtggcggcaatatagagaaataattcttcattaggttgagggcaataagtacaggtggatttgataggtagcgcttgagtgcaatgaatgccttttcggcctcttgtgtccatacaaatttgtcttgctttttcagcagagcgaagaaaggttgtcctcgttctcccatcccagcgacgaacctacttagtgccgccatgcatccagttagcctctgtacttccttgagtcttgtaggcgacttcatgttctcgattgccttgatcttctcgggatttgcttctattcctctaccagagacgaggaagccgagtagcttgcccgatggtactccgaacgtgcacttcactggattgagcatgaggcgatatcgtcggaggttgtcgatcgtttcccacagatcgtcaatctgagtcgcttgtcttggtcttgataacaatgtcgtcgacgtaggcctcgacattgtttctgagttggttgctaagtgcgccctggaccgtgcgctggaaagtgtttcctgcggttattagtccgaacggcatcttaacgtagcagaataccccgaacggcatgatgaatgctgtcttctcctcgtcctctctcgccatgctgatttggtggtagccggagtaagcgtcgaggaagctcaacaactcacagccggatgttgagtccaccagttggtctattcgaggaagagggaagtgatccttgggacacgccttgttgaggtcggtgaaatcgacacaaattctccatttcccgttggccatccacaccatgactgggttggctagccactctggatgaagtacctctatgatgaaaccagctttgagaagcttgtcgagctcttctcgtatggcttgtttttgatctggtgcaaatctccgcagtttttgctttacttgcttggcattgggtcgcaccatgagtttgtgctcaatcacctccctgggtacccccggcatgtcggacggctgccaagcgaacacgtcagcattgtcgccgaggaaggtgatgagcgcgagttcctatttctcgtctagtgatgccccgatcttgacggttttgtcggggttggcgctggagagtggaacgatcttgattgcgccgtccggcttcagcgtcttgtttgttttgctcactttcttgggtggctcagctatggcgggtgggcttggcgtgtgctcgaccatgtcgaggctccgcttgtcgcattgtactgccagcttagcgttcccttgaatagtgattgttcccttcggtcccgacatcttgagcacttgatacgcgtagtgagacgcggccatgaacttcgcgagtgcagctctcccaatgatggcattgtatgctgtatcgaattcagcggcatcaaaggtgatctgttctgttcggaagttgtttgcttggccgaaagtcacaggcaacgtaattttgcccaatggtttggacgatgactgaggagtgattccatggaagggttgatcggtgggtgtcaactcgcttcgtgggatccccatcgcgtccaaggtgctggcgaagaggaggtttattaggctgtcgccgtcgatcagaactcgtgctaccttgatattccgaatagtgggttcgaccacgatcagatattgccctgggatgacagcagtcttggggtggtcctcttctgagaattctatcttctgctcggaccacttcatgttgggcgcagccccctgccatgtcaaatagacttcacgttccactttcttgtattctcgctttgaggagtatgccgtggaacctccgaagatgtgtgagacatgaatgtcggaatctagttatgctgagtccgattcctgagtaggcgccttagcgtccttctcaaccacatgtactcgcttgcctttttccgatgccatgtgttttgcgagtgactttttgaagacgaggcaatcttctagagagtgtctgtccgtcttgtgtatatggcaccatgctttcttcatgtcgctgccttgtgggtctaggcacttgggagggtccgcgtattctgttgcgaaaacttccgattgagctttcctcttcccactcttgcgatttttcttcttgctcgactcaggtgcgtccttggctggtttcttctctcctccggtcttcggtttgtcgttcttgcgtctcagtgcgtcatccgcatgagcgcatcgatcgacaatttcgaataatctccgagtagtcgtgatgcgcctcattgccaactcctgagtagtatagcgatctctgacatcggatttgaaagcgcgaattatagaagcattggtgatctcggggattatgtttctgcactcgttaaagcgccgaacataatccctcaagtattcgcccgggttctgtgtcaacgcatgtaggtcgtcttcgatcgcgtggcgcttgtaagttccttggaagttggctatgaattgctgccacaggtctgcccacgaagagatcgagtaggggggagatgcatcagccatgaatgtgcagagcctttcaatgcggttggcaagtaattcgccaatgcgttgtcgtccgctccggcagcgtagagtaccatggagtaaacctgaaggaactcttccgggtcggtgctcccatcgtatttctctattgctccaggtcgaaatctttcaggccatcggacatcccgaagtgaacgaccgaaagctctacacccagtgctgggggcagtgggttgtcggcgatcatacgttcttcgtggatgtctatctgatgatgaagatgacgaggatgatgatgatgacgatgagtcgcttggttccggcgtgcgattacgaggacgtcgaccgggttctcgagaatcctgtcgtcgtctcccgttgttgtctcggcgccgatctccatcatcgtcgtcattatggcgatttcctcgaccagtatcgcctggcacccgccgttcacgatcatcgtgatcgtggcggttgtggcagttatcacggtctcggtcttcgctcgaacggcctcctcgttcttcgttatcgtgacaccgtgaagagacgcgatgtcgggaacggttctcgttatctcgtgtgcgtcgcgcctctcagcggccattcaggtgatcgcggagatcgccaatgctgcgaggtggaggggtggctcgatgaggcgattcccgctgttcagggttttcaccattagcatcgccagttggtggctgttccgggtgcgctacagcagcggcctcttcgaacgcgttgctgaggttggtcactgattcccgtaatcgttctgtccaacgtgcgagatcgtcgttcagaacgggatcgtagggggtttccctcagtattgcgttgacggctctgatatgctgggccggagtagtcacttgattctccgcttccgcattggtgcgcgctgacgcgccgacatcgtcgatagccaatacctcacgcggcgtgctcgttgtcgatgatccatagtcttcgaggaggtgcaagactgatggttcgtggggatcgatgtcgattaccccaacaaatcgatccgaaattggcgtcgctccttgttccttgtctttatccctgatggggatgtgtgactgctggaccttaggagatggcgccttcatggcgctgagaaagaccttgcagctcgagaggtcgtgattctttgtcttgtgaataggacaatagacatcacgagttggagaggtacgctgaattccatgctctttgcaggcacgaatttcagcatggacgttgagaaagacccagcaggcttgcagggtgtttttcctggttttgtggataggacaccaggaccttgtcaccttggaagtaatcctcgtcggcttgtgattcctgtcggaaagacaaggcttggccgcactaggatccttcttgggctcggatgtcgtcgacgctccgatctccgcttcggcgggaggatccttcgacatggagtcgccccgggttgtagccactacgttctcgtttccggccattggcggaccagctgagatcggcatagtggtataaaccggaaagacaatttcgccgacttgagtccacaccagtgttgttgaagtaggaactccttggttgaggttggtgttgacactgttgtcaacgaagctggatgtcatagtagtagaaccttgagcaccaagtccccctacctggcgcaccactgtcgacaggggatacccgtagaccggatatagaggttattagggtacgctggtacgaggatctacgtaatacgacatcaagcaggtagaaaacaaagattatactggttcaggccccttggtaggtaatagccctaatccaattgatatgggattatatgatggaaaccacatattacaaagggaatagtggaactcgatggtatcgacaagatcgtagtcgagttgatccgactagatccccggcgacttggctccgataagctccggcttcgtaggctgtggtggatgtgttgactctgagatttgatgccttaggtcctcccggggggtcccttttataccataggtcaactggtctccagtaggactcggagacatcagacccgatacgatacaatgacgacccagttctatccgagtaggactccttacatctatgaactccgtaatggatttccccaacttatgccgaaaacgtccacatacgcgcaagcataccatgtcgatatgtgatgtatatcaaagggtagagggtatacctttcccgtaaccctgacactctcgacgagaagtaatactctgctcttatttaaggattggaatctaccgggtgttgtattgatttgacgatcttggtgttggttgtgcccttgagaggcctcatgccctctttatataggtcgaagcgcaagattacatataaaaacctaacctacggcatctactttacaatattgtcgaaataagactttaagacgtttccttaataccttaatcataatccgttacatattctagagatataacctatcctctacaaccagtcggataaaccagccatgtggatataaggtactcataatctccacaaatacaataaccatttaaagctttgttcaaatcaacagttagcttgagtctttcagttgcatgtaaaacggagtgagtgattagtacaaaattaattaattaagtattaactattataaacttaaaaatgtatttacttgatataaaaagtctcttgtaaaatacagatcatttagcagtaaaaaagtgtgcttgataaatgcaattggacgcaacctaaagtatttatagaactttttacgattaagataaatggttaaactttatgtatttgtactccaacgccaagtatttgtgcactgcatcagttagtgcacaacctagctagttcttcaaaacaattattcaagcacgcatatataatgcatggctaatgatccaagtatgtagattaaataagagacatgagaaggtagctactccgtgcacatctttggtggaaaaactagcctgactagggtaggggatcaaagagatgataattaatttactatataatgaggtactagatgacatggaaatggaataagataggcaggatatgttccccgtttataatgtccttcctcgatcggaactgctaacatccccgtttagtataaggggatgtttagttcatactacatctttggtcccgttcgattctgtaactgggcttggatgaaaatgaagattttcatgtcacacttttcaaattgttaaacggtatgtttcgtgcgaaaattttctatataaaagttgttctaaaacatcagattaattaatttttcaaacttgtaataattaaaacttaattaatcacacgttattaccacctcgttttatatgaaacacttcatcttcaggagattcaaacaccatagggatgttagccgcttcttaggcaagtttgaaaaaaaaaagttttgaagtcatcaactcgtaggattgtgcggttgaaaaattaatgtgcctagccatgatcacaaatcatcaaccaaactcttcctaagtaacgtgtctaaactttatttgacaaatttaaggcattcaattaaacactccctaagtattttttttcagccaaaagttaatagatattttcatcttaggacgtgtttggctagtgaaaaaggcaaaaataaacatttagctaacccataaaaaacatagcttgtctttttatatgcatattttagcatcaatccaaattaaactactctctccgttccaaatgtagcaatctaaaactaaattagattttttgcactaagaatctaaacacatgttcctcaatccattttcacgctagtatcctctagctatattttataacaaagtgagcgtttaacttacacacaccaccaaaattttggtacaatatcaaaccaagccgatccttagaccagcaatctaactatgatgaacgtttacttacactacatgaagcaccatctacgtaccacacatcacatataatagctttctcagtttctctgggtaaatatagttatggggtgtttaaattcaggggtgtaaagtcttggcgtgttacatcgggtattatataggggtgtggtaaggagtgttcgggcactaataaaaaaactaattacagaatccgtccgtaaattgctagacgaatttattaagcctaattaatctgtcattagtaaatgtttactatagcaccacattgtcaaatcatagagcaattagtcttaaaagattcgtctcacaaattaatcgcaatctatgcaattagttatttttgagcctatatttaatacttcatgtaggtgttcaaacgttcgatgttacatgatgtaaaattttggggtgggatttaaacatggcctaaatatagcttttacgacgcttacgacatggttacattttgcggtaatattctgctaagaccatgagagtgtgtctccgcaccttttttttttagggtaaatttgcttgatttgatatcatactttcacaaccatgagaagagcatagtaatccggtggtaagagagctaccagtactattgactgccagcgtttgagtccccccgtactgattttcacaccatttcttctctcttcgctgttacgtaatcgaatttttcggacaaaatccccaataaattataagcggatcataactacttctatatgcaaaaatcacttcccagatcagatgtcggtctgctataataggttattctcgcaagcataccggctggatagcaagtgggtcccacgaattttaccacacctctttttctcatcctcctcttcctctccactgcatctttcctctcccactcattttattcactccacaccttttcccacttctcttctgcattcctctcctcatctcttccccttccgtatccccattctcttctctggcggcaagcgggcggcgacggatctaacaccgctgccctcggccccaagaaaggcaatgaagatggtgggcagcgacggtggagttcgagggtggctgatccgtcgtagccatcctcggccctagagaggcgatgaagatgttgggcagcgacgtcggagctggaggatggcaaatctggcgctgctgcccctaggcctagggaggggcgatgaagacggcaggtggcgacggtggagctcgagagcggcaaatctggcgccaccaccctcaaccccaggaggggcgacgacgagcccgagtgcaacagaagctagggtttcagcggaattttctttttggtattctttaaccaaaattatttttacagtcggtcggcttaagcgttcgtatgcgaaaataccgaatttaatttgcatgcggttgctatacccgcatataaaattatcgattttcgcagacacctaggtgcaagtgggccacccatgcacctatgaaaattgatctttttttagaaacacattacaaatgcaagcacccaacacccacacagtcatctctatgaacgtgcacacacacattacctctataagcatatccgaaagactataccggcatatctatcgattctatagttatatgcgaaaatcttttatgtagtagtgcttataatcgattctactatcagtatcccatattatcatctttcaaattaaaatggagtatttcacaactgtagcaaccgtattatttcacaccacacgcgttcggtgtgccgcgtactaaaactcttttttcagagatcacgcggcattattgatcgttctctcactggtttaatttcgtcgtaattgcgacatgacaggagtatttgtcagcaactagtattgaaaaagaagagcgcctaaaagaatctgtggcgagcgctgagtgctgcaaaaacatcatcatgagcaatctccatctaaagcgcaaacaaaccacaaattaatcactttttaaaaaaataggatagaggggttatttgagaggtcaagaatccgaaaaactaggtttctcaaattctaggttctaatttgttttatttgttttatggattctaatttttaaagtttactccatccgtcccaaaacagacaaactctagttatttatctggatatacatcatgtccagttacgtagctagagttttttttttttaagacgaaggggtagtgataattttaactgtttaaaaaggtttctgacagctagaaattctgaaagaaggatagaggtgtcagaatgttccaaacagggcaaaaatagaatatgcactgagccgaggggaaaatcagataaattaagagaaaaatagaatatgcactaagccgagggggaaatcagataaattacgggctcccacgtggacgttccgtaaacgacaattcgcgtgcggcactgcggcccaccaccacgtcagatacgtactgatattttcaagcggagtagagtatacgcatgatgctaaaatctattcagtatacgctttctatttttttaaaagagttaaacagtacaacatatacactcaaaacacacgcacactaacccctataaacgtatgcacgcaaatcctacccctatgagcatcttcgaagactgggccgacaaatcctcgagattgataaagtcatcacagacgcctcgttatcgacggatccatctcctaccactgaaaccacaaagctgttaaatcctaaaaaattcgctcccatggagagtcgaacccaggacctaaggggaaaatttgctcccatgagtatacgctttttatttcatcttatttagataccctttcataagtccgatcagttaatgatgattgaggtacaaacacgtgaatattatatagataaacaagatcacttgcgagaaaaagagaaccacatgctatctattactacctccatcctagaatataagcatttttagagttgggcacggttattaagaaagtaggtagaagtgaatgatggagggtggtgattggttgagtagtggaggtaagttgaaaaagtgaatggtggaaggttataattcgttgggaaaagaatgttggtggagaagttatattttaggataaatcttgaatgctaaaaagttattatattttgggacggagggagtagttgtcatgttgattcacgtgcatgttagagcaggtacaatagtaagctataagccagctataaccacatatccagaagaaaagagaagagatagaagaaagcgggctacagatttgtagtcagctgcagtacggactctaagatgttatgtgtgtatgagaggtgggaccaggtattaatggtatagcatgattttatagtcaactattgtatgaatgagctattagattaactatagacgatttagagtaaatatttagctatcctattaaacttgctcttacgaggctaacatatcgttacactagcacattttccttttatagaatctttgatgacttatattttttttatagacagtatattatttgtaagattcgtttgaactgtcctatttcacttaaaatatgtaacaaataagtctaatattgaatatattcaaattaatttttttttctgaactgttctcgctggatagttaaagagttacttcctcagtgtcgttactttcaacgccgtgataagttaattctctagcaatacagttatttctaataccttaaatagttatttatgttttatgtttcttagttactttcctctagaagtgtatttacttataatattatgaagagttccgtctatttttcaaaaagttaatttcatccagtagcgtagttacttttaatataatgaaggattactttttatataacgtaagatttgattttttctaaaataatacagtgattactttaaataaagttggacatcttctctacactttagttgtaagtttattccacatagttttgtattccaactcagtcgtaatgtaattacttctaatgctatagagagttacttctattgcatagctaggttacttctacaatttaaataaattacttttaagttaataaaatgtttgaatatatttaacattgatcttgttttatctcatattttaagtggagtacaatgaagcaaatagattttaaaaataatatataatttaagagatactccctccgttctaaaatataaggcacaaccacccttaactcaaagaccaagaaacaattattatcatctcctagtttgaatcactctaataaatataatgcatacatctaatagaattagagatcttgaggatggaggatttaaaaaagtaataatttaatggagaaaaggtcctaattaattatatgcatgcatgtatatcttatattatgaaacatcttaaaaaaaatagttgtgccttatattatggaacggagagagtacaagttatcaaataggtaagaaaaaaaatacaatttagctaaggagatttatacgtggaggaagtgatcgcggctttaatcaaaccaacgaccgatcgttgtgtagtcgtgttcgaagcagcatcagctatctttcatatacggtacaaatttaagccgccttttgaaggctaaagccctgcaaaaatcgttttgtatagtgtcagtcggatatcttgggcccattgggccacgtctgcgcgagggcgaccggccgcgtcagcgtgagtcggctgacgctgacgtgtccgcacgcctgattcttggtctaactcatgtccggtgattaaggttaatctctagatatatcatctgtttacgtaatatccttcattcacagatataaaaaatattacaaattaggatgggttggatttgactctttctacgataacgaacctgaatataatcagtttaggacttggtcaaatcctattatagattgtaatttttggagaaaaaaaaagtaagtactccctacgtttctaaatcttttaacaccgttgacttttttaaatatgtttaaccgttcattttattaaaaaaatttaagtaattattaatttttttcttataatttgtttcattgttaaatatacttatatgcatacatataattttacatatttcacaaaagtttttaataataagatgaatggtcaaacataaacttaaaaagtcaatggtatcaaatatttagaaacggagggagtacttgttttctcaactacctattttgtaaatcagtagtaatatattcatatgatataactagccatgcctatataagtagggatatgttataagcaaattagggatacaattaattttagatccggtggttacataagtaagctacgcgagtgagcgcagtgggaagatgggaaagtaggactgctaatatatataatatatattcttcagccgttggtcggctttatccatttcgcggaagacaaaattaacaagtccatgatgtcccgtagttaattatttatttacagctttcacatacgtacaactataaataccttcccacaacaacaataatataaggggcaattttatttttacccctacttttgatcttcaatgttgattttaccctgtttttaagggtttttatttttgcccctttttttttttaaatgaaagcaaactctacccctactttagatggacaagttgacggcgttaaatctttggcgaaaagacaatcatacccttatttgatattgcatatttgtctgaatgtttatttaataactgtgtatttgccccctttttacatgcagcttgtattttgataaacttttacaaatatgataattttgatagaatattaaaattttgatataatttttccacaaatttggtaaaatttgggtattttgaagaaaaaaagacagaatttgggcacaatttcggcatggtttttacacagctaacaaaatacatgtagcaatcatcacaaaatcacacaaaatcaagcaaatccaaatcatgaagccaagcaaatacagtccagtagcatgtcgctcctccctatcgcctgtttacagccgagccaggttgatgctgcttgccgcagcgtgcacctccgtcgtgccctgcttgccaacagcttgcagtgcccctgataactgctcgctgcgcgcggcctgctgcttggcgtgctcgccgccaccgcttggccgggccacctgccgtcgcctcctctctgcgtcgagccgtcgccgccttcccgcattaagccgccgatgcctaaccgagacgccgccgtcgcttgctcctccgtcaagccgctaccgtctggacaagagcccaccttcgtcttgtcccctcgtcgagccgccgtcgcctggcctgccttgatacgcgccgccttctgctcgccaccataggtgggattggggaaggcaagaaggacggctttggttatggctcaccaggggtacaaaggtccatcaacgaattaaaaaatcactatttctttttctctctacgttttagctccataatcctaggtcggctaacttccgttaaaaatagggataaacgtctatttcatttcagaaaagcaggggcaaaaacgaaaaccacaaaaaacaggggcaaaatcaatatttaaacatgaaagtgagggtaaaaacgaaattatcccataatataaagtaccttagattaaaagaaactacaaaatattatcttttcttctttttgtttttgaaaagactatatatcgtcacgatggtcgagttagagcatcatcacaacaccaacatgtctagtcggtcatcaacagatcgaacagaacgtccttatcagtacactattgagagagaaaagcacgtttcggcacatcgatcattcagcgtagacccctgagaaaggataaacgtgtggcatcagatcacatattgcaccgacgatcatcacacacctaatctctccatccccaactaacagaaatatactggagtagtatctattaatttttcaagtgaattaattagtccgttaccgatttgtttggtgagtagtgatttaatttagaagtacgtacacgcgatcgatctcggacatttcagctacaagtgcgtgccagcggtggtgtgaatataatgaaattagccgctccagccgatatatgtagacgtgtactaacacaaatactctatccgtcttataatataagtgattttaagtttttacttacactatttgatcactcgtgttattcaaaatattataaaattattcttttacttactttattatccaaagtactttaagcacaattttttaatttttatatttacataaatttttttgaataagacgatttatattatgggacggaggtacatgctagcactgggagagaaatggcgtgtcgtcctcgtacgcagacaaagccatccccactagcttactgtacgtacaggttcactgagaaccagtacatgtacgccgcgcgccattaatttttaaagagtaaggtatacgatcggtgaattttttttgaaaataatattattttaatggaaaatcacaaaactttaggtcggctagacgaaatcacaagtttagcgccctgtcgaactgggacagggtactgtcgaactgccctagttcgacaggctagttgtccaagaaaaaaaataaaaaagtacttgctacaatgcccgatagggacgtatcgaacagggggagttcgatagggcgcgtggcatggacgtatcgaacagcgggagttcgataggcagcgtcgctacagtgtcgctacagtgtcgctacgtctttgatagagaaaagactggactagcatttttgaatgatgcaacaacgcaatatatgatgttgttgttgtttctttgcttccaagtcgtaggccggtctcctcagtacgtgtggatagatatgccacaatgaagctttttggttaagacgtcacaacgaagctaacatcggtatctctgggtaggtttagcttgaaaacgagcccgttgcagtcttatggaatgaaacaaatgaaagaagaaaaaataatgtgcacaaggaaggcaagcccagctataaaggtgctggtcacctcacattcatatgcctcagcccaagtgtttctagcggtcgagcccgatcagatgcaacggcaaactttattgaggcccaagttcaagttagcaaaatggcttcttttaactttgttaagttttgaagcacaacgtaggcgagtagagataaaaatagagcggatagcagagaggatagcttccatccgctctaaagaaaaacaaatacgaatataactcggatatgaaaatgaatgcgggtaagtttttgctagatgcaaatatgtaatcatggtattcgacggaaacaaataatacgaatatccagtgaatagtgttatttggacatcgccaaatgcatgaaacatgtcccacatctttttaactcaccttcgatatactccctccatctcataaaaaaaccaaggatgagatgtgacacatctagttctatccagattcgtagtattaggatatgtcgcatctcatcctaggtttttttttatgggacggggtatatctttagagtttaataatagcacaccccactagcactagctcgcactattaattgagagaatatactctttgtctttgagtttatcttagttcaacgatttaccatagacattatcttttctataatataccggtaagtttatcaattctcctacaatataccattatccattgagttgggcatggttttaaaaataacactaacacacttatagatataaaaggttaacaattgttttatcctgtcataagtctcaaaaaaaattatgaatttttttagcctctttacacaatgtatatgttcaagatttttgtatttctactttttataaaatataatttatcagttatatgttatatagaatatgttttgtgttgttgtttttaatgtaaatcatatttcttaggctacacaaaaatatttttatgctattatttttgcataactaatttctctctcatatactccctccatctacttttgatgtgtatatttccaaatctgaaaattttacttttgataggcatatttcaatcaacaacctatcctcttaatgaatttttcggatttaatgcgtgactctctattcttccacacaagattggctacatgggcatcgagaaatataaatattaatgaatcgcctgtttacgggaaataactagtagcatgtttaaatggataataagtagaattacttatccttagtcattgtgccaagatgcaatatgactatcaaaagtagatggagggagtaccaaacaaaaataactatgttttttaaaaaatagaaataccagaaaaaacatgaaacttatatacacacttgagtaaggaggctaaaaacttcatatttttaaaaacttctaatgggataaatcatttttttaactttgtatgacttcaagggtatttttagtatttccaaaaaactgtcgacgggtgatacccgtagaccggatatagagggtattggggtacgttggtacaagtatctacgtaatacgacatcaagcaggcaaaggacaaagattatactggttcaggccccttgataggtaatagccctaatccagttgatgtgggattatatgatggaaaacacaggttacaaagggaacagtggaacttgacggatccggcaagattgtggtcaagttggttcgactagatccccggcgatttggctccttgcaggctccgacttcgtaggctgtgagggttgtgttggctctgagattcgatgccctaggtcttccccggggggtcccttttatatcacaggtcaggcggtttccaagtagaactcggaaacatcgaaccttacacgatacattgacgatccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaactgagataaactcagtggcataagctcctattaatattatttgaacttttaaataattttatgaattatattatatgttatctattataatattcgccagccgttgccgcctcaaatccgccacgtccggccacaatttctccctcccgagccaatataaaccctccccgtgctctcctcttccatttccccctctttcccgagcccggcactctctccctcgctctccccacgccgctcccgcgcaccgccactttctggcgagctccggccgcccgccaccgctgctccacccaccgccgcacaaatccgccaccaccgtcggcttcgcggcgccgtgctgcagcccggcccctactccatttcccctctccgcctccggaacatcgccgcctcgcgcaacacctctctccgccgccgccgtcacctccagccacgcgccatcgccactcccgccgccactgtgctgcgccgcctccactgccggcttcaccaccgcgcgggcaagctcggtctccgctccgtttccctgttccttcaccggaactccatcccctctgtcaacccaagccaccaccacctcgccgccgccgcgagcgacctccaacctcacgctctccttcgtcggcttcgcagcaatgatagggagcccgacatcccctcatccaagctctccgtcaccggaaatcctttccccgctgtgagaggtgagctccttccctcgtcgccggcttccggccgagttttcccgccgccttgcgcctcctccctattccctaactttccctccatgttccccagatccttccgatcgccgtccgccggttcccgctcgcggaacaccgctggaccgctattgccgtgccaccccgaggagcgccgccgccatctcgcctcccttcggtgccgttccgcttggtgagcatcccctctccgctttttccgccgctctccgcgtgccgacccgcgccgccggtgtcgtcgccggtggtcgccgtccggccgcgcgccgccgtcgtcgttcgccgccgctcggccgcgcctgtactttggccgcccgtggaccactcccgtggtctgggtccacggtgccgccaggctgcagtggaccgagtccaccgtgcgccctcccctagtcccgctgacgtgtggggcccacctatcggcgcgcccttcccctttgatgacgtcagcggctgtgccttttcctttgaaaaattaaataataattccgcaataaatcagtaataattctagaaatttatttaaatggctcaaaacttctaaaattcatatctaattcattcgaactccgaattgggccattcaacttgcaaaattcatctaaaattgacctctacatgtttgttttactttttatgtactgttttcttggtttttattagagtttttcctcgttttgcgtgccagtgtgtagttcccgtcgtttcggaagtccgtggtcatgaggaaaagagttcggaagatcaaagtgaagaagcaaggcaagtcacacattccccttgagcattttgatcctaatttacaaatgttttatcgtttgcaaataaaattgcatgtcttgctaattacatgggatcagggttttacctatctgctcacttgtgccatgtttacttgatatctgtcctttgtcaacattgggtaataaaacgaatagctcatgttacttatgtgacctagctagaactatatgcttagccatgcttaattaccactagctcagttgatgggataactgcagtattagacctttttagtatcatgaggagctgcgtgctcaagacacccggccatgcttcatggtcataattgtccaactaaaatgcgactaaatggtgggctgtgggtgcatggttttgctagtcgcacccatggcaattaaggaccggtttgcgggatgccctggaagaacttatcgtacttaccataagccagcgtgggcaacggctgggcttgtagtgtagctttcctctagccgacgcatccaggcaagggtgggcgtgatggagtttggatgggccctgcgacggcctatgcggcttccggattcacctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacgaaaatgtgtcgtggggctgtgtcttgtgggtacagttgtacacctctgatcagagtaaaactattcgaatagccgtgcccgcggttatgggcagtcgaccaaattcaccgtgattagtcccaccttaataaattgactcaatgcactgtagttcaggtgggttggttgggcctgttcaacgtggtgtagcgttgatcagtggagatttaatgttactttaattactcaacagttttactgttttactcaataaaatgttttacaaccgcctttatgcaaatagccacaaatcgttcttgtgttccccttgcacgtctgcatcgttggtgtggcttgctaagtacggtggttgtactcagccttgctattattcccccttttcagaagtgtagtgcttctgagctgaagacgaagttagaagaccaaggctcagaccccagttgagttttgcttgtggagtggagctgaagccccgctaggatcgcctttttccgctgctgtcattctctttcgttgtgaggactaagtgcctcttctgtaagtattttacgctttatttacgtttggaactgtttattacttgttgttttgtgtaccctggctggtcctagacagagatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaaatgtctcctctcgtccttcggcatttctttgcgaaacggtttttaaaattctcctcgatgtccctccaattcttttagttgtaaaacctggaggacaaaccgtcagcttcgtgtctgttcggaagtcaagtcaagcatcaagcttcgtgcagcaaagagcgagaaggtcagttcagagtcgtcgttccgcgaaggtcaagaagagttttcccggagttacctaaacccaatctttcccggaagagtagttccgttagcttttagatcgtgtgttgtttgcttgtgtgtaggggtatggattgcatcattggtggggatgcgaccatactaggttgtttgcttaagcaacttgaatcataaaaatccattaacaacagatcagtaggcaatcggtttaagaccttatctttagtaacccctctcatctccccctccctctcttgtgcccgtagcaattggtcagtatgagggatagttgcattgggtcaggatctcaacagtttcatggatcaactcggtgcaatcctatgggcattccacgtcaacttcatgaagatcagcttcaaccttaagtcatggctaatcagactcagacagtggaagagttgttacaacagatgcgacgtcggtaccagatctatcagatgcagcaaatgcaatggcaatgtcaggagccacgtcaatgtctccaatcgcaggtgcaagtccaaatgccagcccggaacccaaatcagagtcagagtcaggagttcccaatatcggcaccgaagacccctgtcaaaatgctgtccagatccccgaagataactgtagccgagtcatcgtcagaccaaaggaaagtaagtgctacctgttatgactgtggtgagcaaggtcactatgcaaggaactgtccatggaaggtgttcaccaggtcacctgaaaaatacgagaagcagtgctcaggaagtaaccaagctccaagccagtctaccgacaagaaggatggtactttgcagcccaactatggagcgaacaggacagtaatatggaagatggataatggtaggaccatgatcatcactggtttggaatttactcctgaagacgccgcaaggatacccaagcgtcagagaagaaaaaataccttccgtggagtacgtcagctaacccgacacctcataaagtacggcccgcccagacccgaagatgatgaatcaggagagcggttctctgctgacgatgatgataatgacgatgatgatgatgatgaggatgaggcgacacttaacagtttcatggaaagaggaatggagttcaaagcatgtactagatgtgggatagtcggacacactgctagtttatgcctccccacatgtcgctgtggtgaatatacccattactcagatcatgccctttgaggaaggttacatgattcttgtgtgaaggaacagatcatgtgcctaaggactatcagttgaacacggtcatagctaagaccaagaaagaacaagggacaaccgtgcaacccattcgtcgaccaatggcagacgacaacagcagtcacaatccttctgctcttcctccaactccagctccagcggaagccaaccatggaagaagcaacatcgccagggatgttcagaaatcactgcttgttccagtttcagctgccaaagtgcacaatcagaagcctgcaccccgggaccaagcaagtcgattatgtcgcaactgtcgtaaaccaggacattgtttcagcgattgtcctcttccaagagcagcaaaggcagttcatcgttgttcacaagttaccagcactgcccacgacaccaatcgacagctgaatgtgcaacctccgcctcaatggattatcgtcaagggcaccgtcaaaggccgcattgttccaccagcaacagcttcaagccttcagcaccagcgccagcagggtaagcaatgccaggaaaccaacagctcgctacagctacaaagaggcagtatgctccttcgtcagcacccgcagcaagtgttgccagcatcaggttgcccaactattgccaatcctagcaatgcacctcgtattgctccaatccggaggcccatcggcaaatcatcactcggtaatcccatgagctagaagatcctacctgctacagctgtcaagaggattgccattccctcctcgaagatcaatgcccagagcaatgtttccgatgcaacttctgttagtaggaactaaagaaacaagtcagttaggtttaaataatggaagcaatagcagttctagacaagacttctacttttcaagttcagtcgtgaaaagggcagttctaatcagtagcagtctaccagtgtttaattttgtaatacttctccttgtacatatatgtttatggcagccatgtaatgaaaaggaaatgttgaataaaatatgagttagccagttcctctccttttatggttcatcttgagcatgcagaagcaatttattatgtgtatctgtcggtgccacaagaaaccaagagtttctcttctaactcatcgcaattttgttgagctccaaaacctgtttgctagccaatagaggaatggttaaccaacggagtgaaaatggttagacactcaacacttgacatgatgagatctctttaaaggcagcatcagtggtactcaaatgaaaagagggatggaatatttgaaagtgacatcatataaagaatcttgggaactctctaaccttggaagctgttacaggatggtaatcggcaattacgccctagtggtgtgatcatgaattcagtataagttccaggaatcatctcaatgtttctcaaaagttgaaaaaagaaattgttccatacatgagtcaggaagatacaagagtttggtccagaaatagaaatgtgtagtcaacaaggtatatggcagagaatctattttcaacaaatcatctttaccgaagatatgaaagcgaagtggttatgatcaaagagcagaaactctcagcagcatcaaagtcagtttccgatagttgttcagattgcagtattttccggaaagttgttgcaggatctatagtccgtcaacccaggaagagtcagcaaaggatggtcgaagaagtgaaatgtcatgccatggaaaggacctcttgagttggatctgttaagtgatcagtgcttgtttcaaggaatgttaactatgcaatctgtttaggcatatgacaccaaaaatcaagtcagaagcaagatagttgtaccagcagttagaactggttggggaagtagtcaagagttagtaagatcaggagcgaaatgagaatttctttatgtggagtttcctatcagcaactgagggttaagttccaaatcttgctgggatgaaagtgcgtcgtcatttctctattttgatgaatcggtgaagttcaattttcaaagtgagggcctttgtaagtaagagaagtgttggttatttttcaaggacaatagtccaattgttcccagtcaggcgaaagtaagactactccctgtaaggggggtaggtctcggagatgagttttggctcagttcgtcgctgttttagtgaaggttcaacctagtgcagcaatccgagtagcacttgaagaagcctgttgcaaggtatcagaagagctaagccgatctcagggcatccgattgaattctaaggtacacccgtgaggccagatcaacaactccgcttagagaagcagcatcagggacagttgcagttcagacgaaagattgatcaagcagcttcttagaatacttactgttcatgtcaagagcagcccaagcgaattaagggtcaatgatttacgaatgccagagataagtcttaggaacaactccatccttctctagccagcttggtgaactgtcaggttatcaaattgctagtatcaacggttcagcccaagataagagagtttcacgagcatccgcagccctagtttgggtcagttcaagcagaaccaataagttcagttttgggaagcaatgggacaacagggttgaatccagccagattgctcgtataggtttgatcagttaatcgatcgtgttgggtaccagaactccagggatctaatccaatgaggccagtcagttcagttgtttgaagcaaaagaaacgaatggtcgatgccgatcagttcaattatgcaggtttggtccatcgagcaatcaaacaatcagtcaatccgaaacagaaaaaaacagtgcagtgtctagatcagtcagatcggtcaaaccgcccgcacaaccagttttctctctagccatcccagaatctcgggacgagattcctataagggggtagatttgtaacgccccgattttcgtttgggattaaaaatcatttaataatgcactttctagaaattaaataaaagttaaagctagttaatcaagtgaaattattgagggaattaaaaatttcctttaaaaatcaaggccgggaatattttgtaatattctttgtgccctaatgtactctccggaattttccgtgaattttcggagctcaagaagtaattttaatagcacaaagttcattgaatcaattaaataaaaagaaaacaaattaaaaactccccttcctccttgggccattttcggcccaagaatccttcctctcccccgcggcccgcgcgcccctccccctctcgggcctctctctctccccctcggcccgctcgtccttgaagtgtaaataaccccctgctccctctctctctcaggccgacaagtgggaccgcgggacccacttgtgaggttcatccccaaccttcctccatcccggccagcaaccgcccgaagccgccatgccacccgttgccgcccacgtcgccgctgattccggccctcccactcgctccctggcgcccaaaccgcataaaatcggttcccctccacctcctctaccaaatcccccacttttccccaatttttggcgccaaatcgagcccccacttcgcccacgatgtcgcccacgtcgccggccgttgccgcatcaaatccgccacgtccggccacaatttcaccctcccgagcctatataaaccctccccgtgctctcctcttccgtttccccctctttccagagcccggcactctctccctcgctctccccacgccgctcccgcgcaccgccgctttccggcgagctccggccgcccaccaccgctgctccacccaccgccgcacaaatccgccaccaccgtcggcttcgcggcgccgtgctgcagccaggcccctactccatttcccctctccgcctccggaacatcgctgcctcacgcaccacctctctccgccgccgttgtcgcctccagccacgcgccaccgccgctcccgccgctgttgtgctgcgccgcctccactgtcggcttcaccgccacgcgggcaagctcggtctccgcttcgtttccccgttccatcaccggaactccatctcctctgtcagcccgagccgccaccacctcgccgccaccgcgagcgacctccaacctcacactctccttcgtcggctccgcagcaacgatagggagcccgacatcccctcatccaagctcttcgtcgcgggaaatcctttccccgctgtgagaggtgagctccttccctcatcgccggcttccggccgagttttcccgccgccttgcgcctcctccctattccctaactttccctccttgttccccagatccttccggtcgccgtccgccggttcccgctcgcggaacactgccggaccgccgttgccgtgccaccccgaggagtgccgccgccatctcgcctccctttggtgccgtgccgcttgctgagcatcccctctccgctctttccgccgctctccgcgtgccgacccgcgccgccggtgtcgtcgccggtggtcgccgtccggccgcgcgttgccgtcgtcgttcgccgccgctcggccgcgcctgtactttggccacccgtggaccactcctgtggtctgggtccatggtgccgccaggctgcagtggaccgagtccaccgtgcgccctcccctagtcccgctgacgtgtggggcccgcctgtcggcgcgcccttcccctttgatgacgtcagcggctgtgccttttcctttgaaaaattaaataataattgtgcaataaatcggtaataattctagaaattcatttaattggctcaaaatttctaaaattcatatctaattcattcgaactccgaattgggccattcaacttgcaaaattcatctaaaattgagctctacatgttttttttactttttatgtactgttttcttggtttttattagagtttttcctcgttttgcgtgccagcgtgtagttcccgtcgtttcggaagtccgcggtcgcgaggaaaagagctcggaagatcaaagtgaagaatcaaggcaagtcacacattccccttgagcattttgatcctaatttacaaatgttttatcgattgcaaataaaattgcatgtcttgctaattacatgggatcagggttttacctatctgctcacttgtgccatgtttacttgatatctgtcctttgtcaatattgggtaataaatcgactagctcatgttacttatgtgacctagctagaacaatatgcttagccatgcttaattaccactagctcagttgatgggataactgcagtattagacctttttagtatcacgaggagctgcgtgctcaagacacccggccatgcttcatggtcgtaattgtccaactaaaatgcgactaaatggtgggctgtgggtgcatggttttgctagtcgcacccatggcaattaaggaccggttcacgggatgccctggaagaacttatcgtacttaccacaagccagcatgggcaactgctgggcttgtagtgtagctttactctagccgacgcatccaggcaagggtgggcgtgatggagtttggatgggccctgcgacggcctatgcggcttccggattttcctaggcatgagaggggactgcccgctgccttgcgaggagtgggggtgaaacctgaggtgtggtgtgcttggttagagggggttatgcgaagggtcctgtcacggcctctttccggtatgttgtggtggcatgtcggcgcacggaaacgtgtcgtggggctgtgtcttgtgggtacagttgtacacctctgatcagagtaaaactattcgaatagtcgtgcccgcggttatgggcggtcgaccagattcaccgtgattagtccctccttaataaatcgactcaatgcactgtagttcaggtgggttggttgggcctgttcaacgtggtatagcgttgatcagtggagatttaatgttactttaattactcaacagttttactattttgctcaataaaatgttttacaaccacctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcgttgtgaggactaagtgcctcttctgtaagtattttacgctttatttacatttggaactgtttattacttatcgttttgtgtaccctggctggtcctggacagggatttaatacacaaaatagtctggaaatttgggcaaaatttctgggcgtgacagcggctagcaacacgcgtaaggaggtgatggaagaagtcggtgatctgggggaatctgttctccccctttttgaagagtaggacctcttgtactcccaagacatgctgtgtaaaactgaatcttaaccgcctttggatgtgcacttattattctagcttactcttgcatgttgatcttgaaaacttttgtcccttgtagagatgttgatgacgaggatgtccagcagcgcgggcagcccgagtcaccggcgactattccggttctcgcgtttgaaccacatgcgttgcccgacaatgtagaccagacccttgctacggggacggagatggcgacgactttcttaggttagttgtccattcatccctttctgctcctccgactagatcaactatgttctcgaaagaggcgcgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaagctgtggaaacgctccgaggtcgtgaggtgtggttcaactcgtacttgaagagttgctgcacatccatggccagggtttgtagagaacttcgagtgccccgtggagatcccgaggagtcggcggccggatacatctcttggctgaatggagcctgtgctcaactcgacggcgtcggcaagcgtatcgacgaggtcttgaagcaggagtgtcgtcgatcgagccgatatgccgaaggacacgtgttggcttgcctacgagatcatcgcccgcgcctggacctcgattttctccgtgagggttttgctcgttctcggaggactccggcggagatagaccacctggcgaggtcgatggcgccgttggcggagaagatcttccagtctatagactggagttggccttcttggtagtcttcgtaacctgtgatagatatctcaggaaaaaggtgtaatatagctttggatttgtgtaaaaattgtaagaagtattttgtgaaatagaaaagaaatctatctttaacaaatctttcttactccggatgtcgtgtgtaagagtgtgttctcagttcacgactttagtcagtcatttgagtcgtacactctccctagcccccagccttgtcgtcggaggaattttcttggaggataaggctcttggacctttgacctgccttggttgaataagctctgatcctagcccccagccgtgaagttggaaagttaatttccgatttcgcggcttggttaatacgcacggcgagaactcttacacgaccagatcttacatggtctttcgtctctacaggatctgacaaggccttatcggctctgggcgtccccaaccgaagatcccttaggttcctcggaggccttgtcaagacggcgtaaagggacatgaggataggtttcaacgctaggtgtcatcagggtaagggatcattgggcggaaacactttgattgtaatatgggcctaagaataggctttattgatactgtaaggtgtcttacaggtacggattgtattgactcatacatagaatttacgtagttggtcaatgttccaagaatttgctaactcgcgaccatcgtcgtctgcaattttgaatgcgcatgaccgcaaaacttgtgtgatcgtgtagggtccttcccatttgggtgagagtttgtttcgccctgcttggctttgaacccgtcggaggacgtagtcgccaatcgaaagtatgctgctcggatgcgcttctcgtggtaacggcggagggcctgttgatagctggctgctcgaacggcaactcgttcgcgatgttcctcgagtagatttacatcgacgtttcgctgctcctcctggtcctcatcggagtgcttctgtactcgtgtactctgatgtcgtagctcgctggggagcatggcctcggagccgtacacgaggaagaaaggtgtttccttgttagacgttgtcggtgtggtgcgtacagcccatagttactgatgggagttcttcaacccattttttgtcatgtgacatgagcctgtcatagacgcgggttttgatcccttgtagtactatgccgtttgccctctcgacttgtacgttgctttgagggtgagagaccgaggcgaagcatatcttgactcccagcccgatgcagtaatcctagaaatcagcgctgatgaactgggagccgttgtcggttatgatgcggtgcagtagtccgtatctgcaaaatatccccttgatgaatttgatggcattgtcggccttgatttcccccatgggtactgcttcgatccatttagtgaatttgtcgatcgccacgaataggaacctatagccgccctgtcctcgtgggaatggcccgagtatatctagcccccagtacgagaacggccaagtaagagggatagtctggagcgcttgcgcgggtatctttgtgtgtttactatggaattgacaggcttcacatcgctggaccatgtcgcatgcatctttaagggcggttggccagaaaaacccctgtcgaaaagctttcccgaccaatatccgaccggcggcgtgtgacccacaaatgccttcatatatatcaaggaggaggtgtctgccatcgtcggacgagacgcatttgagaagtaccccgtttggcgctttcttgtatagatcgttgccgaccatacagtagatctttgctttacgggttattttcttggtctctgtatcgtcctcgggcaactcctcgctgttgatgaatttgattagtgggatgcgccagtcgtctgtggtctcgatatcggcaacggcttgttctgcctttgtggcctccgagctaatgtcgggggtgaccgggctaacttcgccgctaacctcttttactgatggctttgtcaggatgtccagaaaagtgccgggctcgagcggttctcgtctagacgcacgtcgtgctaggtcatctggctcgatgttgtctttgcggtagacgtgtcggacttcgatcccatcgaaccttttctctagcttcctgacttctgcgagatacttggataactcggagttagagcatttataatctttgtgtacctggttcgcgactagctcggagtcccctttcacgattagtcgcttgaccccaagtgcggctgcagctcttattggtcgccctaaagttgaggtggattgtgtgcttgaattgatctccggagggagacgtcaagataaatcctgccccaactccttggctgttgagtgcaccatcgaacgccattgtccacgtttcgttgtcgacttggttgtctgatttgttatcaggcatagtccaatcggctacgaagtcggcgagtacctgggatttgatggctgttcgtagcgcaaaattgacatcaaactggctcagctcgactacccatttcgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtaatttatctctctcgacaacgatgacggtgctaacggaatatggcgtggcggcgatatagaggaataattcttcattaggttggggggcaacaagtacaggggggttctataggtagcgcttgagtgcaacgaatgcctcttcggcttcctgtgtccatacaaatttttcttgcttcttcagcagagcgaagaaaggttgccctcgttctcccatcctagcgacgaacctgctcaatgctgccatccatccggttagtttctgtacttccttgagtcttgtgggcgacttcatgttctcaattgccttgatcttctcgggatttgcttctattcctctgccaaagacaaggaaaccgagcagcttgcccgacggtactccgaacgtgcacttctctggattgagcataaggcgatatcgtcggaggttgtcgaacatttcccgcagatcgtcaatcaatgagtcgcctgtcttggtcttgataatgatgtcgtcgacatatgcctcgacattgttgccgagctggtcgctaagtgcgccctggaccatgcgctggaaagtattccctgcagttatcagtccgaacggcattttaacatagcaaaataccccgaacggcgtgatgaatgctatcttctcttcgtcctcttttgccaagctgatttggtggtagccagagtaagcgtcgagaaagctcaacagctcacagccggctattgagtccaccagttgatctattcgaggaagagggaagtgatcctcggggcacgccttgttgaggtcggtgaagtcgacgcacattctccattttccgttggccttccgcaccatgactggattgactagccactctggatgaagtacttctctgatgaagccagctttgagaagtttgtcaagctcttctcgtatggcttattttcggtctagtgcaaatctccgcagtctttgctttactggcttggcatcgggtcgcaccatgagtttgtgctcaatcacctccctggggaccctcggcatgtcggacggctgccaagtgaacacgtcagcattgtcgcggaggaaggtgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactgttgtcgacgaggccggataacatagtagtagaaccttgagtaccaagtccccctacctggcgcgccactgtcgacgggtgatacccgtagaccggatatagagggtattggggtacgttggtacaaggatctacgtaatacgacatcaagtaggcaaaagacaaagattatactggttcaggccccttgataggtaatagccctaatccagttgatgtgggattatatgatggaaaacacaggttacaaagggaacagtggaacttgacggatccggcgagattgtggtcgagttggttcgactagatccccggcgatttggctccttgcaggctccgacttcgtaggctgtgagggttgtgttggatctgagattcgatgccctaagtcctccctggggggtcccttttatatcacaagtcaggcggtttccaagtagaactcggaaacatcgaaccttacacgatacattgacgacccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaaatgagataaactcagtggcataagctcctattaatattatttgaacttttaaataattttatgaattatattatatgttatctattataatattagttaagcatgcatttgtgctgtaatgttatatgtgttgaactcaatattatgtatgatgatagttatttctattagatagaagtttgggttgttttggtgttacgagaaatgtttgttttcatattcatgtccgatcatattcgatccttatttatttttgagataatttttattactttatgtattcgattttgtcagggttatggataccacatacctaatagtagttgactaaatctcggcaagacccaccacataccatgtcctatacggaaacaaccttcggatataggaggagttccagataaggaaagacaatcaaagttctacatggaaacgacaaggactactcggattgtatccatattggtttctctagttctatttggacaaggggacacctatgggtataaatacaaggccccctaggaggagaggggggacaatacacacccaacacaatcaacatacacggaacaacagaagccacaacatacaagccaacataagccaagacaagacgccggatatcaacttcggagataggtatggctagtcctctacggtgtctccggatactgtcaggaaagacgaaagcgctatctctgatctcgccgggcatggattcgaggaggaagactaccctgttgtcgactacgagtcagaccttcagaccgccatgtcgacaacagttagataggctacccaaaatattgtactggtatgattatggtgaataagatcaacgaccggcttcagccaacaggatgtagggttattatctgacaattcaggggcccgaacctgtataaaaatccctgtctccatctcttttacctcagtctcgtgtataccctagtaccaacgatccctataccatgtaaataccagaattgcgacatcaaacgtcgacagatttattcatatttgttttcgtatccaactaaaaatatgaaacaaatatgatacgagtattatttgttaatatctgctttgtttgcatccctaagtaagtaagtaatgcaagtgtagaacactaaaacagtgtgctttgagttttcataaaagtaagtcttaagtttagaaattgttttacttcatcctcataaataaatttatttgatagcctcctaagagattggaatagaatctagaaatttgtagtctcattggccgtgctagttttgggatacaatgccttaaatctttagtctcacaataactccggtgttaaatttgtagttttatgaagcatcttttaaatatatagttttatgataatttgataaaattatcaatagttttgtaaaaatttgtaggtgataggtgatgtatgcccccaatttgtaagccgtcccgtcaaggcgtcaaccatcaatatccgatgtgggaataaatgaacaggtatacatttataaaaagctctcttctttaaaaaaaacgccttcaaagtttattcaaggtagaaaacaattggatatgtaataatgcaaactatatcatcatcatcatctgatcatgtaagttgcaaccaactatttgatcgatctcacctccatgattatctttgtgagaggcagccatggccatggccatgcttgcattgcatgcaggagaaggtgtggggaacatgtctttagggctggcaggccaaggccaaggcctaaacataaacaaagagaaagagaggaatcaagcgaccaagtcaaccattgcctccatattttcccttcaccacacacacacgcacacacagagaggaggacgtgcatggcatcatatcaatctctgcaactgcaatcgccttaaattatctctcctcctcgccgcgttcctctcgcgaaacgcagcgcattgtccgctcctcctccgatccctagcaaaagcttcctagctagcttgcctaccattgccatcctctcccctccaacctctccctccattcgcattaccgcgcaaaggaggaagaagaagaagaactcactcgcaggagcaccaatggtgatcgatctcctctttctttctctctctctctctctctctcgctacaaattaagcacaattgcaatttcagtttcttgcatggtcaatgatgaattgcaattaatagagtgatttcccccgcaaaaaaaaaattaatagagtgatttgatttgagaatggcaggcgaattctgcgtcagggctggcggtgaacgacgagtgcaagttcaagttccaggagctgaagacgaggagggggttcaggttcatcgtgttcaagatcgacgacaaggccatggagatcaaggtggagaggctcgggcagactgccgagggctacgaggacttcgccgccaccctccccgccgacgagtgccgctacgccgtctacgacctcgacttcgtcaccgacgagaactgccagaagagcaagatcttcttcttctcctggtatgggtacttaaaaatatatcctaatcttttgaggggacgtcctctcatttctcacgtctaaatagttaaaaaaaattaaaatattaataagatatattaatatgtgatatatcattaatttgaacctgacttcaacaaggtgcaaaagaaaaacaaatatgactgaatacacgcatcttagctagagtttaatttttttgctttttacaaatcgtaaaggttgaatttgaatagtatatttgtgtatataataatctatcttgataactttttttactaaatttttcattactaaaagggacaagatgcaagaaaagaacgacagagagttttagaattcattcccctatatagctataccatcgaaattaatatgcgtggctaagttcaatttcatttcgatgaggtatcatttctgttataccagtaaagatcacagaaagtgccatgcatgtatgtgtaggtcgcctgacacggcgaggacaaggagcaagatgctgtacgcgagctccaaggacaggttcaggagggagctggacggaatccagtgcgagattcaggccacagaccccagcgagatgagcctcgacatcatcagagccagagctcactgatgatcatatcatttcatcatccaacaccaccagattaattaattcattcccaacgtcgatcgccttattcaaccccagatccatgcatatatatatgcccatgggttaatatatcatcaattatggggtttatgtccgcttaaatttaccctacgtacgttttgatcctcgcaaaaaaaaacacatacatatatatatataccgttttgatcgactatttatacgttgttatacgacattgatgtcgtccaagtattattatcctattatatataattccttcatttcattctatttttcttctgcttatatcttcaacttttcatttttgtaatttgtaagttgtattgatgcaatttgttggcaacaagaatacactttttctattcatgtataatagaaacaacatattctcttattacgtgttatgagttgtgtgtgcataatggaatttactgtgtccaaacattaggtgcacggctagttctttacttttagattggttgggtgaaggcgaatactgatggggcgtttttgtgatggcacactagtttggagcagcggtggtagtcttgcgaaatgaccgcggagattttctgccccattcgaatgtcctgaaaaggtggattaaatttcggattaaagtggcgcgctttttaaactgctaaacggtatgttccgtgcaaaaactttttatatgaaagttgttctaaaatatcagattaatctatttttcaagtttgtaataattaaaactcagttaatcacacgttattaccacctcgttttgcgtgaaacacttaatctacatcttcatcttcatctttagaagattcaaacaccttaacaatatcatctaaggattaggatgctaccatggcgaaaattctaccttatcgcagagcgactaatattgtaagggagttaggagtatctaaactaattattgagactgattctttggaagtgaccgaccgagaatggtgggagtgtctagcaaacattcgaatgatttttgtcatccatttcacttagatttttcaacgtctatccggatgacacgttgccgagtgaacgactttactagttaatcgttctaaccgattgctcggtgaagaaaaaaaaaaagccaagacatcccttcattttgattgtctagaaaaaacccgagatgaatgaataaatattactaatacatctacttaaaaagttacatgcagttacattatagtcatattagctacagtataattacagtatagttacattgcaattacataatagttacactacaattacataaaagttatactgtaattttataatagttacactttaattatataaagttacactgtattttctagaattacataatagttacgatgtaagtttatcgttgtaactctaatcaatatttattgtatatatattttttgagggaactattttccagcattgcatgcttgctcggttggtcgtagtggttctagcgggaagcgcaggccgcgagatcgatctcacatgtgggcatctgttttatattttcccaccagtacagcacgaatcttgacacaaatcctacggccagaaaattgacagatgtgtaactaaaaaatctgtcgaaagatttatagcaaatccggagatgcttagaggaaagttaacagatagatttgtaggactttggcccaagacctgaagataaagctgagttatttcgaaagcgcaagggtcacagattagctcaaggagagtcttcgagtagttttaccacctggctttctatttttccaggttctattagttcgattctgactgatgattgtaagtataatagtctaagttaattaagtgcgagtagtgtactgtgtaattcttaaaaatgtagtgccttggtgtggttcctattttagcatatatcaggccttggtgtgaacatatcaatctttcttgcatttggtgcctaactgtggacacggttatgcatgaatgtatgatgagactccaggacggttgaaaacacttcaacaatatgatatcaatcttgttttaatcaagatcaacacgcatcagtttcataccaaaaaaaaagggggaagaaaccatgcaacatatctggcagactccgatattaaggagatattatgcaatttacaaaaccagtaacatattacaaaaaaaaaaacccactaggaggtagaaaacgaagattaaagacagtttatcagatgtccatcaaacagctgtcagcgtttcatatccaatgaaggaggcacacaagaacagcagcacacgtttagacgttttcactattcattggctctcatcgacaaataattttattgggatgacaaacacacttttatttggatgataacatcttctacacatgctatcctacgccatattgagcataatattatacagctgtgattactatacaaagccggggcattttagtacattgggaagaaataaactaaaaaaaacacttattacaagaaccaagaggtgcttggacacccaggttcgtctttaacttaactatacatcctttcatatatgaacttatagccggtaaacatcgtgcttatatgttgtattgctggtttatcttttattgcatcagcagaagattatttacagtagcgtttatattatttgttctcatcagatcctacaaattggtgaagaaaaaacatcagtgcataccagtgcgtaaggtaatagctaaaactagagttgagaggaaatagaagtgtacctcaataattagctcgtcagggatatggggtaaaacttctcgtactctatctaccatggagagaacctccgacatgctaccattcgcgggtcttgcagtgcctcggaaccgcaagccagcagctgaagcaccatcaggcctcgaggaagaggatggaacaaccgaagatcctgcaactggctcaggccatagactccaggtggcatctggatgcccataattatcagtcactgaagtcaactgcctcatcatcatctgaactccactaagccccactgatgtcacggcgctggaagaactgggattgtccatcccagggctcgaccatggtggtgcccagctagaatcaagaccagcacctctgcaccacccaacacctatgcatcagtgctgcagaatcgtatgcatagcagtacaactatagggttatggtgatcaacaaacaatttccaaaaacgaggattcactgatatagcaagtgtatgtgtgctaaattataatagcatctgagagataagtcatactgcatatacaatacaagtaggcacagaagagccatcaggcaaccataagaaataaaaggaatagacgagagatggaccagtttgacccatccaacccacctgcacgcatgagtgtatgcgtctctttcggccctttccagcccaaccaaccaaacctgcacagatgtgctctataaaacttagccccttatctctgactccatgtgtatgcaagacagtagcagcttcacctctttctccatctaggtttctctaccctcacaattactctccccactccccctgcccccctgctctctatcctcgacctacctcttctgcctcactgccacgaatcaaggtagaattctcccttgcatagttgcaatatggaagagctggtagcaagcggccaggagataatgcgtttttgatggtcaggaagttgggggagcgagaacaggagctaaacgcacactatatcaaaggtacaaaagtaccaggaaaatatcattacttattcaaattattttggaaattaaacaaatcaacaatacccgataccatatccccttgtaagttgtatcccaccacatccatgtattggatacgtatttgcacacaggatcagcattttgttgtataggtgattaataggaagataaaacatatatcttctggtaattttgagtgagcatgagttttagtcatctttggggatcccttctttgccaagttttcaaaattatgtttcctttggtaagtctttattactaccaggttacaatttcaatgttcaatcaagattcaatcctaaaaatatgctaaacctgccagtataaatcaatctgactggaacaaaatattcaaaataatgatggtaataggcaggtgagcaccatcagtttgacatactaaacctacttagtttcacctagaatgaataagattcgaaaagatgcattgaaagactttggttcatcattatgaacaaagataaagtccattaggaaatgaaactatggctattattcttcctttttctttagatcaactaggcctggtaaactcgctttcatacccatttaaaacttcaattgaaccacaaactaggaccaccattaagtgatacattacaacaaacaatagcttcatcggattaaagattatcacagtatctagatagaaaatgtgcatgccataaggctaacaaaatctttgcgagggtagtaacttgaaagagaacaggaaattaaaaatgccctcaaactataccattcatacactcaaataactgaggtagtctatcaaggcctagtttcaaataacgatataatgtcagacatttgcccaatcactttataaaatgagcttaagttgtgacaatgaacaccaggggcgaagaatagggaagacatgcatgagtggagnnnnnnnnnnnnnnnnnnnnnnngatcttggttatgttcacggtcacggcagatgaatatgggctgggaaaaatatgttttgtgacaaatgagctgcagagatatggtgcttaggtgaggcaatggtagccagatatgagaaggggacaatgatgtttcctgagaacttcacatagaagtgatagtgctatgaatgtggccatgttggcgaagaatgaaaggaatgacaaatttaggattttccctcctgtgagtgcactctattgtgctgttctacaagccatcatcatcttccttctttcagcaaaaagagcatatcttcctcttccttctatctccgaaaagggcatatcttcctccttgtctgagcaggatgtgtgctcaattcagatctagcatgcataatggagtcgaccgctaggggtgaggtggaaggtgttcgtgcacatcagcctatggcacacacaagggattcacggtaaacagcgacagggacaattggacatgatctctgctgcactgtctttgccacgacagccaccacctacactacagtaatctggtaagcaatttggcactgcagcagaaagatagcctctcgcttctttaccctgtgtgagatcaccaccctccctaagacttataagctgcgagataacacttgttggcattgcccacgcataccaccaaggatcatccttgccaagtgccacagcccacaaccagtgccaggaacagtccaagatcctgatcatattatctctacatactccatcgttccaacagctaccagggtaaatcaggcggcttttgtgataaattatatttgcttaggcagttgtaaattaatgaattggcagttgaaatgagatagttgggaggaactctacaattatgtcaagttcaatctaccatacaacaactgatcaccaagaatgtagtggaattagctcggatgctggacaaaaggcattacaataggatgttcaaagataaaatttctgagaaagtttgatccagcacctcaggaatcaatgatggctccaatgtacaggggttttctagacagcaaaagttaaccttttcttttctcatattttttgttcattcccgtactcttgttgatgtagaaacacatgcaggaagcgcttatggaacacatagagcatgctggtgaggaggcaagaaactggtaaacgaagaggtcatagagtggcatactcactctgagtaagcaacagatgcagttggttgtttcttcattggcacaaactgcagagcagcctcctcagaggcacctgctgtttttgctcctctaagctcccatttagtctttgcactgctgatttccacattagctgccttctcttccatattatctctctctatatatagctaggcctgcctgaaggttgcaactggctatccagctagcattgagtaacaaatgatgggaggctgtcaggctgacttgtggatccacattgttagctaatatgtgggactgatgggatgtagtgatttcataaaatcgagcacaaaaactatcgtaagatgggtccttaaaggtgtaggtttgtgatagttttgaagttttgacaagacatgaataggttcattgaatttaccccaaatcacatcaataatttgacaagacattgttataacatgaatatgatgagcaatgtgaagaataagaaaatagatcattccaagtttgttatacacacctccaaacagcatctgcaggattctgatgttcaataggatgttcatgaccaggaaccctctgctgattcaaccccgcattaagttgttctgcaattaactggacgtttcctacctctgctgtagatcttgtgtgaccttgagatgacagaaagagaggtcttcgacaagttggacatgagtaaccatccattaatccttggtccaacctacacatagcaacaatacttaagggaaaaatcaaacatagaatgcaatttgatgtggtcacatttgatggtaagatgtgaagctatacacaattgctaagcatatctacttttgtgggtgtagaagtgttgcatatttttgtactaagtgagaagcagaggtcagtacagttgtacgaaagagcaacaaagggagctgaacaacagtctaagctgaaatacaagtaatactatgatctgttactaatgactaacaactgcaacttcttcacatcagcttgctggcaagcttcaatctcgtcaaagatatttgtgagaatctgactaataatttgctaagaaggttaacagaaggaccatccaccatgctcagcaatatcaattttccttatgcagagattccatgacagaaaaatttaagtcaaccgtaaaataggaatgttggtcccgtattttaataagtaaatttggaatgcataagatcaaatggacagttatgacggcatatggagtctgttcataactacagcctgcagtccttatgcaaatagtgggagcacaatttccagaaaatgaaaatgaatctacttaaagttttttttttggtaggacattatgagctatcataaaattgaaccacagaccatcaattgcaaaatagtaaaagggactcatcgcgtaccatgatcgcaagca

SEQ ID NO: 74797 - DNA, 10199 bp, Oryza sativa
  unsure (1)..(10199): unsure at all n locations
gtattggtctgggacccgtctcgttggcatatggtgaacctgtgtcggctttcgaaatgccttgtcatgaaagccttaaggtctctagacgtggccgttttgcacgggctggatgatccgggttagtaatgtcgtgtgggtaaagtgtaccccctctgcagaggttaacaaactgttcgaacagccgtgcccacggtcatgggcggatgtgaggtgattcctagcgtagttttgtttgactactgctttgtgaaattgctgctgtggaatgggttcgatgtttggaaaatcggcggctgatgggatcagccaggcccgggtggccgtttgaaagctgttggccgggtgccaaccttgatcaattcaaagactgatatattgcacatactccgaccggacgagacgcactgcttatccgtgtcgtttgagaagcactcacttagtcgtttcaaaaaggagtttaaataaaatcaattgcaaaaacaacagccttttctttgaagcctgcattaaacacttaattcccatggcttgctgagtactcctgtactcacccttgctctatataaataatcccccccagttgctgaagaagatgatgtggcccccgctgacgaagagttcttccaggagcaagtcggctacgatgagttttagggtttcggcctagttcccaagtcgcgcctgtgatgtttggtccaagtcttggcttccgctttcccttttgtaatgcagttgtgagctcaggatctgtccgcagcccaacatgactgtactcctactctataataaagagacctctgtcgctgtgatatactgtcttcctgtgttaccagcactgtttcctgggactggtatcgattaacaggttaatttggagcgtcacgggctagttccgctcggggctagttcggggcgtgacacgttgtccctgccctcgccttgccggatccgcaaacaccgtgaaccttgacgacaccagtttgactttgaccgaacatcttataacctaaaacggaggaagtatcttgttggaaacacactgttgattctgagctgttagcgaggtcgctgagccctaatttcttccataagtatgttcctggttgacatctggccagactgtgatctgctgtttcaaaggcagggcattgcggagggcataggtcacaatggggattgtcaatccattttttcttcatcatattgccatattggcattagtgtttaatatctgtctctcaaagctaaagcacataatgtctgatgaaaggttaacagcaccattctaaaaaaaaaaaggttaacagctgatatgcattcgaggtggagcgttgtttgcaaggggacagagctctttggtcaggtgaccgtgactctgaattggggcagaaatcattcagaaacagctgcatatcttgtagctctagctgtcttggtgagaagggtttggaaatttggatgcagttgtatgtgccaagacttaatgacaaattatcatgagtcactcggagaggagtcactgagggcatgtttggttgttgcctaatgttaccccttgccacaagcccacaactcaactcgtccttgtttaacattacacaacatgtttgccatgttggtggaccactgggcccctagcctgtactactactggacttcgatagaagacgaattgacttgctgctgccgactgctagtcgaagtctttcattaaacaagtaggatttgcgagatctattgctctgaactaggtcccgtataatttccttccccaccgggagctccgtcctgcactcacgcagtcacgccgcttggtctgttgtctttgtgcatctccgttccttcgtgcttcgctgttcccaaatcccaataccagccacgccgggttagttcactgacccacccgaagcttacactgttgcagtctaaatatgttgccacttgctgtcttgccatgtgccgaaagacaacatgggtcactccagtatctagtttacttatccatagaccacagctgttgaattgtgtgatcggctactagtacatcactgctcgtgattcagtacgtacaccgcggtaactggtaaggaggattcgcatcgtcgacaatggcggctgcagcggtggctgacgaaaatgggtcgcccaagaagacgaagcagggtggcttcaagacattgccattcatactaggtgatcctcctcgtaacctcgtttacacttccatatcttggtttggttcttgatggaattttcgttcagtgcaagtactgcatctcaagtgttcgattcgtgttctaagagtacactactccgtcaatgcagcgaacgaggtgtgcgacaggttcgccacggccggattcaacgcgaacatgatcacgtacctgacacagcagctgcacctgccgctggtggaggcctcgaacctcctcaccaacttcaccggcacggcggcgttcaccccggtgctgggcgcgatcgccgccgactccttcgccggccgcttctggaccatcgccggcggcggcgtgctgtaccagatcggcatgctcggcctcgtcgtgtccgctctcgtccctgccctccgccccgcgccgtgcggcggcggcggcgccgcggccccgtgccagcgcgcggacggcgggcagctcgccatgctgtacctgtcgctgctctgcaccgcgctcgggtccggcggcatccggccgtgcgtggtggcgttcggcgccgaccagttcggcctcggcgggaggcgccccggcggcgagcagaagtggagctacttcaacctctacttcttcagcatggggctcgccgtgctgctcgccctgacggtggtggtgtacatccaggagaccgtggggtgggggtgggggttcgggatcccggccatcgccatgttcgtctccgtgctgtccttcgtcgtcgggtacccgctctacgtgaaggtgaagcccgaagggagccccttcaagcggcttgtgcaggtcgtcgtcgccgcgttcaagaagatcaaggagcccgtgccggacgacgccggcgagctctaccacaacaaggagctggacgccgccatcgccgccgacgggaggctgctccactccgaccagctcaggcaagcattttcaatgcatcgatctctgtgtccttttacatgtggttcgttgtttattttgacgcaattcaacgtgtcagagagttaataacgtatttgccccaccacgtgaaggttcttggatcgagcggcgatcgtgacggcgggggacatcgccggctccggcgagccgaacctgtggcgggtgtcgacggtgcaccgcgtggaggagctcaagtccatcgtccgcatgctgccgctgtgggcggccagcatcaccgccatcgccgccgggtcgcacaacttcaccttcgccatccagcaggcgcgcaccatggaccgccacctcgcgccgagcttccagatcccgccggcgaccatgatcatcttcaccacgctgaccatgctcgtcagcctcgcgctctacgaccgcgtcctcgtccccgtggcgcgccgctacaccggccggcggtcgggcatcacctacttccagcgcatgggcgccggcttcgcggtcgccgcgctgggcgtcctcgccggcgcgctcgtcgaggccaagcggcgcgccgcggcggccgagcacggcctgctcgacgcccccggcgccgtcgtgccggtcagcgtgttctggcttgtcccgcagtacgcgctccacggcgtgggcgacgcgctcgccacggtggggcacatggagttcctctacgaccagtcgccggagagcatgcggagctcggcggcggcgctgttctgggtcgccggctccctcggcaactacctgggcacggtgctggtcacggtggtgcagagcgccagcagaggggagtggctccaggacaacatcaacagggggaggctggactactactactggctcgtcaccttcctcttggtgctcaacctcgcctactacttcgtttgcttccatttttacaccttgaagtcgttcgaggtggacgccggagacgaggcgcaacggcggcgagatgttgccgggagtgcagaaggagagactgagctctctgctggttgtgttgttgcgtcaagaaatggggtgttgtaagctagcataattagggagtgacttattgacatcagtgaagtaatttggtcagagctatctttcttttagcgagttcatattcaatcaaatatttttctggcatacgatcagaaattatttttttccgggataaattgatacatctcgccttgatattttacttgtttatgtaaacactgatcaaacagagaaaatcctttgaggacatgggcatatacacttcttgttcttgaatatatgacacacaaaaatacgttcttctattnnnnnnnnnnnnnnnnnnnnnnnnnnnnnttatatggtgagatcaaagcataaaccatctatgtagtaaaagtgaacatattattctgttccaatccggcaaggggattgaaatgcacattctacttcaaggttcctcctttcttgccatcgccctcgttgccatttccacggtagagctcgagctcctcctcaggtttcaccgtctccaatggcttgaaggtgtagtacctgacgcagacgaagtagtagatgaggttgagcccctgcaagccgaagacgagccagtagtagctgtccagcttggctcggttgaggttgtcctgcagccactgcccgctccgctgcgtcttggcgtggatgatggtgacgagcagcgtgccgaggtagctgccgatcgacatggtgagccagtagagcgccgccgcggtgctccgcatgctctccggcgcctggtcgtagaggaactccatgcggccgacgtccatgaaggcgtcggcgacgccgtggatggcgtactgcggcaccagccagaagacgctgatgggcagcgagctacccttgggcgcgtcgagcatgccgctcgccgcggccacggacttgcggcgactctccacgaccgcggccaccgcgttggcgagcatggcaatggtcatgcccacgccggcgcgctggaggtgggtgatgccgtttgggtggcccgtgaagcggcggagcacgcggacgaggacgcggtcgtagaaggcgagggtgagcagcatggcgaggttggtgaagatgagcatggaggccggcgggatcttgaagtgcggcgtgatgtcgcggtccatggtgcgcgcctgctggatcgcgaagctgctgttgtgcgacgccgaggtcaccagcaggatgcccgccgcccagatgggcagcatgcggaggatcgacttgagctcctcgacgcggtgcaccgtcgacagccgccacagcttcggctcgccggacggcagcacgtcgccgtccgtgataatggccgccttgtcaaagaacctttgcaagaacaaacagttgattaattagcccctaatcgcatcgccagttcgccgcttgctataggagttcaacttactttagctgatcggtgtggagaagacggccggtggtggagatgccggcgtcgagcaccttgtcctcgtagaggcggcttggctccggcatgacggctttcctcttcttgaaggcggcggctgcgacctgcgccagccggaccagggggctgccggcgggaggcatcttgacgtacatcgagtagccggacacgaaggcgaccacggcggcgaacatggcgatggtgggcacgccgaggccccacccccacccgacgttctcctggatgtacacgatgacggtgacggcggtgagcttggcgagctcgatgccgaagaagtagaggttgaagaagctccacttgggccccttgcgcccgcggcgcccgcgcgcgccagcgtcgagctcgagctggtcggcgccgaacgccatgatgcaggggcgcgtgccgccggtgccgatggaggtgaagagcagcgaggcgtagagcacggcgatctgggaggacgaggcgcgctggcagtcggcggcgtgcttggcgcagggcggcgggcggagcgaggggagcgcggcggacagggtgaggaagaccatgccgagctggtagatgacggagccgaacgtgatggtccagaacctgccggcgaaggagtcggcgatgaggccgccgacgagcggggtgaggttggcggtgccgtggaagttggtcagcgtgttggaggcgtcgacgagggggaggtgcagctgcagggtcaggtacgtgatcaggttggagctgaaccccacattcgcgagccggtcgcagaagtcgttcgctgcattcggtgagggatggcgggaaatgttacaacttcaaaaattgttgagagccagttctaaaataaacacaacaatttcctcctctagtccctgtttagaaaaggagaaatttacggtttcttgagagttattaagagctaggtacaaaaaaaattattgtaaattttcgtacattgtactgtcagaggtaccaaattttacaagtatgtaaaatcactccatattcgacttaagaaattagggaaaatataagcttgcaatggactttgctcattttgacatgtttttttaacaccgttaaggcgttaagttctctctgaatgggataagggcgaacacaagtttcggttaaaaacacatgaggacaaaatcacaattgaaaacagtggtaagaataccatttcccttttgagaaatagcatttttacggtccagcaatttgtacctcctgataccggtacctgtaggtaccaaaaaaatcgaaccgttcaattttagaggagtacgatcatgaggaaaaatagcggtggaggagatggtggcgggggtggtggaggcgacaccgcgatggaggaggaggaggagatggcgaccgcggagtaggcgccggtgaaggaggtggcagccgcggcggtagcaaagcagcacttgtggaggaggtggtggcggcaagggtggcgaggcgacggaggaggcgctgacggcgaagtaggtgccgacagaggaggagctggtggtggaggagatgcggcatgacggctgggaaggagacggcgcacacctctagctctattcatccgcacgcgaaattacattcttgcccctccacctctattcaccgcgaagtaccaaatcagaggcagaagtggtacctggcggtacctaattccgtcagctgttggatctgctcgatccaacggccacgatttgataccgtcaggtactgttggatggtaaaaatcctctttgagaaaacgctatattcttttagatagctaagtttgaacctacactgcaaagtaatgcgtactgaaatttccgttccactatactttagtactcattccgtgtgaaaaaatgtctgtattttttttcgccaagccggcaaatgtttgatagaaatgtttcattgatttattaaaaagtttgtggaaaatttgctctcagtcccttgatagaaaatgcaaacctgataaactcagaattttatatatatataaagggaggtgtcgagctcgtatgtatattctatcattctcgtgtttgtttctggtgaagggtgtcatgtactcatacctaattgtcgagctctttttatattcatcacaaatatctggagattccttctcttatacagtagttaagtatagaaatggggccttttccagccctagttaaaaaaaaagtagttaagtagtaattcaaaacaagggaaactttgttacagttttagcccttcatttccctcaaaaaagttttagcccttcatatatacgatcaaaaggatatttggatatttgacaaaataggctgcttgaatttagtggtcgtgaaagctttgccatagatctgattctgattctgcacgtagcaacagtagtgatatcgtttttttacaaggtcgcaaccacatgagagctactgtttggcatttttaggacttgggctatgcgtaaagatgatccttgatgctgttcgacaggtcgggttcttgggcgtcagtccaaagaaaacgtcatttcgtttcctacaagctcatggaaccgtgcaatttgtcttcgaatgtcgttttgactagtagacaccttgtttgactacatgacctcagaattaattcctactctatgcagctgcagcctggtggtatccagctagcccaagatccccaagaacaccgagatggaattaaacaaaaatcttttggatcaatctttgccaaactactaattttaatgatctaatcattcatgttctgatgtgatcatgtgagcctgatcaagcaaagaaaagaagcagcatttgtgaagcaaagatactaaaatcagattacctaggatgaacggcatggtcctgaagcctccctgcttcggcttcttcaccgccaccacgtccacggccttctcctctcctcttccatcctccgccattgttcttctccctcctcctctgcaggtgaagcttcacagttgcagcagcctctgctttctctctctctctctctctctctctacccaggagcaatgagctttcagtagcgtgtgagaaatggagatgctttttataaaggactcgcgcgaggttgagactattggattttggagcttcagagatatggccgtgccctgaaatgtccctgggaaagaacagctccaccaccacttgatgattgagatgcgacgccattgaggctcagcatccactgcagagtagtcagaatcgaacggcatcaaatctctccactataagcaagtactaacggttttttatttctgatccatatggattatctcattacatgttgtctgatttatcgtcaatatcactttgcaaatcttgcaggaaatgcgcaatcagcatgtctaatcatttgctcaagattagtctcaactctcaagtggtgggatatgttgtgtcacatctcaccagtaactaagaggaagaggaatagaggatccttggagatctgatcataacttggtggaatgtttggcttcaacgtaaccttagaattttccaacatatttggctaaacgaaaaccaggtggctttcttgatacaggaaattataagtgaatagctctttccaaaaggcccatgtgatagccttaaagggattacgagtcaatgtatctgtggagtttatatccatagcaatagctgttttagttgcttcctcagtcttttggcccttggcctttggcttttgattgtactgtgaacaattttgtttctactgcttctaatatattcggcaagtcttttgccgcttttcgttaaaaaaaaaaggctcaactctcaagttcaactacaaccaaaggcaaagatgtttttttctttttttctttaagtaaatgtatttattttccttttgttacttttgacatcatcacatatcacaatcatactaggggcactcatagtgcaagctacccaaaatgagaaacctcaggttaaggtcacacctcctctcccagacaacccctaaggggttgtttggtttgctcctaaagtttgccaaaggttaccacacctcatgttaggcaagtttgacaaagttagtatattgtttggttcatagccacacttgtggcaagattccttcttatctatttgggccccacgtgtcatcaactcaacaaagtgtggcacaatccaattttgctagctaaggtgtggctcactttttgtaagccacaacttaggcaagtgtggcacaaatagtatggtgaatagtggcaaacttagtatagcatccaaacagccccttagctttttcccgtcatcttctattctagtcctcacatgttttcaaactacatatcatataaaatttagcactaaacaccctaaaatctaaaaactagtataaaatttctccccctccctcaatctctctgttccccaatccaccacaaatagcgaagccggcggctcctcccaactggcggctcggaaggcgacagcggcggcgtgagagctcactgggcccctccaatcctggcggtggctcgacgacgaatctggcaccgcgcgagtggcggaggggggggaggcgacgacagatccacgatgccgtggaggctatggacgccgcgatggtgtcctcggtctcgtctccacggcgtgggagcggaagatggcaacgaacttggc

SEQ ID NO: 74798 - DNA, 11649 bp, Oryza sativa
  unsure (1)..(11649): unsure at all n locations
cagcagagaggggaccacacgcactttcttttttgggcgtgaggaacccggaccctagctaggaggcgcaaaccttgcaagggcacaggacccaccttttttttcctccacatcaacattcagcaactaggtaacgctccacgtagaagcattatgaaaggcttaatggagaagtaaaatatgaccatgccctaggactacaattctcatgtgaacatgagtgatctcgcactcctgtacaattaggataacgttttttaggaaactgttttgtctgatttgttagcgttatcagcttttctttttccctaaatccttaactgatcagcgtgattacgagtgacagaaatccacaagctaccgggcgtcactaccgtcaccgtcgacggcgacggctcggcgtgcagtgagcagtgagcagtgagcagctagcgcagtggcagcaccaccactgcaggtctgcagcagatagcagagattgtgatcttttctgctggtctgctagccactctggcagaaatgagacgggacactattgctacttgcttcctctgtcagttgccggtaacttgctacatggtcctgtgcatcatgtcctgcctctaggtgccacttccggcgattgagaagaattgcaagggtcaacccctttactttaaatttgttgccgattggggtatatgtgagtgagaggcagagatatttctgctgcagtacgtaccaagtacaccctcatcccaaaataagttctttttggttgttttgtctaacacaacagataaattatcaacaatgtcttatttaaaaaatttatgaaaaaaataaaaaaataagtcacacgtaaagtaatattcatatttaatcatctaatagcaataaaaatataatcataacagttttttaaataagatgaatggtcacacgttagaaaaaaaattctataaatagacttattttggaacggaaggtatactactctctgaagcacatcttggtccagattttgaaacagattgttgagtagattattgctaccgattatctatttaattatatggataaattgaatattttgataaataaatttaacaaataacttaaaaaagtcgtttaaataatacaatagaaatttttttcttataatatatattttaaacatggagcaaataatctgtaaaacaattccgtaaataattaagtaaacctcagcttgcaaattcctctaaaattaaaccctgaacctatctcactctcaccggttctcatccactggtttcttgaacagcagaagattatactctttttttttttggttaagcacagtaaaagtgcagcaagtcagaaccgaagaaatgtctactacactgatcagttaggccggtacaatcattcaatcatgtaatggtccattgtggtacagggatagcacagttggtgtgcagtgcctcaaatattaacatgcactccaaaacggatgatcgagaggcatttgttgtcaacactagctagttgatagaagccactatatatatcctaacatcattagattcaagcggctgcgcattagcactcagtgatgctcctactggtaggcttttcgctgaattttccttctttctttctttattttttgcatatatataatatgctcatttggttacatttatagcgacagcaaaagcctggccagagaagaaaaaatcctaagaaatgcattgcttcatttaaaaaattccatggtaaaaacacgcaaaaatttccccaaacctaggcaagaacgccgccaaatgttttttttgaataacccgccaaatgtatccactacggccttgtttggtttgaagaagattgagagtaaataattctacaccataataggtataaaataaatctcctccaatctctcctcttagcaattaatcaaacatggcctataagaaaatgtgctatatatggagcaccacaggggaggatcaggagaatatttctggtgccctggaagcacaaaagcaatactctctccatctacttttgataaacatatttcaaatctgaaaaaattacttttgataggtatatttcaatccaaccacctatcctcttaatgactttctcggatttaatgagtgactctccattcttcaacataagattggctacatgggcattgagaaatgcaaatattaatgaatcacttgtttacgaagaataactaggatcatgtttaaatggatgataagtagaattacttatccttggtcattgtgccaaataaaatataactatgaaaagtagatggaaggagtaccaagtaccgtaaaaatgttcgaattaaaaaaaaagaaacattagtgtctaacccatgtattatacttcctccgtttcaaaatgtaagactttctagcattgctcatattcatttagatattaataaatctagacatatgtgtatgtttagattcattaatatttatatgtatgtgggcaatgctagaaagtcttacactgtaaaacggagggagtatatgctattgatattgatattataaatattaaattttagtcatgttgactttacgaagtttaatgacttgtaccaaatgaagagtacggtacggcaacctatttaattttaatttcaaatttcggaactaaattaataatatactaagctgagagtaaggtacggcaacatatttattaattccaaactagaaaacctagtgcatgatattcggtataatctaggttataccgagattaataggagtgtaattaggatgtactctatccataaaatgagttaaatgagtttagacaggttcatgcctcactcaagataataactctgcgttttgttgcatgtgattggaaaaatacaaatacatatgtgtgttacacgggtctacaaatatgaatccttccctgagagaatagttttggaagagtgcatgtcttattagttaaagttgtaataatattagttaaaattaaatgaaaatggagggagtatatgtatacagaaatgctaagggacagggtcccatctctgcatccacaagcgatatccttaattccggatgctagcgtcatggtggtggcaagacggcgggtgcacgatggacaagcggatttgagcgagtccttgatggcaccggagatgttagggatgtattgtaggataagggtgtggaggtggataaggttggcctcctggaagacggcgagggagatgacgcagactgagtcttgatcttttcggcgtcataacagattattagtcactgtagacatttcacgtgtctaggaagtaggaagcaaagtggtagggactacctagtgcggcgccaacggagagaaggatcaccttcaccttgttgtcatcgtggcattacagttatttcttggcaaccgtcgctgcaccggaatagggacagggactgcaaggaagaggcggaaggaggaggcagtggaaaagcaggagaaggaggttgaggaggaggcacaatggcagtggtgagttagtgacaatagtattgcgctgacaataatgatctcatttagatccagctccatcatgaagcaagtatggtacctcatagatatcaggttgatacttgagcatcatgcctaatgtcgtagggcattgatggggtaccacatttgctactaggggtgggcattcggtctaaccgaaaatttcggtctcgatcttcggtctttcggtctttgacaagtgaagaccgaatttcagcgaaaaaatatcaggaccgacaaattcagtctcggtctcggtcctgaccaaaatttaacaatattttcatatatgcaaagaaataatggaaattttcaacacaaaaatcacaaaaaaaattcgtaagcacttatgagtaaagactcttattaggttgcatgcctagaagaagtagggatgtgaaaattagagtttaatcctattaaacatagtggattgtaggttgtatttagacattttttgataattcaatctttttggtctattcggttatccgaggagaccaaccgaattgaccgaacaaaattcggtttttcactacctagggccgaattgatgaccaaatttctcggtctcgattttttcggtcttggtctcggtctttcggttcggtctttttctgcccacccatatctgctactcagctggtatgtccaaaatgggacaccgtgtaatgacagcccccatacgtataacgcatattagtttggacccgtagtatcagcaatacgtacgatgcaataccttggagggggagagttgactaccaaattaagtgacgaggccaataccagatttgacacgttttagcaaccactagactcaaccactacgagcctacgaccagtaggagcaactaacagcgagaacaagtgcgtttcccacaaccccggtgctctggaatgctggaaggtaacgattactggcttgctgtttcaaatgattctagcgcatttggttgcataggtatagctactacgtatagcaaaatcagaaggacctttctttttgttgttgttgtcagtcgcctgatcatgtaggtcatcaggaaagatgggttaagaagctccactttgttgaacatgtagctacatcataataggggatatatccggtgaaaacgagttaagtgttgaaaactcgtaaaaatcatatctaaaagttttataaattcatgaaaaaaatactacatataagtgtagatatgaaatacattctcaccaaatttcaagttcaaactcaactttatttaggagtaacaaaaaagataaattttgggtgaatagaacatgacactattcactcgaaatttgtctttttttttctcttaaacgaaattgagtttggagttgagatttgatgagaatgtatttcatatctacacctatatctagtattttttttcatgaatttacgaagcttctaggtatgattttcacgaatttgcaacacttagctcgttttcaccagatatgtcctctttctaatatactcccttcgtcttaaaaaagccaacctcatattaggatacgacacatttatttttttttatggatggagtatctctcagttttagtccgtgactttatgttgatggaagctactcccttcgctccaaaatataaaaaattttaggtggatgtgacatattatagtatgaatatgaacaaagagttagaacatataatatccaaaaaaatctcttatattttgaaatagagggagtatcaagtagtagcaacctacttggactgacagctaagaggtcaattatgatgctgatttcttgaaatttatctgcacccagagatgtgaatcgatgtagtactatctgccattcctgaaaccaaagcaactaacaataaacaaaagaactgaagaaaaaaaaaggaccaggcgtagagaaatgtgaccagaacgaacggaatcaggggaggcattaaccaaggaaatgttaaagcgtgatcttctcttagagaaaaaaaatccctgtttcatcgccgagggatctccactctccagagcttctgcttgacggattccagcaatgtcggaagaggagagcaacgacgatgccggcgagcagatgccgcagcagggcggcatcaagaccatgccgttcattctcggtgaggtgttcttcttgcaatgttgctacccattttgttcttgtggatgaatgctgaggtgagatctcagattaatttgtgcggtgcagcgaacgatttctgcgaccggttcgcgacgatcgggttcaatgccaacctgatcacgtacctgacggcggagatgcacctgccgctggtggaggcgtccaacacgctcaccaacttccacggcgcgtccaacctcacaccgatcgtcggcggcctcatcgccgactccttcgccggcaggttctggaccatcgccgcgggctcggtggcgtaccagctcggcatggtcggcctcaccgtgtcggcgctcgtgccatcgctgcgcccgccgccgtgccgcggcgaggccgtggccgtggcaggggaagcttgccagcgcgcgaccccgtggcagctgctcgtcctctacctgtctctgctctgcacgtccgtcggcaccggcggcacgcggccgtgcgtcatggcgttcggcgccgaccagttcgagctgggcaagccaccgcggcggcgacccggcgaggccggcgcgccgaggtggagcttcttcaacctctacttcttcggcgttgagctcgccaagctggtggccgtgacggcggtggtgtacatccaggagaacgtggggtgggggtgggggctcggcgtcccgaccatcgccatgctcgccgcggttaccgcgttcgtggcgggctacccgctctacgtcaagatggctcccggtggcagcccgctgacgcggctggcccaggtcgccgtcgcggctttccggaagagaaacgtggccgtgccggacgatcctggcctccttcacgacgacaaggagctcgacgccggcgtctccaccaccggccggctgctccacaccaaccagctcacgtaggtccccgtgtttcacatcaactctccaactctaaattatctatgcatgtgtgtgatttatctttttaagattttttgaccgggctgcggttgtcactgacggcgacatggagggaggcggcggcgcacggccgtggcggctgtcgacggtgcaccgggtggaggagctcaagtcgatcatccgcatgctgcccatctgggccgcggggatcctgctggtcacgtcggcctcgcacaaccacagcttcgccatccagcaggcgcgcaccatggaccggcgcgtcacggcgagcctggagataccgccggcgtccatgctgatcttctccaacgtcgccatgctcgctaccctggcgctctacgaccgcgcgctggtgccccggctgcgccgcctcacggggcaccccgccgggatcacgcacctccagcgcacgggcgtcggcctcgccatcagcgccgtgagcaacgccgtggcggcggccgtcgaggggaggaggcggcgcgccgcggcgagccacggcctcctcgacgagcccggcgccaccgtgccgatgagcgtgctctggatggcgccgcagtacgccatccacggcgcggccgacgcgttcatggacgtcggccgcatggagttcctgtacgaccaggcgcccgagggcatgcggagcacggcggcggcgctgtactggctgaccatgtcggcggggagctacatgagcacgctgctggtgacggcggtgcacgagaggaccagaggcgaaggggagtggctccaggacaacctcaaccgggggaggctggaccgctactactggctcgtggtgacgctgcaggtgatcaacgtcgtctacttcgtcatctgcgccaagctgtacacctacaagaagctagaaacagtcgatggagtgagcacaggggagagaaatgacatagttgatgatcaggagaatgcaggggagagagatgagaaaggaagcgatgtaaaagatgtagagcttcagcctctgctactatcggatgtaacgctcccatagagatgtttttagagattttgggggtgtgttttttttcactgggaggcaactgttagtgccgagctccccctctctcagccgtcgtgctccatgttaggtttaatgaaactaatttaatattttaggtgtcgctaaatttttctataaacatagtcaaatttaacaaagtttcaaacgacttataatattaaacaaagggagtacattataagatgaagatggttgcaattagttctccgtagaaaatcaaatggggaaaacaagtacccactaggtttagcgggggcagcaatgaccgtctcctggtaacccacgaagacccatgtccaaatacaaattattaaattcttgaggtccaatcgacctatgattagtggataaatgataatcttgtgttcttgtcacgtggattatatatattgatatgtcgatttaatgtgtggatggtatgtattgcatcatatatgcgatttgagatgtagatattgttttaagtggagaactggagatgatggatcacgggatcaattcccgcacgggatggtgatagaaaaattgttccccgttataattggcagggacggaatgggaatgtatttccggaagagatcatctgtagttgatgcaccgtgcctttgtcactgacatgtggaaggatcctgatccgccacgacacctttgtctcgctgttgacactggccatcgctagccggccgtctttgtcaacactatcacatacaccctccgtcaaaagagagagagagagagtaatttctgacgaatatggaaacaacctatgtctagatttgtaactagaaattttttttttcatgagatggagaaagtagatgcaagtatgtactattttcaccttctcataaagaaaagtttattttctactccataccagtaaaaatatatgcataaaaacaagtatatcctcttatgttggaggtcctttgcttacccaatagtatatcactacactcgtttccttccattaaataataggggctttcagcgccagtttttatatattgaagacagaattctggtcaatcaaaatgcagtaaaattcggaacttactcatcaatgtaaatatgtaataagatgatgactgacaattattaaacaaaaactgaacgatcgaagcctacctcggatgggaacggcccaggatagtcaagatatatcaggttgatgcctacctcagataaaaccatgtacactattgccagcattatattagaagtccggatgatcacaggttattttttaataatatgaaccagatcctgctaactatataaaaatatgttagcaatcatttctcattgtagatacagaggtttgcattagtatagctgagttccaaaagggcgcgtattgttaatttctaaccatatatatctacctcgcgaaaatataaagaagactgcagatgaaactgggggatgaggtatctgtaaagtgcaatcgaactggctgagaaatgtagaagatcaagaaaaatatttattcgtaaagaagcactcgagacattcacataaaatttgtgggcagcattattgaataatctacaagattaaaatgccgtcctctaagttaattattatattgttattcctagcctagaaatttcactagtttattacatagcgacatggtatagactcctattatcctatagcacctttgatgtcatttacatagtacatactcgctcaatattttctatgactgcactcattacaacttctctacataaggagttttcctaggcaatttgctaccacggtgaatttatctttcaatatctgatacctacaatcaactaattacgcatccatactcaatattttacgaagcctttttggttttgtgctttgccaagagttgactctatatcgccatggaatagagaaagctgtttggctaaagcaaaaccacaatacataccatccacagaagcacttaatataccccctgcatagccagcaccttccccaataggatacagccctgcagtgatgtgctctcatatgtaccggtatttcgtgaaatttgcaatggggagcttgttcttgtctggaaacaggtagaaaattgcaataaataaaataaaagtaaatcgtagttgaaaagatagaattatagttaaaaggtaggtgacatgaatagaagtccaaagaaacggtgaaggattggagtgctttctaagaaattatcttgtgcattgaacagttcaacaggtcatcagggtgtgaagggcgacaacacagtagaagagactcggtataattaatttctcatgcagcagatactgcacaacttaggaaagaaaaggggaaccctacatgactatggtttacacaaaacagtgaacatggaaagaaactgaatgtactccatacaggaaatgttttccgtttaaggggttattaattctaagagcaatgtagcaacaggaaaagaaaaacgtaggtacagtcatagcgaatatggagaagaaatgataactgataaggacatcaatgttaaatatagctcagggatagagataaatgcgataactgaagtcacaagagaaggttcagtggaaggtggatgcagctcaataagaggtatctttacaatggcaataagtataggtcagggatttaggggtgaattcagtaggttaaagcctagaaccctgggaaaggttgttaggtcaaaaaaaatgggtgattatttcaaagtagagaaatcagagcatccagggagacccacgaaccagcattgacctctttagggaaagttggaagctaaaaaaatcaatgttcccaatctcataaagtgtggattttattgccttgccttgccaggcttttttccatttcataaactatgatataatggctttaccgccttaagtttgcccaaataaattaactaagaagaaggattcagtgtgtaggctagatccaaagagattggctgtaaatcataagcgacaaatttgtanacatatgggcacgttgctttgagattaagtaatgctaccgtccaatgctcaggcattggtgggattggagtcattggactaacactagactctttgatgttaaacaattggtttcaggatttaatgaatgaaccacaataaattctatggaaatagactgatgaaaaatttcgagcttgcatatgaatttgcatacctcgacaccatgaagtaatcctcactagatacaaatcctggcatctgaaaatattgggttgcaatgtcagagagatggtatttaaaaccacagaagaagaaaaaatagtgtgtgtcaaacctcttcctcaatcattattattgattgttgtagaacttcagttatgtgcgaagggaatagctcatggagtttggatggccgaactcccagcctatagcttgatggtgggagagttgtaactggaacagataataaagttaattaataagaagaaaagtatatactccgtatctttaccacctaataaaatcttagtacctgacaatctgttactgagaaaatctgtgacacactgtgcaggaacaacgaaattccctccccccatggtagctgctcttctttcaaattctctctgtttccatgaacatatacttgttaaatttgcatttttggaattgaacactaaagcaaggaaggaagaacatgagggaaatactacttaaaatggaattttatcttacatacaagaggagtattgtctttgcccattaacaaaagaggtttaggcaaaaggcagcacatggcatcccacattcatgagcaaatggattgcaggcacatgtgcacacagcatagtgatgactgacgcaagcgacaatctctaccatgctgcgtatccaatctatttgtcatactccctccgtcccaaaatgtatgatatcgttgacttttcgcataaagtttgaccatttgtcttattcaaaaaattatataaatatcatttattttgttgtgacttgttttatcatcaaagaaactataatcttaacttatactttttcac

SEQ ID NO: 74799 - DNA, 18651 bp, Oryza sativa
ctggccctagggataaaattttctttttttatatattttctctatatttgaatttgaaataatcaaataatggttatgatcttcaacatcaatttaccgcagtgccacaatttcgggatatcctataacaaattccacaaaatttaagcattttgtagcaaattttatcaatatatagtgttgtaaactttaattaagatcttttatgctttgatttgctttataattcttacatgaatccgtttagtagaccgtatttattgtacgtgagttcgatggtagattcgatgttgattcgctttataacttcgtttgattgaaattggaacgatgcgacggaaaagttaaagtttgtatgtgtatgaaattttgatgtgatgaaaaagttaaaagtttaaagaaaaagttggtaactaaaccagcccttgatcaatatgatgaaaacattcaggaactttgaccagcattaactcgagctgacgagaatatacattccggaattctcaccattggttttgcccgcgtgaattgtcttcactgctcagtaattgcgctgctcgagcgcgaccaatggcctcacgaaaactccaggtggttcggccacggaaccagagtatggaactgattgcgtccttggcacgaaggcgaattttcaccgcgattttctccatttgtctgactcgtacaacctttcacctcctctttttcaccctttacccaagcaagaagttggtaaaaagaagggcaggtcacaaaagaatgaggagagcaagaaaacaaaaaaagagttcccatctcatctgcaccactactgtgtgacagcagcagcagccagccaagaagagagaagagcacattgcattattgcttttcctgcaacaactggggcaacaaaaagccacttggtactttgcttatttttatccacccaatctacttttgctccttttctcgcaaaaagcccccttgcacctctcccctcccctctctgtccggctccttgtgctctgcagaaaggccagttccgctgctagttctgggatgcggaaaaggcgaccgcatccagccgcagcatggacagatagctgtaggatctcatgcgccgcggcggcagcggcagcggcagctcgccgttgcgattgcgctgagctcaacgatccctcaacacgccggccggtgcgcttggcgcagggggaatgtgcagctgctgttgctgccgaaaagctagcgatccgatgcttttgtgtgtgtgtgtgtgttatccgacggacgaggacaaaagacaccgggcatctcggcggcgacggacgggctcagctcggcatctgatgcctcttctgatgttgatggggggttttcaggtaagctggtgggtttggttttcctttttttagttcttatgcaagtgggattttgatcgaattgcttttctggtgccttttgtgacaggaattttgtactctggtagttacattcaagaagcatacgcgcttcaccgcacacgtgcaacacacaagcacatccgtgagggtgaccttaacacattattactcaaaaacaatggagagaccgatagttgatcaaacattcgcacactcacatctccccgctcatccacgcgcaggtgacacggggaaaaaccctagccgccggccaccccctctcctctccgccgcaccgccgccggagcacgccactacaaaagctaagcgatatgctgggaagacagcggcatggctaaaacctggcgaggctaggtctccagcgtaggggagacaaagtgaaactggccacgacgtgcccccgataagggtggccgcgaatccaatgccggctccaccggatctagtctcctcgcagctgaatctaccccccgtgcgagattctaggtttagggtcccctccctaaattatggtttagggtcctaggttgggtgggggtggaaggaaggggaagagatggggacatcgctgaccttagaggggtagtcatgggaggcggtggccttatagtaggtggtagacacgggaggatggtgaggtgccaacacggcgttagagccatggggatgaaggatgatggtgggccagtgttgacggcaaggcaaagcgaagcttgtggttagtagacagcggccgacaatggaagatccggcaatagtgagaaaccgaagatgaggaagacgacaggaggtgggctcctcaccatcggtggcttcaggatgaggagagggaggaagggggtcttctctggtgctgttcgtgccttctagccaactggcaagaccgggcaatggggcggcagcagcgtagggcacgagaggagagagcgtcgtgcaatgggggtgggtatgaaggagggaggagaagagcgagggggttaccgggggagaggagtgtgcacgaaggcggcggggaaaacacgtcgacagcagagcttctcctcggcatgggaggcaaagcggcgtacgcacggcgggagacagcggccgaagcggacagcgggtagatccgcccacgccggaggctgatccggcctctcggtggtggatctagcccccagcggctagatcgggataggccgagctcgcggtggcggtggcgctactcgagctcgtggcagcggcggcgcgactcgaagctcgcggcggcagaggcgcagcccgggaggcatgggccagcggaggatgctctggcagcggcggagctcgtggcgatggtggcgacagcgggcagccggcgggccggtcggcgacgatggagaccggtgaggcgcaaggaggcgcgaccgatggtggtggaagccgacacggtacggccggtggcggtggaggcggccgtggtggaggctcgggcgaggcgtgtgccggtgcggtatgatgaggctggtcggcgtggtgcgaggaagtgcagccggcgacggcggtggccgacgcagcgggaggcgaggccggtattggcgaagcccgatgaggcgcggccggtggcagcacacaaaggctggccggggggggagggcgtcgatgcagtggcgcccacgcaccggcggaggtttaaatggcggtggagcaatgatacatcagtggtagataggcaggtggtggacggcgggtgaacccagcccggccttggctgggccgacaacgatggtgttcgagtgtcactcccctcctgagagcgttgttgtgccgtctcaccccctctaacgtggctatcgggtgaaaactcagtctcggttgtccttgagaccttgacgaacggcggcatcgatgctttcatcgcttctctccttggagacgtcgtctagacatcccattgccagaacctcccaagcaattggtgcaagctcgctctagattcatatcctcttgtgttagcgtcctagcttctgtaagttagccacgttggaaggcctaggggggacagcagtgtcattctactctctcaccctctctccctctatcccaaagatttggatagagtgggattttgtgtcggttgtaagggtcgggttttgggaaatctcggttgtgtttttttgttggcctagcggcggtcggtcacacttagtggcggccagtccggtgctagctttctactgggtcggtgtgtggatggtggtatactttttttttcccttataacctctcagggttataatcttgtaatttttttctgctctataaatagaacttcgttaaaaaaaagatttggccaggtgttttatatccattgtcaaatagacagtcctgaagactaatgcctattgtcgagtgtatgtagcaatttcgtgtttgcaccacacttttccttatagcaatttcgaggggagtataaggtatgagtagcgtggttggtaggaggtgaattcggtgctttgggaggattgtacattcaaccacaaccaggattacatgcttgggtaaattaagcctgggaagttaacacctgaacccttttaggctacaacagatgaactgattaggacttaggagtatacgaaattgctgaattgagacctgatcaacttgtcagtaccgaaattagagatgaggcccgtctttcccggcgatctttattccgagagctccatgtttggccaaaagtggcaaaatcacccaaggaagaaaattagttttgggacctaacaagtggcactatatcaacctaattgcactaggtttggtaatgacacaatccaattgcaaagccatgtggtgaaaatatcttattcggcaaattgtcatctggtctttattagtaacagcagcaaccaaatttatttctccttaattattttccatctaacgcatcagagggtaaattaatcagtgatcttcgtggttgtgtttcgctgatctaatactacatccgttttgtccgtaatgaatataaaaccttcattagcttttttttagtgataaaacacgtgtctgtcaaggtccactactagctgccactactattctattgtgctgtcaccgctattcacacgttaaacttctgtacttaacgtgtttgaactgattttgttgcgaagaaacttctctatcagggaaacttcagcagaaataaatttgttcggtatagattgcttctacttgcgagctaagataatggagttaaacatggttgaaacataccaagcaatttcattttaaggcagaatttaatattggtcctgttggaatcgtgagtcagaatgagccatttatattactgtataaatattctgatcctttttctcattggactcatgaaagacttcgtaatatgtggagcatcaaaatggtgccttccttggaagccatagctttcccagaattaaattaaatatatttctgaaagttagtattcctacaagtttgggctggtcagctgcactttacaacaaaaacggtcagaaaaatgtttatatcattcccgtttttcctctaaaatagatttttttttgagaaacacagtaaaaacgcagacgctcacaacgtgcgcacactcacccctataaacgcacacacgcacaccctacccctataagcacctccggaagactgggctggcatatcttgagattgacgaagtcaccacaggcgtctcgctgtcgacgggtatgtcgcctatcactgaaagaataattagccgtaaatgcgagcacctgtgtcaaatctaggatttgaatccgggtatcggtactattgggttattagaaaatattgaaaataaaattatcgaaatagagcctcagaaacaatatcgtaggagtaaggagtattagtgaatattccaagcagtttgatttgcatacttaataacggtactgtagcatcaacgatgacaacacctattttttaaccaatggttatgtttttcatattttgatgggtaatcagtaatttgttccaacatttcacatgaagacgatataccaattaaatggcccgaaaaatcagtatatcattttcggaccaagtaaaatcagaacggaattgcgacagaacttgcgacagtaatcagaataaaacgaccggtacaaaacggaagcgatattcatatcgttttcatcccaagtgcagcagttcagagctcctttggctcggtaagcggcgccggtgcagccaaacggccccactcatagtacttaattacgcttaagtaggcttaagtacgaattattgtaggtaaatcaggcttattaagcaggcctgtactacagaaagatggtttactaaagcgcaaataatgagtgagcatttaattgcggaaaatccaggcaggcgagagcgagaggattcatggatctcccgaccaatgtaccctgattctcctctgatgatagccagcccagccagccagcgagccagccggatctcgcaacccccagaactagacgcaagtacacgagcgagatatcaccaacagcatgtgccactgccaagtgccagccaccatcatcacacacccaaataaaaaaaaactaaaaataaaaaaaataaaaagggaaatcgcatttatcgcctctgcagataaacattgccggttgtcccagcacagggggagaaggggagagagagggggagagaacgtcaggcatgtgggccccacacctcggggggtggtgggcccggatcagtgacgccgggcgtggtggggccagcggcagatgagatcagaatctgggtttgtccttttctcggctcttcgctgcgggcctgacgcgcgcgcgtgggagtagtatctgcttggatcggagccccccaagccgttagctgtcaaggtggggtgtggggtagtggagagaggagaaaagcgggggaggggatctgatcgtcgcaggagcgcagggtgcagcggcagcgccactcaaccagcgggagcggctgctgctgctgggcttttgctcctcgcttgagcatggttggggggaggaggaccacaccatggtgtgccatcgtcgccctgtgcggcctgtgtagtgtgtgtactactgtagtactgtcttcctcgcactattttgtgtgtgggggcctgtggggaggggttgatgatatcgaatgtcctgacgtgtcccccctccctccctgtccatatcgtggctacccttcatatcccaaaataaatcaatttaaataaaaataagatattatacggtataatgaatttatacatactcttatctagatttatggtaatatgttacgttatatcccaagtaagattagcttagaacgaaagaagtagatctttttttcccgtgtttgtgttagacactcttcatcataaaataaaccaacatgatgtgatattgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcgtccttagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaaaggggattgattttcggatccagaaggatcagagagggagagagtaagagctctctggttctccagctcttttgtagcttcttcatacatagatccacaaaaacacaggagtagggtattacgcttctcagcggcctgaacctgtatacatcgcccgtgtcttgtgtgcttccattctcgcgaaccttccacacacagactaggagcttagaatctcacccagggcccccggccgaaccggcaaaggggggcctgcgcggtctcccggtgaggagccccacgctccgtcatctggcgcgccaagtagggggctctgcgagtgatcttctgagctctcgcactctttcgtgtgcgccaagcttttcctgttcagcccaatggccgaacaagcaaaggcgcacaacctctcttcgagcgttagtggtgacgaaggggagccaaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgtgctcctacgtcacccgcccattgtccctgacccggagtctccagcccaacgttggctggacgacgtggccaacttggtcatgacggcacggcagcgcctaggtgctggtgggcggtcctccgccaccaagacccctggcgctgctaccaccggctccgtgttgtcaaggcggagggcgcggcgagcggcggctgttgctcgccattcagccgccactccttcgtcagcgcctccgacccaggaagatctgcgtggggggccggatgcccgcatcagtatcgagcgccggcgtaatggccggcgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcaggggggggtgtgcggcacaaccgcatgctcgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcagacagggcggcgtgacaggaggaggaagaagaggtcagcctataccgacgacgagggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccctggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcttggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttggcacatccgcccccgccgccccgaggcagcggatagtcacatacgacgaggtcccggtcaaggaggttgccctaggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggaaccttaccccctgcctcgcatagatcagattgtcgactccatagcggggtgcgacctcttgtgttttctagatgcatactctggttaccatcagattcgcatggctagggaggatgaggaaaaaactgcattcattaccccgataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagctgaacggtggcccaaggcccccgacgaccggagcaggccctctgcccgcttgtcagacggtgccaggtgcccccgacccccaggacggccccgaggccactgcgggaaggccgcacctatcgccctctgaccccgaggctaaccctgtgccgattcgacccaggagagagcagggagaagaagcccccgagccgaacgatggcctaaggcccctgacgaccggagttggccctttgcccgcttgtccgacgacgccaggagcccccgacccccaggacggccccgaggccactgtgggaaggccgcccctgtcgtcctccgatcccgaggtcgtcggcacagaagacgagtgcgccccgcaaggccgcttgggtgaagagcgccccagggatgcggcccctagcgaagaggatcggccccaccgaaaggtgcagcggcccgtctactttgttagtgaggccctccgggatgcaaagacccgataccctcaggcccagaaaatgctttacgctattctgatggcctcgaggaaactgcgccattatttccaggcgcatcgggttacggtggttacgtcttaccccctcggccaaatcttgcataatcgagagagtactggacgggtggtgaaatgggcaatcgaactttctgagttcgatttgcactttcaaccacgccacgctatcaagagccaggccctcgccgactttgtggcagagtggaccccggctcccgagcccgtctcagtccccgaagccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgacttccagctggtcgttaaccaggtctgtaaggagtaccggtgctctgacccgcagatggacgcttacgttcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgacccgataggggagacggacgcgcctgacagacccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcggggacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccgtgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccacacttaaattcattaagggcatcacaacccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagacgccttaaaaccaagaccttcaatatcctcaagaagcacggcgattcgtggattgaggagttgccagcggtgctctgggcgaaccgaaccacgccaagccgagcaaccggggaaacgcctttcttcctcgtctacggcgcggaagcggttctcccatccgagatcaccctgaggtcccctcgggccaccatgtactgcgaggctgatcaagatcagcttcgcagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggcccggggcaaccccgcacccccctcgggtgtgcagggttggccgggggctaccacatatgcatattcttatttctcttatatctgtatttcaataaaagcattttcgatttcctaaaggctgtatctgtgctgttgtttccttttaaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaagaaccgcggcacagacatccttgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccaggtcgccagcctcgtcgccactatcgcccactccgtcgtcatcgtcctcctcgtcggagttgagggcgaacgcgagccgaggggccgaaccctcgaagctgtggacgatatggtcggcggcatcccaaacctgcgcgcgcgcgccatcctcggtctcgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctacagatcagcgatggtgtgttcggcagctgcgaggcgggcgattaagtcgctttcgcccgcggccgccccgccgctgcgcgccctcgcgtccagctccttctcccgcgcctcgagctcagcggcccgctggttcagcgcggccctctcagcgcgggcaccttccagattacggcgcgcttgttcctcttgcgcagcctcgcggagggacaggctgtccgccagccgttgcgccgcggcctcggcctcatcaagagctcgctcccgctcggtgagcgcgtcctcgcggaggcggagcgcggactcttcttcggcacaggcggcttcgtgcaccgccagtgtgacctcccgaatagcaacggcggccttgcgatccgccaggtccctctccacggcgctggcacgctcttccagcgccatggcacgggcctcaagggtttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacggtggtggcgatgagggcagccccccgctcctcctccacctccttggcgatctcccccagcaccttccgacgggtttcgagctctgagacgtgccggcggtgtgccttgcggcccacctccaccatggcctccaccgagcgtcgcccctcttcgacacgcgcccatgcggcgtcaagctccgcccgctctgcttgcaaggcctccacctgggcacttaacccgtccaacaccgtggtgtttgcaacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggccttctcggcttcccgaaggcgatccgcggcttctcgccggtcagattcccgcctctgggcctctgtggtcgccgggtcctcggcctcagactgaccggacttggaatggcgggagggacgcgacgggatctcgcagaaaacagaagaaagaccagaagacaaacaagatggatgagtgaaaactcgcgttgagggaatgaatacggccacgatgggcgtgggacgaacctgcgagggggtcggttaaccgaccaccttggaggggaaatgaggtttccccgggatggttctgtccctcccatcttgcggagccgtttcttcttccgctccccctcgggctgcgacgtcggcgtggccccctccgggcgcctgctgccggcacgcgccgccccgccccctcggggaggagatgggggaggggttccttcctgcttcctcttctcccgggcgtcggcagggtggccgctccccgggcccccgtcgcggggcccagaagcacgaccccctcccggggtagattgttcccccctgcggctcccgcccgcgccatcatggcctcgaggagcccgctcctccgacgccccgaccgcctgcatgatggtcaggatggaggcgcggtctggatcactgcagagggggaggactccttgaggaatgagggatgcctccacggagctgagattcagcacccgttggaccactatcttgaagtcctcaggagcccagtcccatttgaccccccggtgggtcctcatacagtcctcggacccggtgtactcccaggcaccccgggcgcgccgctggagtggcgcgatccggcgacgaagatagtcaccgtacaccatggcccctgtgagccccagggatcgcaggcccgccaggcggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatgtagcggttcaacaccggcccccgcggctggaagtagcagccaccaaccaccgacggcggcgacaccgactgtattgtgaagaaccaccggaacagccgaagggatgggcgcaccccgatgaacatctcgcacaggtgcgcgaagatggccaatgtcattaccgcgttgggggtgaggtgcgccatctggagatcgtaaaacttcagaacatccatgaagaaagaagaaaatggcggaaccagccctgccattgcaaaagggaggaagaagacggaccgccccgggtagcatggcgccgggtgtccctcgcccagcgtaactatctcccggccggtggcagattccggcatgaagcggcgcggcagcccgccctgcctctcgctcacgatgcgggaaggcggcagcacgctaccatcaagcaaagcggagccccgtgccatgacgccggaggaagagatgtttaagagcgagcacgtgtggcgaaggtagggcacaggaaacaaggagttagggcgcaagcggcgaagacaaggggaataatggcgagaggaaggaagcaaatctcttcctcggcgactttatacccttgccaacgctgtgcccagctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccaaagcgccatcaccatatctccaggaaaaacgaaccggcttgtcccgatttttagaccggccccaccatgtcaccaggccttaggaagtggcgtcacgtccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcgg

SEQ ID NO: 74800 - DNA, 13835 bp, Oryza sativa
gattttcggatccagaaggatcagagagggagagagtaagagctctctggttctccagctcttttgtagcttcttcatacatagatccataaaaacacaggagtagggtattacgcttctcagcggcccgaacctgtatacatcgcccgtgtcttgtgtgcttccattctcgcgaaccttccacacacagactaggagcttagaatctcacccagggcccccggccgaaccggtaaaggggggcctgcgtggtctcccggtgaggagccccacgctccgtcagatatctattcagattttattttaccgctagtatgtgtcacattttatgctaggtttgtttatggctcgaatcttttcgtattcgtgaaaatcgagcatctttttaagtttcagcagttttgtaaaccccaattgtatgatgcttaattttgcctatgcatatccttttcttagccatgacataagaatttgtttttctatctaacaaaacggtagtcacatatagcttggacaaaattaaccaagaaatcgagcatttggtatgcggcatcgtactaatagaggaaaggggagtgaattcgatctgaagtcaagtctgaaccgcgcgattgtgacagcatcatgccacagtatccgcatcaagtacagtacaccaatcaaggctcctatcggatggcctaatcagccaaagaaaaagccaaattttaaattttcaaacttaattttaagattgattttaagatattttcaacgtagtttcttttacaacattggcttttaaatcaccaagaacacatttataaaagtttcatctacaaatttatttttatttactaataagccggcttattaggaaataagccaaacaatgggacccaattgaaaccgagccccctccgcgatcacgccttgtcggcgccgaaagaatcatttacgactggccctgcaggccccagctgcagtagtagctgcgactttgatccgtgcgaaacatgtgaccgaatactgatgtgtcgcgcaccggatgctcgctcggtcaccctccgggagccaagccagcaactcggacatggacacgggcacacggcgctggtggattggttgaaagcgagagttggggtcgtgctatgtgcgtacgcgtgtgatgcgtcgtaggggaggcgctgcttgtcgaatcggcggtcggtcggtcgaatcggcgtatacgtgtttatcgtctcacgcgcatgcgtcgtcgatcggtccgatggtcggaacagtggtgatgcatcgctttctgctgggatatcgaaaagagggttccgtagagccgtatagccaggtaggtggccggcgatccggaaagggattgcgtacctgagatcgagtgtctaacgctcggagggcaaaatgagtagttgcatacttgcattggctcgagtatatactgctttctccattctaaattgatttatatataattttttttaagattatttctaaatgatctacatatttatttttatttattagagtctattcgttatttgtgcattggagtaaataaacattgattcatacatccatacacataagtatttataacccacatgcaatatcttgatttgctattgactagaaaatattgggatgatgcattcattgagtttgttgctagagtaaatatagtatgagagttattagcttttcttggtattggtgtacttatgaaatatgtagatcaatttggaatggatggagtatatagcataaaacgacactggaggtagtaaatagtgacagacgtacaggttctgattttttttttttgaagactacaggttcggaattggattggctgtgttcgtttcaacccactcccaacccctctctctcgttttccgagcgcacacttttcaaagtgcgaaatggtgtgtttttttaaaaaagtttctatacgaaagttacttaaaaatttaaattaatctatttttgaaaaaatagataatacttaattaatcacgcgctaatgaaccgctccgttttccgtgcgaggagatgagttcccaaccccaggaagcgcgcactctgcggctctccgctgtctggtccagtagctaagcccaacctgatcaatttttggtgggcattggcccagcatgagtccaaaaacagcccaaggttggggagaggaatcgtaaataaactctaaattctataaactgtaacccttgtcagctcatctgaacatcgaagtttagataaagatggcatacgatgaattgaaagaacgaaatgtcgaattatgcagtgatttttgtggcaggatgaattttctctgaacagcatcctgagcgattctcttttcttctaaaataacagtaggatcttgcagctttttcaaaaacaaatcctggcaatagtttattgtggggaagcaaatcaattaccctggcaaattttaaaacgtcaggtcgtttacggtttcggtccactaccgtctaccgtgcttggaagctgaatcagtgcatatgttcgaactgatacgcagactagtactattgtttgtaaattagtgcacaataacgtctcatcgaaataggaattcttatacagctatcttttgacgctacacggaagttcgacgctgggaaagtttgactacaaatggactcaacatatgacaacacaacatagcaagttttaacaaacttggcgcattccagcaagtaggatctctcagccatggttgaaggactggtaaaccggaacctgcaaaagtaacatcacatccagcgcttagcaactccaaaaatatattaccaagtcccgtaaggaaccaactaaatgacccactattggcataaccacagtaaaatcatagtgtacgatttgtatgcaaaaataagtaaataaccaaatcagacctaaacaacggaaaaccttacatcaggctaacttcattgaaaatatcacgactcattcatattcttttggggtctatgcaagcaatggaccatacccaggtactaaccaccgagaatggcaatagtagaaatgatcatgtattgatttctaaccttttgtatattgtatagctggaaacatcttttaactatacaaaaggttagcctaccgaatttgggccactaatgctagattttaaaaactctaatccacatagactagatacaacacacgctataatgtgtacaataattgcacaaatgtactgactttatgatatgaaaggtcaaaacccagtgaatggctcacctgagaaatcatatgcccaagattgtcatagcaatgggggtatatcattgctggagttggccactgtgggtagacagcagttccagaagaggagcccatagataaatcgggttggccaaagtacacagaaggttggtttcttgacatattagcagactgcataaaaccaacaccatactgcataaactgtggcacaacaaaattgaagccaccaggactcacattgaagtcgtgcactgggcccctaacatacctgcaaaaagtttacatgttacttcttagtaatctcatcattgaaatccagtagttgaagcagaatttgaaaggtgcaactaacctcttgtagttacgatcatagtcaggatcactacgatccttttcagtgtccttaaaaacagcaactctggaacggctgttcattgtgttcaccttattctcatcaacaggaggctcaacattaattggttcatctctcgcaacagataaagctcccaaatcacttgtgccttcaatatcagaaatggaaccgttgaaaatgcgtgctcgtgctttgttgtattcctctatcctctcttcaacagttcttgctgcattgttcttggcaccggcatcacctgcaccattttggaaagccttgggccttggacaaataacaaacttaagcttctctgcagcttcatgctcatttcttgcttgtttgctgggaacttctgacaatgcaataactggaagtttgctttcagatgttttctttgcaactatcttgctaactgaaccatctactaagctatctgctactgtagtctctaaaccatagtgttgtgcaacacgatgagcagcacagcggagataagaagttggaaaatgctggaattcgaattcatgcagttgaggattctgcataaatttctgtatatccattgccatacgcaaaactgcagttaagtagaatatgatagtgagttatgtaatcagaaagaaaattcaaataaaaatacattattgatgaactggatcacaaaaaagaggcttaattcaggtgaaagattcacaattcaaagtcgtggaggttttttgagtttagtgcatagagaaataatatgacagcactagcacaaaatgtagttcgatgcagaaaaaataaacagcactgaaagatgcaaagacaggatgtgtcgcctaggcaacataatccagggtttgctttaatccatcatccataagaacttgaaaagaaaggaaaaaagaagataaaaaagaaaaatagctgcaagtgaaaggagctcagctcatactcatcctctcatggagatactgaaatgagactcaccaatcaccatcctccctcactgtagctttgttcttatgtgtaccattcatatcaacaagaatggctctatcggtgtcatatcaacaagaatggctctatcggtgtcagctatagactaagcagattaatccaaacaaaaatgttcacaatgcattgagctcaactactcaacatacagtattttcatccagctctagctgttatttcaacatagtagttttgagaatagaggacagaaaccacatggaaattcctccaagaaataaacatattgttctggtataaccttacaagttaatagcatggcactaaaaagttatgatgcctataattgattcatgttccccaatcaatttctcaagaactttaacaggttcaaatagtatgtgactaaaattcgacatggagtttccagcacagtgagatgttcaatatcaacttcaatatgttacctaatttctaaaaacaataacctaagttcaacatcagtccattatttattgataagtccattcccctaccacaaacaattagcaataacatccacacgtttacaaatatatcagcgacaatgaagctaactccttacatggctctgtcaccaaacaaagttatagcaagctgcaacaaggaatgtgctgcaagcttaagaggtagacagattgctggaatccaacccaatttcgcacggatttttagcaaatcaactgtaccaccgccctctcctagctacctcgaaccagagggaaacctagtccccaaattgcacacctagaatacgccgggaccaaaactctagcgacagccggcacaaatccgagcctaatccgaccgcgaccaaacgaattcgccgcacgagcacacccaaaccctagccgcgggcagagagctaagatgagaggcagcggttacgtacccatgaggcggtggcgagggttgtcgagcgcctcgacgaggaagggatccacgtgcgaggtgaccctcccgtcctccgcggcggcgggcggcggcggcgggggcgaggcggcgccggagctcatcgtgcggcggcggcgggtggtggtggtggtaggggggagggggggcggcggacagagagagagagagggagggggggaagctgggcggccgggtcgcctgcctctctcccttccttcccctctcctccgcttcccgatcccgaagcggctgcggcctcctgcggacggagagagaggaagaggcgtagcccgagggaaaacgagagagaaaaaaaaaaagataggtccgcagcggcagcacggctcctgatttttgacgcccgcgaggtgccgtttgattcaggatcggtgtcggggtcgcgtggaacggctgtgaccgttcgagtcggatccgacgatcggaaataaggtttggggccttgggttgggggttcgatttttatgcgcacgatattgtagatttgtagtacttggggtcctattcagtctgaacaggattaggattgtgctacgctgtttttatctacttctggagagctctcaatgccacatttttattgtaacttgtagtagttgctacgtggagaattcgtatacaatcaaaacaggattacattgtttatctacctttagaaagctctcaaggtaaaactttttaattgtaacttggatcattgctacatggagtactcgcatatcgttttaaagtcacgaatttcaaatggtaccaagagaagaaatacgtatataatgtgacatatgtaagttcttcacgaattacaaattctacataagttcttcacataaactttcaactacatattgcaaaagactagtataaagtgacatatgtaatattacaattatatgtatatacgctattagtctagaagcctgcgcctctgtaatatttgtaatttatagagtagaggcttatgcatatatgcgaacatgtatttcgtttttgtgtgaggcgtagtgtgtgatgtgtcctttccattttaaataaagctagcgagaaaaaaaatattaagctagaaaattcgtatgttatgtcgtggaagattatgtgtatccgtaaaacataatgtttatcaggatatatcgatctctgtcggtcgctctgagaaaatgtgagaaatgatccaaatatataaaatcgaaatggccctatcgcgcgatgtgtctcaaagccgttcgatcatgcgccgtgccgtggcatccatccgtgtggggcttcgcaggtgtggctttgttgtgaaggatctacaccaccactctgaccacaccttgcaatctcgcacgagatccccgttcactgtttgaaatcgagagtcgcacaagagagcgagatgcggaggctgcagtttctccccaaatccattgatagcaacaacaaccactgatttcaagaaaattataaatgatccccttttggtccgtgatttcaactggtttcagctccacatttagagattttcggacagattttaagattttatcatatgacctaaataaatcgactgaaaccctaacccgccgtcggccaaaaccctagctccccaaggtgccatcatcagcatcgtcatcctcgcagccatcaactagggttgagggcagcggatccgcccctcccgaggacaacgttgctggatccgccgccattgagctccaccgtcaccacccgctattgtcgtcctcacccctcccggtgccaagggcgacaccaccagatctgccgtcctcaagctctgccgtcattatcaccccctcggagctgagggcggcaaatccgcccctcccgaacctagagggagctgctcccgagcccactactgttggcctctctcgagcattccgttgtcactcccggccgcgaccggcctctcctgagctcaccgtcgttgctcccgcccacggccaaccgctctcgagtctactaccgttgctcaggagaggagtgcccggatatatgagggagatggaggggaggataaggagagagaatgagggaggagtggataaaaatgagggagtgggacatttttttaggtggagagaggttgactggacttttcaccacgcgagcgcccaggaaaatacattttttcatgttgatttttttaaggagctatatgtgaaaatgctgactgatttttacagggacgaccagtggtggtcagtatgcaatctataggataacctcgtcaaaaaaatcattttttttaatagtgccatgatgaaggtaaccagtaacgcgtgtccttaacccattgccaggacatatagagatgagataggcagatagctcgtagtagctccctttatcggtagcgctatccgtcgagttaaacagttccgcaacaaggagtggaggccgaggatgacacgcacgccggaaagcgaaaccaatggcgcggcctgccggccaggacggctccgccgcgggtagcccagcgaaaaatttcggcaattttgcttggtccaacgcgcaggctcctcggcgtcggcatcacggcgggggaagcaaccgcgtgcgtccacatgaaaacgtttgttttctcggcaggcggccgatgtttgatgggttgccgacttgccgtcgttttttttgcgcgttagcacaagcccagtcacgatggcacattggcacccgtacggccgtacggtccatcacgtgtaggaaattgtggtgggtgtgtgatcgcttttgctgatgacccgtggttttttttggtttactgttaggatgcttcttacgggatgaaaacagctggaaactatcggaatcggcagcgtctctttgaaacggatattcgattgtaatgtttatcatttaaattactcaatttttgacgttaatacaataaagaggatattagaaaaaacaaaatttgtatatagcaaaaaaggtaacggtcgaaaacggtatccattgtatggaaaatgacactcggtcgatcgggaatttatgtgatcattttcaccccttcatatcttggcatgtgaattgtgaaatagaagctccaactcctcggaaaaaaagacccctttgaatcgtataaatggaaaaaggaaggaatagaaaaaaacatatgattatgataggaattcaatgcaaaataggggattgcaaaaaaaacacacacacaagaatgatcttctgattgattggattgtagaaaaacatagaaatcagatgggataaatatactcgaagacaattttccaaaatttagtacaagacatccaaaaatgtgtaattagctgggagacaccgtaagaatgcgtatttgctataggacaccacgaaaaactggtaattagctgctggacaccagcaagttatttcgttatatcttgaggaattggagagagaaacaacaatgtaagtacaattctacccttttgattttttttttctttttctctattcttctctactccttccttattcttttctacctctcattctttctatctctactctttcttcaagcgagcccgaggggaagggagagcgtcggcgacggcaccgcgaggcgtgggccggtacgacgcctcggctggggcggcgttgcatggtcgcccgcagggggccggggccagcacaacgcagcgaaggtggcgccagagcaagaggggaggtggtgccgacacggttgggcggtgtcgactcgtagtcgtaggtaagggcagccgggctcggcaagcgtgatcaggccaggagcgtggtggctccgagccggctttgggtagctcgaccggatggcgtcaggtgcttcagtcgggctcgggaaagaagagcgtgaagacgacgttgggcccattgatgcgatagcagtggcccggtaaaggaagggagtggctgagtggggaggccggccgccgcttcgtcctatgccatcggcggcctccccaggcttgctaaagaagagatcacccccatacccgagatccccatccaacctaactctattgggcggctgcaacaccaccgcctaactcccgccggccgaaggaactccttgtccacccactcgcttcgtcggctccggcgagtcgtcgctccaccgcccaatctggaaagaaagagtgagatagagaaaggggggcttacatgtgaggtccacattggattcatttgagccaagggcaaacttgcctttaatatttttctctctcctattcattaaaaataataaaataatatcgcaggtatccaacagctaattaccagtttttttgatgccctaaagcaaatgtgttcttacagtgtctcctaactaattacatgtttttttgaggttctgtagcaaattttgcattctccaaaatatttacaatattcttcattccataggaatttgagaggatacagtaagatttaattctttgtattaaagctctcatataaaatttttctatatgataaaaattctttaaaatttatatatttttcatgtgaatcaaaggaccccgagaagccgccaatttcctgcggtgatgaggaagataaatatgttaggtcccacaatttaccgccaattgcctatggctgcagttgcctttcgttagcaatagcgagcggaccacacatctcgtgagaacaggccagcatatccacgtttgccttgtgaacgtatggtactgaaaaacaaactaaagagaagctatgaactttcaaaaggaaaaacgaacaccaaaaggaaaaagagcccgaattaccccctacatcgcaaataaagtcattttacacgttaaactttttaaaccggacagaaaatccccctaacccaatctgaagcgttttttttaaattattacacagtacaacgcagacactcacaacgtacacaaactcacccctataaacgcacacacgtaaatcctacctctatgagcatctttgaagactggaacggcaaatccatcctggagattgacgaagccgatcaccatagacgcctcgccggttttgattgtagatgacgcacgagtggtagtctagtttaggggggaaaacggttttattaaaattgcgatgacatatttttaatgtcaaatcacagtcgattctttttgcattgggtttaggcggatactcctgcttgtttgtgcattgtgacccagcgtgttaggtctggaccgcgtgagaagtaaacatggttgaatacagtgcaaacgatgagtaacgaagggcatacccctacacgctaagctaaatagccatgcagcgctttattacgcattcgtataaaaattactctacactgtaagtattacaagttatatagggcaagttttaaaacatagtacattgtaattaggaaaaagtaccgatcaccctcttaaactatagcagttgactaaattaccccttaaactcaaaaaccagacatcgttcaccctcaactattcataccgaatgaataatcccctaagcatcgtcttggatggttttaacttgagcttacgtacgtggccgccaacatggcatccaatcagcaaaaaaaattttaaaaaatatctaggcccacatgtcacctcttttctcaagcaaggcgtccctaatccccattccccctacttcctgctctctctctttcatgatgtcattgactggagaaggacgacagagagggacctcactcgaggagacgacaatgacggaggtgaatcgacatgagctcagccaggcgcgcggaggtcctcctcgtagtccttctcagcctcctcatcatactcgtacatctcggcatctgagtgcggcagcggaggtgacatgacctccacggcaaccactacctcgctgccaccatctccggcgaccaccacctcgtcgacggcagtggtggatacaatagcgcttgcttcaccctatttgtcagcgcgctgtctagccccgcccgtgatgccctcttcccagcggcgaaggtgcaacggtagaggcagccatgtgtggaacggggagtgggagcggctccagtagtgcacggaccaacaccggaggtggccaccacgcttgtcctccccaacgatgtcccacgccgacgagctcatccccaacagccagatccgaccaatgcggctcccgtgccatcgtcgcctccgcggtcaccgccctcgccgccggtcacgctgctctcgcctctgcctccatgctgggaacgctcgtgcccctcctctagggcgagcgtgtgcgggagagcgggccagtcgctgctaccacacgcttcagaaggggagggaggagagagaaatgggggtggggactctaacaagtgagccctagttttttttaaaaaaaatgtttgctgtgactggacggccacaagtgctattcgaaccctaaaccattctcaacagtgctgtggggggagggggttgttcggtattaaaaattcagagtgaacgatgtctggttttcgagtttagggggtaatttggtcgaccgctatagttcagggtaattcgtatctttttcttgtaattataatgtaagttttaaaaattacattgtaactgcagtgtaagttttgaaaaatatagcgtaaacccttgtattacattgtaagaaaaatcttattatattttgttaaaaatatgacgccataaaaatatatagtaccaaaaattaacataaaaactgataactgttcacctttttaagttgagtttttttatcatcaattatcgatgtggcactgaaacaaataaaatatgtgtatatatatgttagtataaatttaacacgggaactggtaattctcaaaatagacggtttcatgattattctcatatattgaacatgacgattgtaccttgtccggccaaaaagagtagatagaaaaaccaaactagatcatttccatctggtctgggcctttatacctctttcggttgatctttgtcttgcttctacgcaagggaaagctcacggcgcccaaaatgatgaaagccacgtcacacgcaaaacgccggcatcgatcgcatagattgggaaagctccatgcatatatgtactgttcgaagcttagaaaattccatcccgtcagcacggccacgaaaaggagaagtggagtgagagtggtgcatattccgaatgagaccctctctaagccactaattttagaggtgcatttctctcaaaaaaaaaattagaggtgcatttgcatctcaactttttcaactcgaagattctttatgtgttatgattttcattgtcctgatcaaagagttatataagaacattttcacaatatgctaactcgtgttttcaatgtagcatatgtacaaaaagaattacaatgcacactttcacaaaattggaactggcctatgcttgcattctttatggtcccatctgatctcccggaacaagataataatgaatttaggatcgatgacgtaggattttctcattatatttgtgaaatatctcttctctactacttaaaaaataagaggtgcttccatcgtccgtaaaaaagaccgggcaaaaaaccggcgaaaaaaacaaaatttatccaataaaaaaccgggtaaagaaaaacgtgtgcgaaaaaagaaaagaaaaaccgatccaaagaaaaagcggtaaaaggaatccgatccaaaaaaggggcaaaaaaaatggacgaaaaaacaaatctgtctgatccaaaaaaagggaaaaaaggaaaaaaaattgaaacgaatccgactttgttgacgcggtaaaaaaagggcaaaaagataattaaaaaaccgtccaattcaaaagaaaaaggaactatatatgacacggtaaaaaaattcgaccgggcaaaaaaaaactagcgaaaaaactgggcaaaaaaacaggaaaaaaaaagtccgataaaaaaaacagggagaaaaaaaaccgggtggaaaaaaaaatctgtccgataaaaaaaagggcaaaaaaggaaaaaaaaagtgcttctgtcatccgtcaaaaaacagggtgaaaaaaaccgagcgaaaaaaagtccgatcaaaaaagggcgaaaaaaacaaatctgtccgataaaaaaaacaaggtgaaaaagggaaaaaatcgaaacaatccgactccaatgcagtaaaaaaagggcgaaaaaaattaataaaaaaactgtccgattccaaattatatatgatacggtaaaaaaaatcgaccgggcgaaaaaaaccaggtgaaaaaaagaaaaaaatttctgataaaaaaacggggcgaaaaaaaatctgtactatccaaaaaaaggaaaaaaatcgaaacgaat

SEQ ID NO: 74801 - DNA, 8504 bp, Oryza sativa
aaattacgagtttagattttaatcgtgtagattggttgcaaacatatctagcataggaactatctagcatgggaactattatataagaaacaaaaaaaatgtagtttttctaaaaatgttatatcacatcgctaaaaaaaaattgcgtggaaaaatcggttttgcactacaagaggtttaagtgaacatgtacatgaaaacccctttcagagtgaaggtgaaaataagcagattcaagagggcgtatatggaaaattcaataaaatacgcacaacaaacttatcccgaatagtcacagttcctgcaccacccaccagaaccttcccgatcaaaaacctcgtaacaccattcttacctttctcgtctttacccacctcacctacacctaaccaccgtgggcccgagaccccaccataccagcgcacacagttccaggcgccttaagttgtgcgttactcgcgtcgtcctagcacttttcagccactctccaccaacggcaatgctagatctagccattcacccccacccccccccccaacacacacagtcacccactcacctcgacaaatatggcaatgacttgtgggcccagatctacgtgggccccacgtgtcacgggggtaaacccagccagcgtctggaaaacatacaggtaggggggaaagagccggatcaccacgcctcgagcacgagctcgtcaacgactccgtcgtctcgtccacctccgaattccaaattttccatacccttcctcccagtccttacacctctcgatgcaaaaaccctagcgggggaagcaccacctgcgcagccgcagcggccatggcggagccggccctgctggaccccaccgccgccttcgacctccgcctctacccggcccacctcttcgaccacgaactccctctcgccggcggcggcggcggcgacgacgacgacgacctcccgctcgacgggctcgagttcgacctgcccggcgatttctccgtggaggacttcctcctccggtctccggagcgggacgactccggcgagggctctgctgccggatccgggcccaccgcctccccgtcgtcgtccccgaccacctcggcgtccaactccgccgtcgccaacggcagcggcggcgaggtcaagcacgaggagtcggatgaggggaggagcggtgggggtgaccccaagtggagcctgaagcggaagcaggcgagccccggcccgagctcggacgcggccaagtgccgccgatccggggacggcgacgtttctccgtcggcgtcggcgtcgcggaccgctgtggattccgacgagggggggacggtgtgcgaggaggaggaggacgagcggcgggcggcgcggctgatgcggaaccgcgagagcgcgcagctgtctcggcagaggaagaagcggtacgtggaggagctggaggagaaggtgaaatcgatgcactcggtgattaatgacctcaattctaggatctcctttgtcgtggccgagaacgcaacactgcggcagcagcttagtggcggcagtgtgaattgcccaccacctggggtgtatccgccggcgccaattcccggcatgcatttcccatggatgcctgggtatgcaatgagaccccctggttcccatgtacctcttgtgccaatcccccggttgaagccgcaacagccagtgccttcatccaaagtagtgaagaaaccagagagcaagaagactgtggagaacaagagtaagagcaagaccaagaccaagaaggtggctagtgttagccttcttggtttgctgcttattatgcttgtctttggtgctttcattccagggtttaatcataactttggaatgtgtgggcagagtgataatgctatgtttaggaattttggtcagtctcatgctagggtgttgagtgtcagtagccaggataaaagtagtttgaacaatagcgacatgattggtgttgatgttggaaagatgacggggaatactgatgggccagggaagaaacatcagcctgcacacaactcaagtgagatcctccctgctttgttgtatgtgccgaggaatggaaagcatgttaagatcaacggcaacctgattattcattctgtgcttgcaagcgagaaagcagtggcacataaggcctcaaaagatgatagtgatcagtcagctagagatcacaaagagactagtgttgccatagctcgttatctttcgctgcctggaaaggatgtgaatcgacaggagacatcctcggcagatggaccattgccacaatggtttcgtgaaggaatggaaggtaagcagattaatatgtttgccaatcttctattcttgttttctgcgaatttgtgatagttcaatttttaattttgtatttcgaccagagccatggtttgtttgtcgaatacaaatattcttgtgtatgctactgaagctgtgaagtttattgcctttattatttactcagatatgtaatatgtaaatataaatactaacactatatagtggtccatgtaatttcttttaatacacggccattgcatccaatatggtttggaatgcagtcatgaatgcaagtttgaaatacaagttaaaaaaagaatgaagtgacttcctgtaggtcatagagaaagcatgaagttaatatggttagacagggatttgcgttatgtttacatgccaacaataggacacaattgttattatctaggaaatgaaacccacatttaaggttgtgaagtaataatcagacactgcaagtctgcaactaatttggaaattggaatattatttattgaaggtcccctattaggcaacattttatacacgtcactctgacatatgggttttgagatcacccagttttgtgaaactgaaaaatatgccacccgagtttcttgttgctctgaattatgtcatcatatctcattttcagttcttcccttgtgttttcttctcatctcatctcttattttcttttcaactgaactaccaatcttccctttaccacttgggcgattaaattggcacgggataaatttgtgctgatccaaaccagtgaatagttgacccctaagcagaaaggtactgcagcatcccaaccattcgttcttcgctgctccatccactggcttgctactgctcttactcattgccttccacgcgagctctcttcattgctgctcactcttttttgcctgagcgcatggaagcatggatggatcttacagtggcggaggagaaagatacagctggggacagagacggaggaaggtggttggctggcggcggttaagttgaacactaatggctatattaataaaatctttgtagtcaatgtgataaccatgtgtcatagactacaaagaacctatgtgttgttaatcctttatcccataaatttctttgtgaacttaacataacagcatggcgttctagatctcaagtttctgtaacaaaataaataaatacaaatttcaacttgtattggttattttgtagtgatccctgcttttgctcttgtgacttaagtgggaactcactctttgctgaaattgtggcaaattggccagtgctaaagctagttcaaactaatttacatcctattataccacaatcctagaattatgttttttagggcaatcatagaattatgctgtgttgtttaaagcatactccttggagttcctttcgcttttctttctaaactttaagctcaactgaaaggtttactgtactggtcaaatatatattcagcggatccctaaatgttcacaagcttgtagttgcacaaaatcaacaagttggagtcttaaggacgtatatactttgtgttgtttagagtgttagaccgatttccaaattgttgctatcaggtatttcttttgaaaagctcaattgtttattcctactctgaattctgattgttatgtaacacagttcctaactctatgttgctatgcaacaacttttgcaggacctatattaaattctggaatgtgcagtgaggtatttcagtttgacatttcgacggcttctagcaatcctggtggcattatacctgcatctcctgttgtgaactcgtcaagtgtcaatgctaccgagaaaatcccagcacattctgctgcttatcatggcaagctgaaaaacagaagagtcatgtacaatgaagcgattccactcaccgggaagacggcgaacaacacagagccttttaacagaacctctgaaagcagcagcaagttacctgatagcaagccagcatcatcagttgttgtctcggtgctagccgatccaagggaggctggtaatggggatggcgatccgagagtatctccgaaacccctgtccaagatatttgttgttgttcttgttgacggtgtgagatatgtcacttactcctgcacgcttcctttcaagagctccagcccacatcttgtgaactaagcggctgggttgttcgccaaaaactgacagatgaatagatttatacaatgatctgatgctgtttcctaaccaaggactaaacttcctatgcactcaggctgaggtaattcaagtttgtcgaaggttcggagtgatgagtgcgagtttagttaatgtatgcagtttttgcagtgctgtgataatcgggttcgtttgctgtacctctagctgtaacggtgatgtaatcatgtaatactgtttgatcgttgagatataagtgcaactagtaatatgggtagtcgagaacacgtgcagaatatacatgcctttttttaccttagtttcaatgaatatcataaacaaagctacagtacatcaggttgctgaaaggtattttttatgctttgatctggatactatttagattatgtttaggctgaatttgttaggaattttgtttgtaatgaattcaggaactagctagaaagaattgagtctggtcaacatatctatgagaatatctgttgttaacagctgtgcgttgagcttgctagtctatcttttacagcactatctaatctagtatctactcgtcttgttattcacaaggtctattctaaaaaaaggatatttaaaatttccaacttacaagcctttgcctcataatttgaatcgtgaataaagaaaatagccgttattagttaggagtgtttttacacttcttccagaactgctaaccgatgcaatttttttaaataattctatacgaaagttgatttaaaatattgtagtaatatatttttaagctttttagctaatatttaactaattatgtgttaattcatcttttcatttacgtgtcagtgaaaaagttcacaaaccctccaaccgaactatttggaggagctaaatattctgaaaaacaactatttaatagcagcttctaaaaatctaaaaaactgtattttttctagtttctggtttattttctgaattttataattaaaatatggatgaacaattgaactttgtagggagttactaattcttgaaaaaaaactgccgttacagaaaaactcaaaagagatccttaaaatgaccctgaagaaaccgtcacgcactggctaaaacccacattatcctcaggcgcaaccgcgctctccgttcttccttccaccccaactcgccatggcgctcgccgccgcctccgtctcagttctccatctcccggccatctccctcccgctcccttgccttcagggctcaaaccctagccgtcccagcctcggcttgaccaatgccctcccgtggcgccgacgcggtgggcgcggggcgggggcggtggcgggggcggtgcgctgcgcgaagcgcacgggcaagcggcggtacccgtcggagaagaagcggctggataggcgacacaaggagctgctccggaaggccgcgccagaggagggctcggcggggcgggaggcgggttactggcggctctccaagctcgccgtccctgcccgcgacgaccccggcaaggacttcgctggtgtctccccgccgctcctccaagccatcgccaaagcactgaaattcccggtacgataatgcattgcatttttgtagtagctggtgaaatgcagtaaaaaattgcgaggttttagaatagctacaccgttgatgatacagaggattttgggggcgtggattcccatgagtcgctgctctggatgtgtggaactgtaggaaatattgccctagttccttgtgcggatagctcaattcttgatttgagcagcaggttgctaatttcctctttcaagttatgaaattaagccgcggtttgcaacttactaaacatgcgtacggctctgtctctcgagcatgtttgaacgttgttcgtaaccgtctatcgaattatgcatatggttcgtgcattatctggcagggctgagtgttagctgcttgcaacctgttatacaagtttccgattgcgtcctgctggagtaatctcaatatttaaactacaacgtttagtgatacgcctttcccttgaacattgtgactatggctgcttttgcatcttttgtccatattgctgagctcatattttatgcttagacttattctaaagttatgggcttctaaaatctattctgttctactgtaggtttcttctatgctccctgaagaggccttcaccgttattcgcaagtcgtttgatgcacggaaggttctttatggaatgattccatctatatcttatttagtatttgttatcctgcaaagagacgagattgcggcttggttgttaactgtaacacagatgcttgatgttgaagctgctaaatagtgcacccaaatcggattaacattaacacaaccgggaagaaacccaatgtagtaaccttcatttcagatctccattaacatgtcatccttctgttgatgtgtccgtcctaacacacagggtaacctttatttgcatcccaagtttgcaatagttccagatggccctgtaatggctcatctgagggtttaaggaagaaaacatgaagtagtgaagaatttgactatttttgtgctacctggtattttgcttagaatactggtcttctttactagatccttttgtcttgatgtcttgcagcaaagtatattattgttttgtttcctttgcttggttgttcttcattccgagagtgttatttcaggttttgcagactaggatgaagtcatgatgctctgcatctacttgtggatttgtagtcaacactaatttatgcattttggtttacatctttcatctctgtttctgactttgcactatttttttttttgttctgtaggcatttttctgaattaaacacatctttgtttatgtggactttaccttatttcagtgactggttttttagcgtgattatacaattgtagttatgccatataaaagttaattgtaatacttttcctttctacaaggctctgtgttataccgattgcaatttgcttcacctgtgttgcattcatgtgtcagtgttggttctactgcgttgataattgtttatatcatttatatgctgattagtttatcacttgcacaatttctttgtgactaaagaaatcatgtttaacatggcagattttgaaagaacctcaatttgtttataccgttgatgtggctgttaagagacttctggatttggagccgagaacgtgggattttattgctagattggaaccaaagcttggaacaatagaatacatgcctgatgagaaagtagcatctgatctggtcagtatgcttaatgtttataagcaaggttctgatggtgaactgggaatcaatgatactgtcaataatggctctatctgtagtccgcgaaagaaaccaagggtggcagttgtaggaagtgggccatcaggcttgtttgcctcccttgttctaggtgaacttggtgcagaagttaccttaatagagcgtggtcaacctgttgaacaaagggggcgtgatattggtgccttagtagttagacgaattctccattcagaaagcaacttttgctttggagaggtatactactcgttcctattttgcttacaggacttcaccaaatacatgtcagaattgtcttgagatatgttcgaataggtattttgttgacaatggattgaggcatttaacagctcgacatatatcttttgataaacatataaagtagctatatgtccatttggctactattatggccaggtggccacatgaagtgatttcatactatggcagttggtgcatttataccaattacttgacctgaaagaagcatacatgtctagacgttatatgcatctgaaataatgtaaggatgctttaaatctattgaatgatcatgctattttgaaaactgttgtgccataatcttcatatattatcaccattttgtccatctgttttcatatcatttaccatgtataaattaacaatttaaaattgaacttatacactgtacagtatgctcaagtcgtgaactccctactcgattactcccacccagtcacaaatatctggcgtttaggataagatttggtca

SEQ ID NO: 74802 - DNA, 698 bp, Oryza sativa
cctcataattcagttataaaatgcatggcactgagctttgcttgcagggccagggcttgtatccaaaagtgatctatgacatagacaccataaaaattaccatttactgtgtggtaacaacgatatgttgtagtatgtgtaaaaacttatgtagagacctgtgcagctactgataccaggctcctttgatatatgtatctatcgatagtttaaccaaccatgtaagcacttgaatagttgccagtttggtacagctacaacatactgtatttcattttgtatattatatggtatgtgttatttgcattcaactgcagtactctgaattggctgctgaagtacataaagggcgtgggcggatacctgtagcagattacaagatagtgaaatcttttggtgaaggagatgcagagctaccagaacaaaatcgcagttgttactcattttgcatgtgtcctggtggacaggtcagttgctcttttgttgtttcactcactccctcttctaatataggagtactactagttactgcaatcctatttctactgaattctaataataacgtgtgttctgattttttaaaaaaaaactcttgcaggttgttctaactagcacaaacccatcagaattgtgcatcaatggtatgtcattctcaaggcgtgcatccaagtgggcaaactcagcttttgtggccactg

SEQ ID NO: 74803 - DNA, 3009 bp, Oryza sativa
aaaataatattagcgtgtagacaaagcaagtgcttccatttttgctcatgacatatatattcaataatagatcaggcatatgctccatgcatacatgagctgcacacatataattttgtcatagaacgtgcaacatataatacatgctggtgacatgtaatgagaggttgctagttagatcatgtctgtttgtgtgtgtgtctattccactttttaggtaattgtgtttcttaattactgacggttgcgtgttttaacctgcagttcgattaccaattaaactagaggaatcaaagcattccaaggagatactcccaatacatgttcattgatctgtgatctaatcattctggttacataaaaagtcacaagcttcaaatcaattataatatataaatggaagatcctctccatgcatgagctatatatcaaattaattaaatgctgacagtaacgttacatgatgcattatatttgcatgaccaacaaggcttagcatcacacaattaatcaaaactaaagttcacattgtggggataaatcagatgaaaattcaaggcatatatttgatgcattctttgatccttaacaattaaattagtactatattccgaggaggcaagggtggccatgcccatggctccttgttttactctcaagttagttattgcgtctgcatgtggccccaatataatcgatcaacatatatatatgtttttatgacacggttgtatgttgggctcagtgttcatggggtcactgataggtaaggctctccgacaccatcaatcatatttccacatcgatttgatcatgcatctcatcttctttttccagtttccactaatatcaatgtaagaccaggaagaaatctattcccttcgtttcattttatcgagtcaaattttttcatgtttgactaagtttgtaaaattaaaatttagtatcatttactgaaaaaaaaatataatattatattaaaatgtattcaatgctagatttaataaaaacttatttggtgttgtagttgcttctatattttctctaaacttgatcaataaattgcacttaggacaaactcaaacatcttataatatgaaacatgggaagtgctagctagataattaaggttagtttcacttacatggtctatacttttttatttgttatcattccaaagttaattagtaattaaatttgtctggttttcagttttctttcagaaaagttttcataatttttctatcatcatctactgctttccttcacatattaatatatgtagctagattgcacgccatatataccatacatgaaacaaaactcagggtcctcaactagctctgatgattcttaagaactagctaagctagctagcttcttcattctaatatatatgtcttgttcttcttggtaattttcagattagtcagtacgtgggtatatattccagtgctgttatgatcattgctcaaacggacaacgaagaggtagagaattattgcctattagtggccacatgcacaatctatggtctaagattcagcattgaagcgtatatacagtatgttcgacccaattccgacagaaacctgaaagaggctgatcaacatgtacatgacgatggcatgaatgctcggtaattcatcagtgaaaagaaagaactctacatgcccttgacaatgtgttcaatccaaatggcttgaatttttcatgcattttgcaaatcagtgagtaataatatatactccctttagatgcatgcatgcctacattatttcccttgtacatgattgaacttggtgtgtatgaaattaacaaattaatatccaacatgtacagatcgccaatgcatgtgaataattcagagatatgtacttaattatatgttcatgatcagtactactggcagtgcaggtaaagctagccagctgcagtgatactgtgcaacaccaaacgatccagctgaccggggaacagtagctatagcttagagtcttttgccacaccacaaagaaatctttccatgcaaaaccaaatcaagggctagctggaatatgtgtttcaggaaagaaaccaagagagatggagatggagatgcagatggtgatccatctcctgtagttttcagctctggccctctctctctccatcttatattagcttgccaccagtatatgtttttgctgtgactgtagttgttgaggtggttggatcaatcagtccttgaaaagggaacagaggaaagaaagattaaaaaaagtgaaattataggtaagttgtgtgtgattcatacaagtgtggagaaagagagaaattaaagtatttccatttttctctttgagagagagagagagagtgatgctgatgagagttgagacttccttcatatgtaatgagtagctctagcttgttttaacttttaaggtttagggtcactggccggcacactgcctccatccataggaaaaagtttgctctctgctagtactcctctaaactatttcgacggaacacataattaaccctgacctttttggctcacttgaccaaacacactgtttaaaacgaaccactttactttgtaccgacatttcttttgtttctcacaattaacacacgacccatagttctatcactagtgagtgaagttgggtaattttttattatagtttaacggctaaaacactttaacgtaatagtttcaagtactagaataaacttttcggttcacaaatattatttactagtatttatttccttaagaaattttacgactattaattaaggagaaaccgagaggtagtaggagatataaaatttacatttaaaagattactctaaaggatgttaacatagtcaagactagttcatcaactcaaaacaatatcccatctctcacctctcctctccatcccctccaccatggcaggcgctacctccatgtcaacattgtcgttgctgactcaaagtcaagagctagctagccttgctgcggcgcaccactcg

SEQ ID NO: 74804 - DNA, 5744 bp, Oryza sativa
ttctctacacactttaaatcttctataacattattgagaataacatttttatttgaaggaatcacacctagattattaagggaagcagaaatttgatcatttgtaaattgtaaaaaagaaacattaacatccatattacctttagcatggggtttctccaagttcttttccgccttcaacctttcagctctttcaaggacaagctgatcactatcagaagctctccttttgcttttcctggatggagaaattaacgcctcgggaatagcagagatttttccaaccagtttttcttgctcaaccaacacggtctcctcatccaacccgtcaaaatcttcgtcagacgcagtcaaaccttctgactccggtatcaaactcaactgagaagaggtaaaagaaggaccacccctctcagtaagattactatcagtagccatactcacatcagagacacccagtccagacttctttcccatgtccttgtcattttccccatcgtcatttctcttcccatcaccatccccaaaattatccatatccaaaggaacaggatccccagcaccaatatctgactccactttaaaagacagctcatacaaatgatcaccaatggccacatcaacaacatcagggattagagatgggtcaaggaccaaaacttgtaaacgagctatctcataccttctagtaaataacatatcaacagctttagtaatcccaagaatagaaccaactgcccaaataattaaatattccctcaacccagaaggaagccccttacactgaacccaaacttttggaatgacatatttcacctcattcccaacacctctttctatgatctccatctgagcctcaccaactttagtgtgcacctttccccattccaccatgcgattcagctcagcagcagaaggaaagatggtatgaaaagtgttatcaccattgtcatgtaccacccacctccatttaccaggaattaacctctccaattcagatacaacagctttaactgtcatctgaccattagatattttaaccaaggccgccctagggtcatgcctaatcctttgtccagctgggagggggatatgaaaaaatcccaaaccatcacccccataaccacataactgagcagtaggtttcacagctgatctaaaaacaggacaccgggtagcaatgtgatccacactttcacaaatttcacaataaaattttgatgaacactcctgaagagtatgccccttagtcaaacacctatagcagtaaggtttacccaatcccttagtgtctgcctttgatttacctttctctgaatcagtggcgcaaacaagcaacccttgttgtacgggttcagcacccaccgccggggtaacagatgcgatgacatcacccgttttagcagcagcaacaagagtaccacccacagcaaccgatccactaactgacccagaggtatttgcagctaaacccgtagaaccactagccgaagttcttccaaaactcggtatcacaccaactgaattaactgcagaagtcccaacaatcttacccacatgtccactcggcgtcaaacctgcaggtagcactagcgatgctgacacagaggtagcagtggctccctgaccaccaccacccagcggaagaccagctgcaggaactccacccgggtataaaccacccggcggcccaaaagcacctgccggcggcgccataccacctgccggcacaccactagatccacccgtcgctgcaaattgaccaccaaacgacggcacaccgaagaactgtgacccagatgcatcacttgccggccggccaaaagagcccaaagggaaccctaaaccggaattgaagccagttggcccagcattctgtccaaacccaccgttccaaccttgtcctcctccaaagttgccatgccatctaccactgttgccgtgagagaagtcatggcgattgttgtgaccgccaaactttccacgaccccgtccccttcctcctctaccatctctgccttgctgtggaaaaccacctccggaacccggatgaaaaccccgagcaaagccaccgccatgcccgccagcaccgaaaccctagcgattgtttctctccattggcgaagaactagcgacagcggcgtaggagcgagcgcgagaaggagatcgatctcccaccaaacacctgcgcctcacggtaccagttttcgcaaaaagagcaactaacccgggtatgggcctataggggatagcgggctttggataaggggtacattgtggacttacgttaattgattcagattttgtaacctccggaagtttgggaaattccaaattcgtcaccgtcggatgaagtggaaacctcaccgaatcggaagacttcaccggagaaaaatcggacttttgaaaccgcatcttccccaccagaggagattgaaatctcgccggggtagaaccagaaacggtcgccgggaaaacggatgataccttcccttgcagcgctgaatagatagcctcaccaacagttctcggcggagacttcctcggcgacggcagcggcccactccatggctttgatgcgcactccagagaagatgacaccaacggccaagactcctcaccatgcaaagcctgcaaaactgaaaaacgagaaccagaagactcaccgattccattttcctgatgatcaacagcagcaactgagacatgcacaggcttcggcctcaacgccgaggccgccgcgacctcagccacatggcgtagccgaagacgatacttgcaaatacctcctttgttccaaaataggtgacatttaagaatatatgtagctgaatctctaaatcttaacttggtaataaatacacaatgttgaaatttggagtacatcagttgatcagtagtacacatgtgatgaaaaatatatgagaaagcttccatatggctgaatttttaaaactactactcacatcgttccaaaataagatcatctttgcctccttttaattgtcaaaaataaattcatctttgagcaattattacattgaaatatgtaaaaggggaaaataattgtattgggatttcataaaatgaagcgttttttttcttttgtgatagtatgggcgtgatgggtgaaaaagaaagttattttatgattaggcgagcgtttgaaagggtgataaaatttcctcgttttccacgtgcatgtttcctagactactaaacgatgtgttttgtttcaaaagaaattctattggaaagctcctttaaaaatcatattaatccatttttgaagtttaaaatcatacaatagtgggtcactgggtcaccacattttatgtatcttcttgtttcccctcctctaaggcaacagaggagattcactggtggagaaaccatctttggtcggtcaacccaaatccacaatagtcccggttccattaaaaaccgggactaaaaacgatttttagtcccggtttataagcgtaacaggactagatcatctttattcccggttggggttaccaaccgggactaaagatcatctttagtcctctttagtcccggttggtaacaccaactgggaataaagatgatctttagtcccggttgtctataagtcagaccatgtcaggcggctaggatctttagtcccggttggtaacaccaaccgggactaaagatctaactttattcccggttggagttactaaccgggaataaaaatcaacacgtactatataatccctattacttatcctcttttcccgtccacacaacgaactctttctctatctcttttttcctctctaactccctatccttattatttcttctaccttcttccttagttcttcttcttccttagcccgcttggatcggagcgagagaggccagccacttggagcgagagcaggccgagcggcagccggcgcggcggcgcggagggacgggcggcggtggccggccggcgcggaggggaagccggcgcgcagcagcgcggagggccgcggcggcggcgcgggggccggccggcgctgaggggaggcggcatggaggcgggcagcgccgcggcggcggcgcggcgtcgggcagcgccgcgggggccagccggcgcggaggggaggcggcacggcggcgcggcagcaggcgggcggcgcgatggcaggcgggcggcgcggcggtggccggccggccggcgtggaggctaggcggcagcggccggccggctcctctgttgtttttttttttaagaatttgtgatttattgcagcatcatgtgatgaatttgatttgtatgtgatgtgaacttgtgatgtatttgtgatgaattttgtagaaacttgtgatgtaatttgatttgtgtgtaattttttttaggatttgtgatgtatttgatttgtgatgtaattttttagaactttaaaatttgtaatgtggacttaggatcttacttcgatttgggatatgcataccacctatattagggagaaaataaataaaggatatgcataccacccagattcggaagaaaataaaaaaggaaaaaaaaacctggctatcctctttagtcccggttggtaacaacaaccgggactaaagataccctatctttagtcctggttggtgttacgaaccgggactaaagataccccatctttagtctccgattgctactcctggttgaaaacccgggactaaagggggttcccaaccgggagtaaaaagggtttttctacctgtgattgtccgtatgaaaaaaaaagaagcttcaaaagaaagaaaggaaggaagacaacaagatcaggaaggtagaactgtactacagctagcaaatggatttctgaaggaggtcacacgcaacaaaggtcttgttaaaatcagtttgattttaagaaatagcttgtcagaagtcggtttctaataatttggagaagttgatattcagttcattttatgatttctgtaactaaagcttctcaaaatctgaacgaacaacataatcgtttaatttgaggagaagttgtagctatctatgagaatctcgtcaaacatacgcagggtaccatcggtaagactacaacatttagggcatctacaatgcaagacacccatatagtgtcctcactaactgaatacacccatatggacattcgtctcacaatggaggccacaactagatgggtttctcaaaatctatgggtatccctaccaaaaagtcaccgcattaaatttcctcatctaccctcctcggcaactcctccctctctctcgtcgctcccctttctcccaatctcacgcgtcgagcccctccccaaccgccgccgcgcctccctcctcgccctccccagcaaccgccgctgcgcctccctcctctcccttcccagctgctaccaccgctgccgctttctcccgcgagatttggatgtggggagccacggtgctgcctcctactcccagcccagcgcgtcggcggctcggcgagcaacgcgcggatccgtcgtcgccgccggcatcgtctccaggtcatcgccggcttcgtctccctctccctctcgccgccaactctcacctctctctccctccctctctctctctctccctcgccgccgccgctggcctctctctcccgtcaccggcggccgtgagggcgatgagtgagaggggcgaggggtggaaggggaaattttttgtgggaacggtgtccacaagccacgctcgcgtccaacgtgccccctcggctgcgtt

SEQ ID NO: 74805 - DNA, 5039 bp, Oryza sativa
  unsure (1)..(5039): unsure at all n locations
gggggggggcggacggaaaggctaacgaacgttgctaggggcacggatcgaagctacgcattggtgatggccttatcggttttgtttagggaaaccataaccctactgttttagtaagatgacaaagaatcagttggtctacttctctactactagtggagagtggagtgtaggcagctgcggcgtggtgggggcggtgtgtttgggggtagtggtgggcgcccgccactggtggtgtgtgcctccggcaagccggcagtcacgtgaacgtcaattccatccactcactgccccaccccaccctccctcacatgcgttgccacgctcatctctattgctactactgctaccaacattgttcgacagaaaacgaaatattttcaagtagtaatatcttttggaacaaaaggaatttcgcaaaaacgatagagaaatcaaaccaatctctactagtactcacaaacactggcgtgtatatgtagttgctgctggtcgttgcatgcacgtacgagctcgttcgttttgacttgggatgcatgattggtagcactagtacggtgtactccaaaaatagccgttgcattgcatgtccggattcgttatccagatctatacgattataactacttatcgatctcacttatatcacttggactttagctactaagtaggagtatcagtgtatcactcactctctcccggtcggataacacaaaaacctctctgttttctccgacacgtacgcccaatcatcaacacagctacaactatatctagctatccaaggaatctttcatgcatcctcttcttgtgtagctctagtccaactacagatcacaatgtcaagagaaaccaatcttaacttaacattataccctacccgtatctatctaaccacataccaccaaaaaaaacacctaaattctattccaatgatttcatactagacatttccaaaaactatcagccgctgactacctaatatttataactatactagtaataatttattttttgcagcagcaacagcgctagtactagtgcagtagggttgttaaaccactctcactcatggtggaagacggcaaaagtgaaaaggcgccttcactgcccaacgcacgtaaaagcaaatgtagcctttcccgaactccaacccaattccaactaaccacctacgctttccagttactctccagcctttccctacgtcaccgacacgtgggccccacccacgctctctccctcagttctgacaccaaaaaagccatggatgaattacgaggtcgtggtaaaaaaaaaaacattacagcgaacacctcacgggcattacatcgaacacctcgccgacgccggcggcggattaacgaagccagcggcggaggtcggtggtggatgacggagagaccacgtccccgccgaggctctccgcgcaggacgacgacacgttcgaccgctgctccgacgagaacctccccgccgcgctcttgaagctcgggctccgcaggctctgcgcgtacgcgccgtacgggtcgatggggacggggaacgacagccgcttcttcgctccgccgccgccgccgccgccgccgaatgacatcctgtcgcgctccggcgtcgccgggcgctgccgcggcgcgctctgggaacgcacccgcgccttggcggactccgtcgccgccatgtagttcggcaccgccgccgcgccgcccgacgacgcgtggtggcggtgcgagtgaaggctcggggtgtagctccctcccccgccgccgccgcgctccacgcgcgggcttgccgaccgcacctggatcggcggccgcgccttggatggcgacggcgtgaccggcgagtggtggtgcgcgcggtgcatcggcgacgacgacgcgtggtacgacgcgttgccgtgccggcgtggcgtggagtaggagaagggccgcgcggtgtcgatctccagcgtcttgacctggtcgcggtggtcggtggacgcgcgcccaggcgccgccgctgcggaggcgcggacggtgctcctgctggtgtcgaacgacgcgcgcgacgccatccacctctccgcccacctcggctgcccatcgacgtccatctcctccaccgacggcgccgggttcctccaaatctaccacattacaccaccaccaatgaaatcgaccacgaacaccactcgtttgcggaaatgacaggaagagaaactgtcatattacttgatgggagaaggcgtaggagagcgccctctcacgcttgagcgcggcgtccttcctcgtctgcagcatcgcctggatctcctctatcgtccgcggccggtcgtcccagtcgtcgccggcggcgaagctgctgccgtctcgcgaccgctcctgcaaacaaacaaaccaatgagaagcttgcaatgtgaggacgaggacggggcaaagaaagtgggaggagaagtggaactgacgatggagcggcggtcggcagcggcgaagtcgtgggtgtacttggaatcccagaaggtggaggtgtcgacgctgtaggaggacttgctgctgccgcatggcgcggcggaggcggcggcggcggacaaggagatggagtcctgggagaggcgcatccgctggtcgcggacgcgggcctggacgcgcaccagcgcctgcatgcagcggagcgtcatgttggcctgcttccgcacgttgtggccgcgcaccagcgcctgcagcttcacgagccccttgagcgcccggagcgcgcgccgcgccaggtacccgcggaacgcggtctggaccacgatggcggcgtagtgctcgcggacgaagctggagctcggacgcgtcagccggaccacctccgccgccgcctgcgccgtcgccaccgccgcctccgcggtcgccgccgtcgccacggcgagcgcgatggcgtgccgctgctcctccgtcacggccgccgccctcgattgctgctgctgctgctgtggcggcggcggtgtcggaggcgcgggagacggcgacgaggacttcctgaagagccatctgcggcgctccctcttgccctggacagagagaagaggagagaagtgagcgaagagaaggtgttcgacgaaatgcgagtaggcgggtggtggcggaccttgtcgtcgtcggtgtcgtcgcggaggcgggcggccttgttgggggagtcgtccttagagggggagcggaaggcgcgcttgacggcggtgagccaggaggaggtggtgccggccttcttccccatcaatggcggccacgggcattgacgtacgggaggtgtcgcaacgggcggcacgaggtgaggtgtatgagtattattgcagctggggtagcagtgacagtggctctcatggctcacgcgctgctgccgcgccttttatgtggtggaggagccattaaagtaaggttngntggggggnagggtggagaaagtnagagngagagagtgggggagggagaagaagaaagggtaaagggggggngggaggggggggccanggttgtaaaaacaatnnnnnnnnnggggggggggagtgagtgggtgaacgttgcgttgccttccattattccgttcgtccggtatgatgattcatgaaccgctgcgcacctgcaatctctgcatctcatcctgatgatgtgatttcaagtttcaatcgctttctctcatttatgtttggttcacatcaaaattaatagtttggtattaaaaatttacgtgtgtagaaaaattttgatgcgatagaaaagttaaaagtttaaataattaagccctaggacactaggaagctggctagggctgcctagggatggagaagtggaaggcccgtgaagtggtgaaccctcagaccgttcacaatgcaggtactcgtagtgatacctaaggtagtgtttggttgcaaggatgggatgggacgaacccacttttaaaggtgttcggtttaagggtggatgggatgggttggtccctggaaaggaataatcctctcagatccgggaccaaccgatccgccaaaaactggcggacaaactcgtcccacctgggacgagagacggggtcaccgcgccatccaccaccttcgcgagctccgccgggcgcccacgagcgtcgccgcttggtccacacccgccgccacctccgcacgtccttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccgcggccgccgcagccgcctccacgagctccgccgctcgtccgcgaccactacctctgcgagcaccgccgccacctccgcgcgtccacgagcgccgcctcgcctccacggccgccgccgccgcctccacgagtgccgccgctcatccgcgaccgccacctccgctagcaccgccgccgctccactcagatccagccgccgcctcgcctccgcgcccggcgcctcctccgcttcgtccatgactgccgccacctccacgagcaccgcgaccgccatctccacaaactccgccacctctgcctcgtctacgaccgtcgccgccaccttcgcaagcgccgccgccggtcctctcagatccgggcgccgccgagtgcctccgcccctagacggcactaacggtgagtacaaatccatccatcccatcccacctcaatctcttctaccaaacaaaaaactataaccatcccataccataaaccaaacagacaactggaaccatcccatcccacaaaactaggataggtctgacccatcccacttcgtccccaaaccaaacactacctaagagaaacggtgagccggatcccaagttaatcgctcgaaccttcacgtgaggacgcgcgcgcacgccctacctgcgcgagacactcctccgtgcctatgttggctaggtcgcctcctcacgtttaattacatctggtcgtcccctcatgtttcatctggtccggctagccctattcagatgttgccatgatcgagtttgatactagggtt

SEQ ID NO: 74806 - DNA, 4560 bp, Oryza sativa
atatacccttttttaaaaattgtcttcataaaactgcccacgcatctgcgcgggctttctttctagttaattaaataagtatattaattacaaattaattgagcttgtaattgattagtttttagttagctggccaaaatacagtgatatatataaatgggttaggtcatgtgcttagtctcgggtgtgtggcatatatttatgcaaacgacgtctttttgatcaaaactactaacgaccctatcgtttggctgattataagcataagcgaaataatatatttacaaattacaaataacttgtgattaaaatttttatatacgtgtaattaacgatattaaagcaaaggctgaaaaataaaatacgacgaaaaaaaatctcaaaataaacgtaactccaaattaaatttaaagttaaaaatttaaattttggctgataagcataatctaagcgaaaagatgggggccgtaagaccatagaagaggacctgcgagctagagcacaagaaatattaaacaaacaagagacaacacttcctctcttttctcttttctgatcatctcttttcaactttttcgatccaattccatcattcaaacagaaaggaatggctcacaaaggacgccttttatgaccgagatcgaaggaaaaagtgcttttaatttctatctgacgcttatatgttaaaaagaacaaataatgtcaccattatagtcagtgaggtgtgacttagaacatatataaaaggccagcatgttttcctcgagggcacatacatacgacagcgccagttaagtgcactaacgattaattatgcgctctaaattaaattaattaatcttgagaatatttttattttgcccttcttttatgaggcgatccatatatatatatcacagatctatagatggatgtgaatcgatgttcattgtgtctttcttttttgtgataatttttagtttattacctatagtgtcatcagggatatttcattatactagttattgccctgaaactcttgtgcaacagttgcaggttaactatgggccagtagccagcatttgaatttcttttttggaatgcgcaaaaggtttgcgaatccgtatattatatctgagttacacaacgcaaaaggctatacatgctcttgtcgggtacatggtagagatcttaggaagagtaagcggaaaaaaaaaagaaaaaaaaagctaaatagtccgtccacaaagaaatggttgatgttatcacctttttggctttttcacggtcttctgggtatgatttcgcccacaattttatattcaaataagtttataaaatctaataagtttatgagattaaaagggcattttccaagaaaaatatatacacatcaatttttttgaagtttaaatctaaatatctgaaaagtaattggtagtaaaagttttaaagtttacctgaagacaggcacccggatttaaagttaatcatatccgttagatttaagtgcctcaaaatttgtaaattttaatttatctaaaatgcacctttctaagcctaaaattacattgttatgtgatgtacaattttagtccatgttaactgtaattttgctttcatatctcatctatggttttactttgtgttataagattaatttttttgcatgtgacgccagtctctcctcacgtctcacgtcgcttgctcttccccatgtttttagccgacgttactttctccatctcaaaaaaaaaaaaaactcaacctcatactatgatgtgatacatcttattacaatgaatctagacatactttacgtctagatttattgtcctagtactatgttgtctttttttataaaaagcgttgttatgcaaaacttttttcaattccatctcttctctctcctgcatatcaccaaattggcttaaatggcaataaaggtacccggataataatacccatggtatatctaataggatctatccacaccctacataattaaaaagactagcttaatacatcatcagtacgctctaccttttaagttatgatccgcataatcaattatcactatcagattaaatccaccaatgacatcatcaaaccacgtcatccttattacataaattgcatcattaattgcatctcctagagaaagaaatgtaaagaaagagcttcaaagaaggaaccgcctggggtgtttttcatgttttagtattttatttttactagaaaaaatacccgtgcattgcacggataatgattttttaagtgatatattaaaagaataagagctaagcaataaatagaaatattaggatcactatacattataattgaaaaggataatgaaaattgtaacactgggatcgctatacatagattataattaaaaaaaagttaatgaaaatattttccgggttttgggccgaaagctttcctttcttttcagccctaggccagtccactacctctctctgtttggcatgcttcccttcgagccagggacaagtagagccgtaagccccgctcgcaccgtccaataccatcttcaaccttccgaagatagtcccgtacccgtacagttgccagagcaaatcttctcatcaaattcgatcgaatctttctcgatcacttaaaattggttgaggattttttatccactcgttctgctctttcctttttcccaataaggatgaagcaaacgatgatcaattagtaattaatatacaagaaacaaacgatgatcagtctcctctctctcccctcccccattaattcttcctatccatggcagccggggtggccggtctcagagcatctataatgtttgaactagaagatgcaaaaaaaaaaaaagtcatcttctgtagcaaagattaaggtctcaactcttaatccccaaacatagcaaaattagggcttttcccttgagagacttgagcggagtgatggagcggcagcactaggcggatctggcacgtactggtaaatctcgagcaaagcgctggccatgaattctcctcccaaacacatgatttgttaaaaatgttttatttttcacgaacacgtaaaagaattgcacgttaatacattagaggaaatattaaaaatgttcggattttcatgcatcggaattattctcctcccaaacacattatttgttaaaattgttcggatttccgtgcattgaaaatcagcgcatgcactatatacaatttaaatatagatatacgtacatttaaaaatggagagagtagtataaatttctactcccatatttcaatataattgtcgttttaggattggtgagctattagctgaagatgaaaattactaagttatcctcaaattattactagtaccagttgcatgtggtcatttcaacaagagaattaacacaaacagcactagccacacaagaaatattttaagcatagaattaagtagtgtcacatagaacagtcccaacccatagtgtccataagtagtgtctatatagtgccatgtcaataagacatcataatagaaactacactcgacagcccatgatttcttaaagtgggccattaataaatacatcatctctcttctctaccaatcatatttattcttcatctattatgaagacattattctatcctaatgtaaaacttgatagtatctagtgcataggttctcatgttgaagctgtgtcttgcatgagacccagtttcttcttggcttcactctctcttaattaatatagtaccacattagcttaaagttctattttggcatggtattaatggcattaaaccctattctaaatgaagggtgggaactgccttattccaagtaatactagtgctactttactgtcaaaacgtacaaaacgtcaagtgctcagagacaaatgttaggggggtacgtaaaacgtcgaagtaatctgggacagtatgtgccctccatggcactattgcatatgcatgcatctgttgggactttatgatcgaactgcaattaatctatcagttgctatttgattctgcgttgcagggtgtgaatttaattaattaaggtgcagatcgagacgacagtgtggtcatctctgttcgatctgatgcgatgcgatgcgatgcatgggcatcaggagcaacatgccacatgtactgctattgcaactctgccaacggtagctggcggtgaaccgatcaatgcatgccaggtacatagtactccctccatcctataatatagtaatctagtaccggatgtgatattttatagtataataaatctggacacctttctgtccagattcgttatactataaaatgtctcatccggtactaagttactatattatgagacggagggagtacgtcctttaattttggttgtcaactcaacgtagtactagctatgatcatttcagatcgatcgatgcagatggagtgccagttatcgatcgatatcacttaattatgctaatcacaatgcataatatatagtactttctagctgatagcattttctctcttgcttgttgcatcgcttgcaagtgttgcttaataataattagtttttgataat

SEQ ID NO: 74807 - DNA, 30408 bp, Oryza sativa
gtatgctttcaacactctaactgtgccttctctaacggtacaaggcctccgtaagaacggagaaatttcagagtaatttcagagatatcatacatcgatcgagcaaataattgatcgataacttggctggccgattaattagcagcacctttaagctcaagagagagaaagagagtcaagactataccatatactccctccgtcccatgatataaaggattttgagtctttgttatcctatttgaccactcttcttattcaaaaaattttggaattattatttttttttgatttactttattatccaaagtactttaaagtacaacttttcattttttatatttgcataaattttttgaataagacgagtgatcaaacactacaatcaaaaactcaaaatcccttatattatgggacagatggagtattgtactactacctccatcccaaaatgtttgacgccgttgacttttaaaaaaatatttgaccgttcgtcttattcaaaaaatttaagtaattgttaattctttttctatcatttgatttattgttaaatatacttttatgtatacatatagttttacacatatcacaaaagtttttgaataaaacaaatggtcaaacatgtttaaaaaagtcaacggtgtcaaacatctagagaaggagggagtatatgcttcaacgctctaattgcctctccaacgggacaaggcctcctttagaacggaaaaatttccaagtaatttcggagatactgatcatataaattcaatggaaaatttatctgtaagatgcagagaaatgacaggttatatttctctaacaccaaagacacaaaagcacttctgaaaggctctgatcagttaagctacgatcataaagtgaggtaaacaaaacagagcaaaacaacttagaaatactccctccgtctctaaatacaagatattttggttagatgtgacacattctagtacaacgaatctgaatataaagtctatctaaattcgttgtactgggataagtcacatctaaccaaaatcccttatatttagagaagagagagtaatttgtaaaagcaaaggctgaatcatagacatgattaaaatagaccctaaaattaatctaccatgaagttttaaaatttaaattttgcaatgacacaagcggatgaaagaaagaaaaaacagagatattaaatactgtgcaatatggagcaacacgtgtggcagataggcgatcacgtcggcggatcgtcggagcacccaaccaacacaaatccgtggtgcaccccacagtgggggcacaaagaaattaacctaccactcgtaggatttgctcctaaaagccatggaaacacacacataatataatcagattaaaattaattaaccaactactagaaaaactagctatatatagctaggtgactatatcatcatcattatcatcagcttctgtttctcaatcgatatcgaaatgtgacaacctagatgacagtacatatatgcatccatccattagccatgcatgcatcatcctcttgagtttctcctttgtgcattgacttgggagagacagagctaaaaagtctaactaaaaagctatctattgatctatagatgcagatagagggtgtcacctgatcattttccctgctcctccctgtcccagcactgcagtatcagcctatttaggcagttaagaaggtcaaatcagatatcctgcaagtcgtaataaattggcaccaaatccccttaattcaatgtgggttagttcaaatagtggtaataagttatccatcaatttttagaccagtatggaacttttacctctttgtgcaaaatttactcctgtatgagaagccaatgtgaagccagttttttttttcctttttggctcctgtatgagaagccaaagtatatatagtcatctgtagctaattgatgttaaatttactcaaccaaactgtagaaataatcaatgtggctatatattgtagcagtgcatatatggggtgttggtgtgtatgaattaattagtagggtatctattaaataaaagataaaggttttatgatatggtgtgggtgagaggggcatgaatcatgccagcaaaggtattgtattactgtgcagtatagtagtgttactgtatgtgtacaggtgaagccgctgtacatggaagaagccagcagacatgccatgctcaagctatgcaggctagtgacacgcatgctactactatatagtgtacttacctgcttttgatctgcttttgactcctgctatagtgctgtgaaggctatcccatctataaagcatttcatactgtcaccagaagcaacatgtttttctcacatgggaattttccttgttttatactccctccgtcaaaaaaaaaaagacaaaccctggtttccgtgcctaatgtttgaccgcccgtcttatttgaaaaaattatgaaaaaaattaaaaagataagtcacgcacaaagtattaatcatgttttatcatctaacaacaataaaaatacgaattataaaaaaatttcatataagacggacagtcaaagttggacacggaaacacagggttcgccttttttgggacagagggagtactctccttcacagatacttgttcaaacactatttatattgaactttgaccatttgtctttttctataaattttcttttataatacttagaaaattcagtattaccaaaatgttaatcctaaatataagtattaaactttcattcatgtatctttgtttaacaagctaactagaaactgtaggtttggtaatctactaaatttaaatcataatgtgctaagaatatagatcacccttatgcaggatttggggatcaccgaccgtctcttctagaaccggattggaagtagaatacaaagtccatcgaactgctccggtgatcatcggtgtagggaaagtagtcatggtagtggtgcggacgaagtggttgccgacttgatcccgaaggggtcactggcgatgaactgcaggatagcgtcgtgccatcgtccttcgaggcgccacctacactaacttagtcctttgaataccctccaacgcttaggtcaattttcccatccgaaactaaacaatgccaatcaaatcatcagtgacaagtattttgaaacggagaaagtattttatatgtctgtaaatatttttacaacattgacataaggtagcagagagtgaggaaaggagtcataaacagtgagaccatggacttattggaagtgccatacatgtgtggtggtacgtatgactacgaaagaaaaggaaagaaacaaaggaccggccagcctcatggtgaagcccaatctgagagtaacaatttttatttcaagtggattagagcagtttgtgtagatgggcttgcctagatttgcaggcaggcagccatacatatatgagtaaatttcactaaactacatatactctggtcaaattatcacaaaactacagatttaaggagatgtatcacaaaactacagatttagcactaaatttctcaaagaactacagatttaagatggagtatcacaaaactacagatttagtaacaaaattatcacaaaactacaggtttagtgtcaattcaatcacaaaacttatgcatttataactcaaatataacactagtgctaaggatttaaattccaatatatgtagttttgtgataactttgttattaaatctgtagttttgcgatactccaccttaaatctgtagttctctgagaaatttagtgttaaatctgtagttttgtgatacatctccttaaatctgtagttttgtgagaatttgactaaagtatttgtagttttgtgaaatttactctacatatattgattgggtcatagattttcagcccaaataatgaatgcttatcttggcaatttcattagtagtttggccagacaggttgggcttaagtttcagaaaacagaaagctgcttgggcttgcagcatctgggaatttttttagtgcagataaaggaaaaggtacaccgaaggtccctcaacttgtcatccagataaaaaaacgtcctcgaaccacaaaaccagatatgcggggtcccttaactatacaaaaccggtcacccgagatcctccagtggttttgaccctggttttagcctatgtggggtgtgggacccatgtgggccccacatgtcagcgtgccacgtcatcaccatccctctctttccctttgtcctctcaggcgacgcgatggtagcgacgacgcgggagcagggaaagaggaggccggcggggggacctcccatcccgacagccaacgcctcgctcttctttacctacgacgaggccacgcacctgctcacgccgccgacctcctctatttgtgtttggcgagtggtgtttgatcgacgtcggtgtttggtggatgccgtgcaggccgagcggatgcgcgcggggctggaggaagcgcagcgacggcacgtccgggcgttggtggcggctgtggcgtgcgccacgatggggagggtgcgtgcggcggaggccaagctggatcgcgcacgctgccacaactcggagctggaggagaagctccgccagattagtgcggaggggcaggcgtggatgggcgtcgccaagagccatgaggccgtcgccgctggcctccgcgccacgctcgactagctcctccagtccccctgtgccgtgactgccgtcgccgccgccacgaggaagggcgacgccaaggacgcgcagtcgtgctgcttcaagaccccaggcggcgccgccgccgccactgccgccgacgcggtgtccggggcgacgtcgtgcaaggcctgccatgtcacggaggcatccgtgccgctgctcccatgcctatgcgacgcctgcgaggccgccgccgccgcttgccccgtctgcaccgccaccaagaacgcctctgtccatgtcctcctctcctgaagtcactcacacgtgctacaccagccagccactgcatggagtaggagattttgatagcgcaacagctatggccagaccgaaaccgggcatccgtcagccaactccggtgtcaagcaaaaagctaacaacaatcatcctgtcccaagttacatggaaattcatgctagggaagccacggttctgtgcatctgtgcatcagtgatctccgggccatgcgagttttgtcagtggaaacaacagttttcggtgcggtggattgaatggttgattgccaatctcatctgccgcaggtaccattgcttcaaatatttggcagcccaggtcggcacgtatgccgccccgtctccccgccggccgctgctcgtcagttgtcctccccatcggctgccgcccgtcccggcacccgttctccccgccggtccccacctgttgacgatgtcccagcgccactccccatccgctggccaccgcgcgctcacccgcctgccgccactaccgctccgcgcctccgccgtccgccgctcagcctccctcgccgcccggtcgtctgctccctacccgtcggccggcctgcaagagaagagtgcgagagagagaggggggagagagagagagaggggaccaggggaggaagggagagaagaataggggaaaggggagttgacgtggaacgctgacatgtggagcccacgtgggtcccacgcgccatgtaggctaaaactgagtcaaaaccaccgaaagatcttgggtgactggttttgtatagttaaggaacctcgcatatctgtttttgcggtttgaggatgttttttatcccgatggcaagttgagggaccttcggtgtactttttccgcagataaacaacaggggatttacatgatgggcctccatttgcaagcccacaaaaatctagtctcaaattaattgctctcactcacacagagagacagtgaggcctcagacctcagttttactcactccgtactaaaataagttaatctcgtacaagagaatgtgtcacatacactagattcaaaacatacattggtaaatgagcagaagcaaaagggtactttaaataaaattgcctggataagaattgggctaagctcaaggaaaaacacgatcgtcatatgctagctctctcctcaactgcatacatatattgacatttactccctccatcccaaaatgtttgacgccgttgacttttttaaaaatatttgaccgttcgtcttattcaaaaaatttaagtaattattaattcttttcctatcatttgatttattgttaaatatacttttatgtatacatatagttttacacatttcacaaaagttttgaataagacgaacggtcaaatatgttttagaaagtcaacggcatcaaacatttagggaaggagtgagtactagataatttgtttgtatgtgttgtagattaatatgccaagtaattgtagtgattaaatactagccagcatcactacgaccaagaggattgtatcaaaataaatgtgaaagatatgcagcaaatcttcaataatttcaggacttatcaaataaaaaatccaccatttatcaggtcattctactaaaatctacgattgcaaaaaatcgtaagacttcattacttgtatttatttgccactccatacatagttcacactacagcttcagcattgaattctcacgtcatatacagcagtgaaatttgaaaatatcgatctgaaccgatgtttaatacaaggttttgagaaaaataaacaagcggaataagtttgttgccggctgattccctcatgaaagtccacctgaaatttaggaaaacaccaaaagtgtggcgatatatatagtcatgggtaatgtgtttgaaaatttcatccaccaggaatttgcactcgaccttcgtatctttgattatgtgtcttacatgtgttccgcaggtgtgtgagtgtcatacatgtttattttcttgtaatgaaaaaataagacaatgtaggattcaatttccaacaaaaaggtaacattattcatagatttgccaaattcaagtgtttttctttttttttaaaaaaaaaggcagatgtgctactaccaaacggatacgcatatgcacgataagcttgcccggtagtacgactcactaattcaatggtaattttgtcgccaactaagctgcaaccctgtacattgctcatttgtcctatctatctttacacacaaatcgcttactataactacaaattaattatatttgcaattgagcatcggttgcaaccctttacctaactcatttcccctacgccggcaaggcccacggcgtccacttcgagatgaagggaaatggacaattttaaattcaaatatagtacacaattgcaaatgtaaatatttcaaacgaaaactcatatttgaaaatgcgatcgattggtataactaaaacaaaatgcatgtccccgtttacaattccaaaactgcccaacaacttggaccgaattattcaacaaaaattattaaacaaaaatgtttagaccgatcgagctttttttttcccacaagtttgaataaattatgagagagaatttggcgaaatcaggctaaccaaacatgtttagcgtgacagacttctcctccctccggttcatgatcaacgagccgagcgcgatgagatggcttgcaaacttgatcccttgctcaagcggtgccaccatggctactggggcgcggaacaaagagcctacacgagccaactccggcagcagctccgccgaggtggccatccttactgccttggaccacctgagcacagcgagcctgactgctctgacgcggaacatgagcttcttgacatcggcgagcctcatggcaccaccaaactcctcgcttagcatctggagagtcacctcaccgagccgccccttgagacggaggtacctcctcacgacacgggcagtgaagtggtcctcattcggtgcagaaacatcgccgtcgctagtgctatcgacggtgacctcatggcgctcgcctgtgatggggtggacggcaagcacgttaactatgcagccatgtcgttggtggacgtcccgagcatccttgagcagttgctcatagtcctctttgaatggcttgatgctcttgacaatcttcaccatggcgtcctttttcccggactatttcatctcaaaaaacaaataaataaattagctaaaaaaggttattatgagatgcacattagttgcaactgaaataagtgtttttgctcattacttacgtttctaactagtgacatgtacacatatattctctcaataaaaaaatggacacatatattttgcataagtgttctactcattacttactttgctaactagtggcatgtacacatctgttctctcaataaaaaaaattggactcatatatttcataaggatgcaaatggattggccgtactttaccaattgtcatgtcaatcactacattagtaataatattataataaagaccttggtatagtgaccagcaatttagcagtttttctacttgctattattattctagaataaaatcatagatctgcggattgcatccaagaatcgatcaacttctcactagccatgaaaagaatattttaactcgtaacgactccacagtgcctcttgccagctttgtttcaaaattaggtaaagctatatatatatatatatatatatatatatatatatatatatagacacacacacaattgcatgaatgatgttcaaggaagcgccagtaccaatctacgctattgatgcactgacaaatgtttagagacaattgagaaactacattacgataaaagtttgagggcgaacatacctagcgatgtgaggagagatggaggagccgtaggtcgaagattttacaaggcaagatcaataaaaaagaattgacaatgcaatgagttgtgaggagagtggaagagaatttatagcgagggagaatagaaaagggttgacgcaccaccgaaaaagacaaaactagttaattgaatttaaaatcaaatctaattcgaaaaaaaatcaaaaccatttaatatgatttaaaatcaaatccgattcaaatctgatatttaaatatacaatatggaatagttttaattttcatacatatagataatgtgatatcctgagcaccgcggtaccacacaagggttggggtaagatggagaaaaggctaaacgacttcataatatcatatctacttctcatagcaatggacggtggatgaacatgttacagaaatggtccagagctagagaaacataatagaaaactaattctatgacattcgtgccacgatagtcaatggctcccgtgacatgaagtggatgtggaaatggagccagatctagaacaatacgtccggctcaaatgccaagggttgtccttcctcggcacaaccagcgacggtcgtgccatcgtctttggcaacatcgtgccaccaacatggaccatgggagataccttccaaggcaatggccaattacatattacagtacagccagtacacaattacaaatgtaatcattccaataaatttcatagttgaaaatgtgatcaattatttgtaataactaagatgtaatcactgtctccgcttgcaattctaaaaccgtccattaacttggaccgaattattcaacaaaaatttattaaaacaaaaatgtttcacccaatcgagcattagagctatgatgaatttccctcaagttcgacgaaacaatgcgataaaattttgtgaaatcaggctaaccaaacatggttagcataacattcttctcctccctccagtattcatgattgacaagccaagtgtgccaagatggcttgaaaacatgaccccttgctcacgtggcgcctccatggccgccagaactcggaagaaagagcctaggcaagccaactcaggcacagcttccgccacggtggccatctttgactgccctgacacatagcttcttgatatcagtgagcctcatggtacttcgtcgagctcctcacttagcaactggagagtcacctcaccaagctgcgccttgaggaagaggaacctcctcactatatgggtggtgaagtggtcatctctattggcgctgacacataatagttgttggtgttgtcgacgataacctcgtggcacttgccggtgatggggtggatggcaagcgcgttgactatgcagccggttcgctggggaatgtcttgggcatccttgagcagctgctcatagtcctctttgaatgacttactgctctaaacggtcttatgtgcgcattaaatgtaacagagcactaacaattttactcattattattcttactaatcatgtatgtatgtatgtatgcatctcatgtataacacataatccatcatctaaaaaaatgtatagcacataaattggtacttttattctgattgcgaaaaaatagactaccaattcgattcaccaataactatactagaagggagtgtataacacattatttattatcttaaaaaaatgtatagcacataaagagatactttttattttgattaaaaaggaatgtatgacacataatccactatatttaaaaaaaatgtgtagcacataaagaaatatcttttattctaacaagaaaaaataatagattgccaattcaattcaccaataattatcctcagtatgacaactagagatatagtaggctttcttgttgtagtcatttttttcaagctatttttttctcattgctctgcccgattgcatggaaataatcattgttgaattgattgactaatttggccggtaattaccatgaaccaataataaatagcacggcggtgcgtgcttggccaacgtatttctgaaaatgggtcatgttataactcgttcttcattacttggaataaataagttttagttttaggtattctctaattaatccgaagtatcccctaaaatgctatatatggtcctggatatgaatggtaaatttgcaaacgactttcgaatggtatttagcttggcgatctgactgtcgaatgatttttacacttccgttggctaattaatccgaattatctcacctatgaatggaaatttgctaaacgtttaaattttaaaattgacaatttaaccatgtttatgccattagtgaacataaagatgcacgggctactgatggattaacggaaccaaaggttgtcaactctcatttcctttactagtaacaaaaaggcatgttaatttggattggtgctaatatgtgccatatcaatattttgctagtttcaatagtaatttattggcatttggattgaagccatttttttaccaagctataggtctatagctagtagcaaatctacactcctaggtagtgccaaaacttctgcttttggcactaccaatattttggtgggggcctcaaaccaacaagcccaaatagccaaataattttgctaaaaacataccaccatattttcaatagttgattttagtaaattatgttctttgtcattattgctatcttctcttatatgtatgtaaatatgtttatatctctgatatcttttctttcaaatatgtaatgaattatttttatcctaattctcccttgcatagtgtgtattggaatatgtagtgcgcattgcaaatgtttgctatatatttacattgtaaaagaaatataacagctttgtaatgcaaaatgcaacgtagctacaaatatagttagtccccaagctacctcaacaacaacaaaaagggatttccacgcttgaatatacttatatactaaaacgttgaactgggctttaaataatttgggtgaaactacttatgcatcccaccctcttcaaactgcagcgcaggacaacgatatacatagaccgagttgaaacaaaacaggttgaacacttagtaaatttgcagaagaagtggaatttgttttgaaacaaaacaggttgaacgctttgtaaatttgcacaagaagtggaattcgttttttctgcagcagagctagctttgcatgcataatggaacgtactgtaggcgcaatgcaatcatggattagctctttgtgtgtcttcgtcgaattttggccgaagcttgtagtacagttttaaggctcccactaataaggtctgatcctggacatagttaaatttatagactgtaaattttaaaattgacataaatatttgagaaagattatttttttagaactacacagtgctttttttttcaattgcggtagaccatgctaaaattttccaatatatattatcgaacgttgtcgttcactacagacctacaagagaatatataagggccaattccctatatgcccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgtgatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctagtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctcaatatataatgggccaacgaaatcgagggctctagtttcctctgacaaataggacgcgtacttagctaaactaggaaggtagcccgcgcagttgcgcgtgcactttatttgatattgcttgaacttttattacgtactttttataattgattgtttaagggttctacttttttctttaaaaaaatctccaaagccaatattgtttaataaacatgctctatttgcacaataaagctagtgccctctaattggttaggcttttgttgcatacttatcgcagtgtaatcatctaagaactcaaaaatgatgcaatgctcttatgctaatggttgttgtagtttaagtgaaagataagaacctatttcttctatgaattttataaggtttttatataattagttctctttactccctattaagttttgtattttctattttattttatataatattattttcagctcaaattttgtgagatgataggatagtgacagagcatgataccttatatgtcaacctattttaaaaatatgaatcaacttttgtgtaaacatctaatactaaaataggttatcgtagtttatttattcatggattgaggggatccaaaactatgttaaatacatattcttgtagagtccaattctattgtgcagtgttggagacaacccatatgggataatttcatgcaagtgtgcgaggctagcgagaacacaattggatggcaaaatataacaacgaacatatcattatttttggaatgccattttttatgattgttcccatgatttcattttttataaaatttatagttaaatattaggaattatgtaataaaaagtaactaacccacaaatattatgttttgctagcctgcattgggcatgaattaagtacaattagattttataatcgtttatctgaaacctataatgtctatccacttgtcataattatcacatattctataaagttgtaaaagaccctagaaaatatgtgtttaaagatcagataaattatttgaaagctttttgcatttctagcatggaatttgtttggttactatacaattcacttgcaccttctaccgaatatgccatatgatgacaaaaagtaaggcctagctggacttaataggactcctcttatccttttttgatgcattattcttatctcattaagactggtctatcactctctccatggttggctttctctctaattatagtccgcgcaagaaaatttttgggttccaaagtctaaacaaatacagtgtaaaattcgtctatgtctagtagacgacaattgtttggtgataatggttttcttgcacctccaagtcatcatgttacatggttgtaaaacttgtatagatgttgagacatggaggttgccatatgatccattgcagtggtgtttacagtttcgatcaagtttagttaatctttcttttcatgtctcggtgtatcgtaacatataaatggattccaaacttaattcttcaagttaatatatgaacagcgacatgtttatagcaagttaatgtccatatatagggatgacaagatatttttaatggtttgtgcacagagaaaacatacatttgttttcttacccggaaggtatggaatagaagcacatagccaccggccgtatatctatgtaccatatactaaaagaccgttaaataccttctaataaagtcatttaaatggtaccatagaatatattatagagcacttacgtggaagatcgtttggcactcttagattatttattatttgagcacattttagaaaattcacgaagtaattggattgtttcctctaactgttagcgcttcatttttcaatcaatcacaaataaagagatagaattataattgttgtggtagctagagccaaaagctgacctaacccaaatatatcattctggatatgtattggcagtgaaaacataaattaaaccaaatatgttattctggatatgtattggtagtgaaaacatatattaaacaacgattgtgccaatataaagcccaaggactattgaatgtatgtacatacgtacaccatcgccaaaccatccaccccctccgccctcattcacgccctccccctcctattgtctctcatgttttcatcatcttttagttaggagcaataattttattataatcgtttaaaataaatagctattttttatcgccttatgtcgttggacccacattaacaatatttcaacttctaaaataaatatgttattttaggtttatattcttgtcgacatttgatgtcgcaattctggtatttgcatagtatgaggatcgtcggtgctaggatatacgtgagactgaggtaaaagagatggggacgaggatttttatacaggttcgggcccctaaattatcaggtaataaccctacatcctgttggccggagccgaagttgcttttattcaccataatcacaccagtacaatatgtggggtagcctatctaactgttgtcgatatggcggtctgacgatctgactcgtagtcgacaacagggtagccttcctcctcgagctcgcacccgacgaaattagagacagtgctagatccctgcggccggcctctgaaggtaccggatagggtcgatccaggcgtatctctgatgtcaatatccggcggcttgtcttgtcgtatgtaggcttctatgttgattgtgttgggagttgattgtctcgtggtgggtgtgtgtccccctgtccttctaggggagcttgtatttatacccataggtgtccccttgtccaagtagaactagggaaaccaatatggatacaatccgagtagttcttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacaattctgacttttttcatatcatgtaaacaattattaaaaaatgtgaaaaaaaaaccaatgatatatattttactggttgaaaatatttttggtgaattttcttcccacctatgtataatgtaggctttattactattgaaataccaaccaaatagcttcaaaaaattccaaaatgatttgagaatgttaatctcacacgaattaaaataaattggatctacttttaaaaaacacaactaaattacgtggtttgaatttttacatagttcaaattacctttgttaattgttaagtaatatttgataacataaagtatacagactgatgtgattatttttgaaaaattgttatggaattaattaatgcatgtcgtttgataacataaagtatatagactgagaaagtatatagactgaggtgattatttttgaaaaattgttatgaaattaattaatgcatgtcgatgtcatctgccacaatgtattttgtgctaaaatatagccaacataattacgtatttttattagtaagatgaataaagtcaatagcaaaaaatattaatataaaaatactgtaggggtatcctaggtaaagaaaataaaagtgaataggaagtgaaaaggggggtggggtacgtactacctacctacacacgtacgtgtgtgagggagggaggagtaggtacgtgtacctaggaagggaggagtatgtacgtgcagggagaggagaggaattataaacggttgttttcaatctaatctagtggtgtaaaataatggacccaccagtgtaaatgaaaatcgagggttggatgtttcccgtctattaaaaggacacgtggcggtttaagaacgtttgtaagggtgccacgtggcagtttaaaagcgtttgtaagggtgccacgtggcggcttaagaatgtttgtaggaagtttaatggacttttaatttataatagatagatagatagattgatagatagattaggccgtgccatcacagcaaaacagatggattttcgcacttgaatacaatgcaaaaactctgacctgttttgtgctttaacgaaagaaaaaaaaactgtacgtgcaattcaatgtatagccaagcccaacaaaacaaagttcccgtgaataataacatggagaaaattagcagcacttgtactacgttcgtggcagagagtattcatgcgtgcttcatgccaagctagctgctgcatccaactaacctatgtatatatctctcctcttatatatgtcgaatcagttcaggtaatgtttcaggaaataatctgctagtctcaaatcatcaatcgccgtctggctgaaagtagggtagaactattatactggtaaatcgtgaaggaaaatgcagctaagccaatctgcgaaggtgagtgagatttttggagaaaaacaaactaattatgccgtgcagggacggcctagtggatgttggtggcgcttcacggtggaggttccgcgacaaccctaatgccaggatctcgacgaccctaatgccagggtctgagaaaccgtcaatgtaatatagtaattgattagattagattagattagagtgtttcttgtccaatttctgctgacgctatagcctttccttatcgaacatctcctcgtgatgacaatatgctcactagtgaaaattcgcatgctttactagtgcgccttgaacattcgcatgctttattagtgcgcatttgtcctcaacatagattaactaacaaagtgtattaactaattggtgcgctacgagcatggtatcaccaacataccaaaatggtgtgagctaatgtatttattaattaattggattgataaaccatgtgataaattgtcctatgttttgatactgagggtaaatttcaaacattttaaattgacaaaaatttctctattttttctgaggactcagttacaaaaacaacggtaactacaccgactgggcttgccgatagtacgaaacagccaaggcaatccactctcgactaatctttactgtcgaaccaacttcagttgtcaccgaccaatcttctgatccttatgattgatagtcaccacccgcgtagcatagcagccatcatctaatcgccaatggctaagaccaaaagcaaaacaaaagagctagcatccatagttggtgaagcactaatcacatctattcgacagatcgacgctggagttttaatttgacaggaacattagaagagacttgaatttgttttgttagagagtttgcatgcatgaaaagataccgaacatgcagtgttgtgtgctagtactactagctaatatctatatagtggactggaaactatgtatgcagccatgccatgcccagcaaaaacaaagttcccgtgaataataacatggagaaagcaacactcgtactgtacatgatcagaagtattctcatgcaaatgcaattgcaaatttgaaatgcatcaatctgcatgaaactaattagcctatatatatcttctcgtatcttatcttctcttctctaatcgatcttctgtcgaatcagttcaggtcaggtcttgaaatctaccatctcacggcccgcatcccgctcgccgtctggctgaaatagattagcactgttaggtctgctgaagaaaccgagtgagatttttgaaagaaaatgagtgagattttttaagggccgcaaaatggttaggcaacgtggtcagtgtgctcattgaaagaaaatgatttttggagatgaacgaaccacttacaagcataaacttcttttatcgaccatctccttgactacggcgtcagtgtgctaattggtgaagactcgcatactgtgttagtataactttgtttggaactccacgaacgtggcattgccaacactctaaaatggtgttagctaatgtatttattaattaattggattaaaacattgttctttctcgctcgctaaataatttcgtatgtaacatgcatatatttacaaatagctaggtcttgatatagagtataaatttgaaacaatttaaaattggcaactatttgagcaaaatttatcggtttttctaaggactccatttaccaataaaccggcactaaaccgggctccaaacgtaacatatttcctgaatacacactgttgttcacaaccttaactagggaatccacactgttggatttgatgaatgaggaatgtaacatgtaagactgtgttggtgaactcaatacaaaccacatatgtactggaaactaccgttaaatccaaaaatgaacatctaagatttgttcacgtcacccagagtaaaattttacttctggtaaaagttttactaatggttgaacctgagagtttttttttttttactctgcatgacatggatccaacaatatgtgatttgcattccagattttcattccatatgtaatttgcactgtatattttccccccttaactaggccactagagtataatgggccgggatactgcacgaaggacttgctattgatgggctaacgtaatcgatagctctcttgtttcctccgacaaactagccaaatatttcatgccaatacagtaggggattgtctatatatttatcgataaattttcttctaaaagtttgtcagatgtaaatatagtataattacattgtatcttacatataattataatgtaattggtatgtaactttcgtgtaatttttaaactgttagatttactttcatgtaatttcatgcaaaaggggaagaaaaaagtcacaactcacacaaaagtgaggggatttggtctcgtgacctccgcttcatgaaaatagcatcttatcgtaagatttttcaaagttacatataagttgtattatagttacatgcaagttacgatgtaattacactacgattacactatatttatatctgtcaaatttatttttgagaaaaaatttgtcgacaaatgtatagcaaaactggcacagtagaaggattaattttcacacttgagtatactaaatcgctgatcactatgtcttaaagaattttggtgaaattcacgcgagcgtcaaccctgttcaacgtggtgcagtgcaggaagatgtacatatataggctgagatgtaacggaataggttgatgctagagttaatttgacaggaacagtagaagagactagaatttgttttgtttctattctatgcgacagagtttgcaagcataaaagagacgtgcctagtggaaactatgtatgcggccatgccatgcccaacaaaacaaagttctcgtgaataacatggagagagcaacactcgtaccatagcagaagtattctcatgcaaatgcaatgcatcgatctgcatacaactaattagctagcctagctatatatatcttctctgctcgatcttttatctaatcagttgagatctcacgaaatctacgatccaaggcaggccgcccaattgtagtttggctgaaatagtgtagtgttgttagttactggcttacccgttgggatagtgagtgagatttttggagggaaacgaaatggttaagcagaccggtggcagtgttgatgtgggtgtcatggtgctcggcagtgtaagagcaacccaataactctctgtttggctcttcaaattaaaatttaactaacacagagaaaaagggagttccaacagcctctccatccgaatgaccgagccatccggatggccaaattgtttctccggttggccaaatgtagccagcctcctccactggccaaaggtgtgtcccaccaccactcccatccccatccactctctttgccggtgacgaaccgaaccgagggcacgccggccacgagcgcctgttaagattaagaattgactacaaaacggcatcggcagtcgctcaaatcggctacggtgatatcgactactgcatatctgttgagcgctggcctactgcatatctgctgagcgctggccatctcgaggaaggtggaccctcaatcgtcgccgggtcagattaaggccttcatagctattgccacataaggattggagttcggcaattgtacctattaattagggcattttctaatttccttagagatatattagagatatattggtaaaggcccacctgaaagggtcattcgtattttaagttatgttaagagataagagtcgtgtccagcaaggatataccatgtacttcgggtataaatatggcccgaccccatgtaatcaaacaacgtcagtttaatacacctcggcgcatcgccacccttttacttctcattgttctcgacgagtttttcttttgagttgggctgcatcaggttcgatctccgacgaaatggtaaatcttgtcatggcggcttgcgctctcgggattagcgcttacatctttatgacactctaatcctgtcttcgcaagcctccgagttatcatatgtatcgcataatctagatcgatctcgtcatctgagcttcatcgtctagcctctaccatctcgaatgagctttcaacggtttgactagatctcttgcctctcttcacgcttaatgctgcattggttaggttcgatctattaagtattgtcctgaggcttttcatctaatcttttctttgacggctaatagagatagtatctgggtttcagccgatcttaccagatttagtcgttttacattcctttttggttataaatcatctagatctgccccttatatcaagatcccatcctcttgaagtagatcaagctcttgttgatgcgaaaaacatacactggcctggaagatctgcttaacttcagtgcaggtccaaaatcttgcttttaggttcgtgagcgtgccagttgatttgatcctgcaatcaacaagaaataaagacaggaaaacagcggttaaatctataaacgatagccgatcggccagtcgccgatgacgtaacatttatctttgagccgatgtcatatttaagtcgatcggcagtcataaataaataagaaagaactaaatctattcgatcggctgcaggtattaacggtatataatctttatgtcgatatatatttaaatcaagtgattgggatagatcggtcgtcatgccaagacagtataaaccacttagattgaaatatatattaacgagaggattataaacattcataacatagacaatcagatagatctagcatttaccgactaatactctgataccactctatattaagatattaaagcaggcaaaatatatcaaacaggaagcctaacatacctagatgcaacaagatcttaatataaagggtagatctagcatgtcaattaagcatataagatataaggctaaattaggtaagattggctgaaaccctgatactaccctaatcggcaaccaaagacaggctagagattaagattctaatcacgacttataaggtcaaacttaactgatgcagctataagtatgaaaagaagaacaatatctagataataaagtcgttggatgtttcatagggtagtggatatcctatataatctaaatcaacgttgatatttaacctaatcagttgccttccaacgatagatgttagccgattgaaggttaagcagcaatattgtcgaagattatataagatatatggtaactcgacgaattacataaacaagattagagtatcataaagatggaagcactaatcccgagaacgcaagccgtcataacaagttttacctctgattgaagatcgaaaccgatgcagctcaacccgaaagcaagaactcgtcgaaagtaaatgaaaataaaagggtggcgatgcgccgagattgtattgaacgtgtgttgtttgattacatgggttcgggccatatttatacccgagatacaaaatatgtccttgtcggacacgactcttatctctaacaaactctaagataccaaaagtctttgtggtagacttttgcccaaacgtatctctaaggaaattacataaaatatcctaattaatagatacaattgccttttcaggactcaatccgtgcgtggcaatccaattgaagcacattaatgcaacccaacaacgtgtaccgagtcacattatcgggatcggcttaatcggctaaccttgtccgactcgaactctgccaatcctggtcgcagctgattcggactttagccgattcttgcactgtttccggaacgatctctatcttggattccgcttcggctttatctctatctccaatacttgaattaccaaatttggttgttaacagctccctagtctctagattatattgggccaggattcctatatttcatctgtgcttatctcggtataaggtggtatcggagtattagccgatacaggttgggttcgctccatcggctatgctgtgagcgtgcataatcccttcgttggagcatgtttagatatggagcgatttatactgtctcgatgccaccaccgatctatctcagtcgctcgatctaagcatgtcccgtctaatggattacgtgtcgctgatatctacagccgattgagtacaccgaacaatctacaagtttttacttgcccccgccgatgcgatccgacttgagttgcatcggcgtggcccccaacgatatgtcatcggcaattatgccgatcggctatcgttgacagatttaactctttgttgtttccagtcttgttggttgcaggatcaaaccatctggcacgctcagaacctgaaggcaagtttcctggacctgcactggagttaagcatatctcctagggcgctgcgtgttgatttttcgagtcaacagcgccccaccaatgtcgtcgtctaggccaccgtctgccgtcgcagtcatcgttgtcgccgtcgcgccacggtcacgcacgagctgttgccgccgcggggagccgtcaccatctgcatcgccactgccgcgcggggagccaccgctaccgtcgcctccgccgctgtcgccgcccgcctcgcgcgctggagccaccgccaccaccgctagatcgatgggccaatgcggccatgcgggagaaaagaaagggcaagagaaagagaaagaagaggaagaagaagggaatggagatgggaggatgacatgtggatccctttgtgattttggagatgtaaatagagagactgttggagtgcacacctagtttgacttcccaaatcagttggagagttggttaaataggtattcggagagtttaatttggagatgctctaagctaactaagctatgactcaacttacctgtggattgaaccagaaaacgagcctaactacatgtgcttcttaaattatcgcgcatatgcatcttagctactcatcatctctttgacgtgctatttatgtgattttttatggtgcagagttagtttgtaatggagatgcctcttgctatacagagccctttatgtgattttttttgggcagagttagtttctaatgaggatgacctcttgccatagagagctagtcaaaccaagaattgctaaatagtattgtatagggttaattcaaaaacgaaaagtccatgttttaattcgttttttatactcaatgtaatttactccagccatattttctattcaatatgagatgttcccattgataaggctatgctatagctcctgcacattgttaaattaacaaaccgtgtaaattttaaaattgacataaatatttgaatgtttgagaaagattgttttctccattttttggagaactcagtgctaatttaaaacctacaaaatccgtccccatcgaaagctgttgttctgtaacagacttgcaaatataaagaatataatgggctgatattagcttggtattgggctaacgaaatcaaagtgctatcttaattatgaatatacgaaaacgcgcttaaattatgaagacaaagtccgagacctaatgttacaggtttgacacttagtttgacaggaaccgcagaaacatagtagaatttgttattgtgcggcggaacttgcactatgtcttgatattgctccgataaaaaaaaaaacagtgcactgatattaactactgagggagccaatatatctggttttaccggtaagggaaacaaattagattcggtgtataattcaaggagccaaaatggactttttgcatggactggctgctacagaatataatgggccagaattgacttgttattgggctaccaatgaaacaaaatcaaggtagtcctctgacaaatactagctaataattatatagttatagtactcctagctaaataaccaaataggccgtgccatcacagcaaaacagatggatttttcacacttgaatactacctccgtcccaaaataagtgcagccatgagtttacgcgctcaactttgatcgtccatcttatttgaaattttttataattagcatttttgttgttatgagatgataaaatatgaatagtactttactcgtgacttatgtttttaatttttttcaaaaaaatttaaataagacgaatggtcaaagttgggcgcggaaaaccatagctacacttcttttgtgacagagggtgtactatatacgaaaacggtggaccacatcaactaaagtgatttaacgaaagaagaatttgggtgaaactcatgcgtacgtccagtccaaatttaactcctaaaatcatgcacagtttggtttgcccccttgtacctgcatctgcatgcactacactacaggagatcgagggtagacaaaggccgacatggaaaggaacagctagttgacatgacttaatttgacaggaaccaacagaaagagagtggaatttgtttttgttcgacagaagagagagctctcacgcattgcataaaagagaggccgtacgtactgtatgtatacgtgtagtagtgtagtgtactcccttagtagtatttcctccgtttcacaatacaagtcgttctaacattttctatatttatattaatgttaataaatctatatagatatatgtctagattcattaacattaatatgaacgtgaaaaatgttagaatgatttacattatgaaacgagggagtactactgtatgcttttggcatggcatgtgcaacaaagctaagttcccgtgagtggcatgcatggaatggatgcagtggcacggtcacatcatcacttcacgccaaccatgcatctgctagccgctggctgctgcatgaaatgcaactaacctttgaatcatcagttggggtcaggtctcacaaaagctaccccttggctcgccgcccaaacgcctcgccggccggcttagctaaaatagtacctactcctgctggaatgtacactaaccatatatcctaagggtgagttttcctaagggtgagtttgagaggagaggaaaagagaaaattgaaaagatacgtaaaacaaggtgagccattagtacatgattaattaagtataaactattttaaatttcaaaaatagattgatatgattttttaaagcaactttcatatagaaaatttttgcaaaaaatacaccgtttaatagttcgggaagcgtgcgcgcagaaaacgaaacaaactaactcacaaacttctcccgccgaacgctccctaatactataaatataaacaaaagacttagggatttggttcatggttacactttatcacactactcttttacctaccacaatgttttcttaggtatgtgtttgttttattgtcacagtagtggcttattaccatgtttttttcaataatatgtttgtcacgtcatagttttaattttctcgtcaactttgttacaccctgtggctcgtaatttataacttatctattcttagttgtgatttataatactacgatatactatcaaattctatattagattagtagtcctgtactaatggtaaaacaaatggtggaggcacatggagctgagtgacctcgtggtgctggcagcagagcagctgcatgcatctgctggtggtggtgcagaaagtgagagattttttaatttgggagggaaacaaaatggttaggtttgaccggacagaccggccggcagatcaaggttggagcgtgcctgggtgttggagccaacaaattaagcagaaaatggagtccccaacaacggaatcaatcggaatcccaacgcaagtgatggagcaacagtggcagtgtgcattgtctgtctctgctgcaggctgcacgatgacaccaatgccatcaagcgatatccaatccacgattttgtgtgatttaatatcgtgccaacacagagggaccagcttactgtggagtagttttctttttctttttaagccagcaaatacaactctactcgtattcttatagttgtcacgtgtactctctccgtcgcaaaaaaaataatttaagtgagaatttgacgcaatctaaaacaacgttagacaggttgtcttttttcagacagatggaatacttcatccgtactaaaataaaaataaattagtaatttatctaagaatagaaataatcaaaaccaggatatgagtgtgttttgattgaaattttgcaggcgtaatgagctgtagatggtgactagagtttatattactggttgaccactaaatttcgaatcccatcagtatcacggttttcaataaatttcgaccaaatctactgtttaagtgtctgtttggtacagctccaactcctaaatttagctccagtagttgagtttaaagtggagttgtggagctgtctaaacccagctcacaactctagtacattttgtgagagagctccatccaactccactccgagttttagtggagctgaaactgtttggctgagctccagctgaaactttagctgtgacaaatagtctctaacttttaaaattccaatcgaacaaaacttcgaaatttcgcagaatttgaccggttcaccggaatcgtgaaccctgaggagagtagtagtactccgatagcggtgaatacagtgggatgattgaggtggttggattggacgagacaatgacaatgagacggacggccacgtcagacgcgtgatcgagtctggctgcaaccacaatgccaagttggcggcagtcaggcggtcggctaccgtacgtcgtcgtcgtcgtcgatccccgcgccgccatcaatcttttgcctcgtttgccgcgtcgccaacgcatgctattgctacggagtactccctccctccgtagtaaaaaaataaataaataaactctagtttccgtttccaacgtttgaccgtccgttttatttggaaaaaatatgaaaaaaaaattaaaaagacaagtcacgcataaaatattaatcatgttttatcatctaacaacaataaaaatataaattataaaaagttttcatataagacggacagtcaaagttggacacataaacccagagtttgtcttttattggaacggagggaggagtagtagagtaattgagtttaattttttcgcgaatacgcaaaagaattgtcacgagtacgtttaattaagtgatcactactgtattatcgagcatatatgcaccagctggtgagtcaactgtcaacgtgtagggggccaaataaagcagtctctccctttttgcatgctttgtttgtttcagctagcctaatgacaatggataggagacatactaggatttggattgattagtttttgttggattactccctactctgtagcgagagtgtgagtggagtactagtgtactccctccatatgacacactatccgtatgacacccacttttctttgctcaaaactggactggagcaagttccccacatgatcgatctactgcatcatccatatccatatccatcattaaactcccagccggccccatcgtatcattaaccacgctagctgtagtacaaatgccacgtgagtcgctgcaaaacatgcgacactacccacagccgtccggccgggccaccactggtctggccacacactctgcatcgatcgatcgcccatgcttgatgcttcaattcccagctaagttacccagatacggggatacgcgatacatcggtacagagatacggtattttcctaaaaacaaggatacagggatacgcttatatatatatatattaaaaacacacaaaaaattaaggaaattgtatttatatatattaaaaatacaaaaaaatcaaggaacttttgtaaagaaatagcgatataatactagtattagtgtagccgattccatatcaatattctgcaattttctcttctataagcaattcaaattaagaagcgattaagatccccaaaaccaaagattaatagtatatttcttgatgactttgcatcaacattagcagccgcactaaccagtaaccactaggattgctagatgcactaccacttgtatctaacaaaaacggtagtactttgtcctaaggaaaacaagaaaggcacagcagattcaagcatgaaacttttgaagagaatggattacccagccaggcggtcaagcgaagaaagaaaaagttttgccgtcgaggttggcggcgaaagaggtgcgccgccgcccagcagtggcggctctgccgtctcgcggaggggacgttgtggccccacgcgcggctgcagccggcgtccggcggcaacgccgggcacgcacgagagacatcagccatcaggttgggccggatctcgtgcggcggcgcatcccagatgtgagcgaagacggaggaaggtcgtgggtgtatcgctggcgtatctcgatttatttatttttttggaaatcgcaaaaatatggggatacgtatgggatacgtatcagagcgtatccgatacgtatccgtaaccgttgccgtatccgatacggatacgcaactatgcaggcgtatcagggtaacccagattcccagtggcatatgcatgtgctgatatgaccataataatatccatctcctgtccttttttctctcttcaagcgggcgggacgtacatatcaccaccaaacattgctacgcgctactcttttcatatgaaaagaaatcgaaaataagatttaacgttattatctaatacaataaatctggataaatccatataactgaataactgcatatagtacggtagctgccccaccatctccattcgcctcaaccagtacagtcccatcgatcgtccatccgatgttttctcttgctacggaagatcgatcggctgcgatatatatactcctactagg

SEQ ID NO: 74808 - DNA, 971 bp, Oryza sativa
aacattatcattcattaaagatgattttaacagttgatttatatgagttattatactatatcactagaaaactagtattctgttgtgagtagttataaggtggtaggctggtgaccgttataaaatacccctttcgtttcactatatagcgacctaggatcagattaggacgaatcagtatctgtaccctgcagtaccgtcctattttggatatgtttagttcacgccaaaattagaagtttggttgaagttgaaagtttgtgtataggaaagttctgatatgatgaaaaaattggaagtttgaaaaaaaaatttaaaactaaactcagcctttagtagaatttgatagtggcagctaccacttccacttgtgcgtgccgtttcggacattttgcactgcagctttcaataccaagcccgaacgttgaacggaaacagcggatgtagtactagcaaataaattcgggcagatgagcaccaataaatgggtcatcactcatcaatcttgtggtaatctgtttggccttcattgcactctcaatgctctacagaaaagaactgaaggcgtttggacataacaatacacatcatcaacatctcgcgtacatcctccgtcccaattaaaactaactttatagctacaaatttatagctaaaagttaacttattttaaatagaggagtaagtgttttcacttgaaaaaactcaagcttgtcaagttatcattcttatgtttggcctgttgctttgtggtcaaaatattgggtcgaatcatctattactactagcattaatgtggctccttaaatggtcccttagagagcgattgttgcaggcgagagaatttatatctgtccgtaacttaccgagagtctcctccaaaaaatcaaatctatagtactatctttgttttaaattataagtcgttttaattttgatcaaaataaactgcttcaaattgggctgcagga

SEQ ID NO: 74809 - DNA, 2040 bp, Oryza sativa
ttcctgcagccccgtatcaacacctgaagaaattacgccacatttaagcattcttagcttcagaaatctttgctatcgtgcgtgcaaaattgacaatctaccaacactggatttcgttattctgatggttgctaatccaatagcgcatagaatggttgtgattttccgaattattactgcaaacaatcgaccaacctgcacattgcgatccttccagaacgcagggtcctcatcgagctcgaagtgcggcacctccgcgggcacctcggcggcggcgaggtccctgagatcgaacaccctcctcgacgacgtcccaatcgaggaagtccgatccctaaccccagaccccgcggcgcaggcggcggcccggggcgtgccggccagcgacttgggcgtgaccggcgctgaccgggggttcctacccgggtccgcgatggccgcgagcggcgacctcggcggcagcatgaacggcagcgcggcggggccacccaccactgaggaggaggacggcgccgccgcggcggccaggtcgtcgttctcgttggtctccgcctccacgcggcgggcagcggccctcgaggtggaggctcgccggccgccggcgccgtggccagccatggctgcgcggaaactgagtgaggtggccaggtgggggagccggggggtggtagagtagaggagactagtaatgggcgatctcgctagaattcaaatttgaactgcgcatgcgtgtgggtggccatgagaggaagtggatctgatgactgatgagtctctgactgtgtgaaagcttttcgggctttcggccacccccgctcctgtgattaagaacggtaattagggaagtcgttttctttttgatgtagattaattaatgatggcgatgtccacttgtactatttgggttgcttaaatattcattaacgctgagttataaactggagtggttagacttctaagtgccaactattaagggcctgtttggtacagctccaactcctaaatataactccaggagttgagtctggagtggagttgcggagatgcctaaacccagctccacaactctagtacattttgtgagagagctccacccaactccactctcaattttggtggagctgaaactgtttggctgagctccagctccaggaggggtggagctggagctggagctgtgccaaacaggccctaactctaattcatctttagccaatctaatagctcattcatacaataattatatactacactattaatacttggtcccacctgtcatacacacgttacgtcttggagtccgtgctgcagctggctataaatctgtagcccgctgcccttctgtctcctcatttatgttcttaaaatatgtttgcagcaggtttatagcctgctattgtacctgctctaactcaactttctcgttttccacaggcacgtttttcaaactactaaataatatttttcttttaaaaaaatctaaagttactttaaaatatcatcttaattcatttttcaaaaaaaatcagctaatacttaattaattatacgctaatgaatcgctttgttttgcgtccgtgagagatgagttcctaacacccagcaaagaactcaacctaatagtattaacttatttatatattgatcatgttataaaattatgaggaccctttgaatcataggaacagaaaaacaaagaaataagaaaaatgtaggattctgacagaaatacaagtacaaaatggagaatcgcaaaacgcgagaaaaacacaggaaaagactgtttcagtggatcgtgggaaagaagtagaaatcagataagagagacatacagaaaattttccaaaaggttgaggctcttgctattctcctccaaattctatatagaattgtctattccatagtaatttcaaatgagaggatatgattcaatcctttgtttgaaaaaaactttatgggaaattttccgatatgattgaaatcttccaaagttactatgttttttctaggaatcaagggacttaggaatcaagggaccct

SEQ ID NO: 74810 - DNA, 1698 bp, Oryza sativa
atctcttttggcttacacgaatatggagtagacagaaagggaaacaaccgagcaattccttcactaatcaacccagcatggtttgtgtgggcttgtccttgctctgaccaaaatcagcatcttccgaccagcccagctgtgttcacacctaatcaaccctttaatacaaatatataatgccactctcacaaaacagcaagcgaaatcacccaagtaattaagcaggagttcatcatcattatataatgtttttcaaggcaaaaacataggacagcagagcagagcagagcagctaagtaaaacaaacagcgcacgttcgttaaaagtttcttggtaaacaagctcagaaagaaaaatgcagggactcgactctgcgcattgaccccaaactcgatcgaatctgccagctcactcatgagcttaagagcgttcacacgcagtcgaacacgaacattcccacatttccgcgccaggtgcactccatcatccatgagctgcatgcatgcaattatgcaaattaagcgtggtactcctagattgtttagtagtagaacatcatttgccttgatcagctagccaacacataaaaaacaccatctttaagcccggtcagtgacaggtaggcagggtagtcactttttgccgtgcgaagcaagcactagagttaattaacccctggattaggataacgacaatgaacttttctttccaagatcatccagatggcttcctgatagaaatcgcagatgacactgtgcccaaacgtgatcgatccgtgcacgcacatgcaccacagattccgttcgtcacgcgcccgttcacaccgatggtgtcgagtggagtgacccagcaaccactcaaaaagtcgagtaccatccgaggaattttaactcgttttctaaactctttaaattttgatttaaaaaagacttttaaaattattttgaaatatttattcctttttatcacgttattcgtttgacgtggcaaaacaatactgtcggtctggccaacaaattcgaatttgaatataatttgggatgatatatttttaaattaaaaataaaagttgttaaaaaaaattgccgagtagataaagctcgggcttgggccccacctgacagcgaccggtccaaccgctaacctacaaatacccgcctcgcttcggacaaacacctcactcacctcacaggctcacacacaggcacacacacacttcccgatggagcccaccggcacgatcgtcttcgccaccgtcggcgtcaccaacttcggcttcgacgtcttctccgccgccgtgccactgccgccgatggaggaggacgccgagcgccgccacacggacggcgtatccgtgaacttcaacgcgcagttcgtcgacgatggcggggaggaggtggcgttcgtgtcggagcgaggcggcgcggcggggctgttccggtgccggccggggcccgagcagcgggccgagccgctgccgacggtggaggggagcctgttccatgaccgcccgacggtgaggggcgggaggttgtacttcgtctccgcccacgagcagccgccggcgccgttcaggagctgggcggcggtgtacgcgacggagattgggagcaaggagacggtgcgggtgagtcctccgggcgtcgtggacatgagccccgccgtgtcggactccggggagctcgttgccgtcgcgtc

SEQ ID NO: 74811 - DNA, 4068 bp, Oryza sativa
ctgcagccccttctccccgtccggcgaccgcgtcgggtaccaccgcttccgcggcgccggcgcgcggggggactcggtggggccctacctgcagccggtgcagagcccggtgagctcgctccggatgctgcgcgtgtacggcacgttcccgtcgttctcgccggacgcggcgcacctcgccatgaacggcgacttcttcaagacgccgggcgtcaccatcctccgatccgacggcgccaagcggtgggtgctcacgcgggagcccaacctgttctacacgtcgtggagccccgccgagagcggggtcatcttcacctccatgggccccatcttcgagaccaccaaagcgacggtgaggatcgcgcggctggagttcgacgccggcgagctcaccaccggccgcgacgaggtcgcggccacgctcaaggtgctcacccggccggaggccggcaacgacgcgttcccggcggtgtcgccgtgcgggaagtgggtggtgttccggtcaggccgctccggccacaagaacctctacatcgtcgacgcggcgcacggcgaggacgttggcgccggcgaggggactatccggcggctgaccgacggcgagtggatcgacacgatgccgagctggtcgccgaacgggagcctgatcgcgttctcctccaaccgccacgacccgacgaacgccgccgtgttcagcatctacctggtccggccagacggctccgggctccgccgcgtccacgtcgccgggccggcggggagcgcggcggcggacaggagcggatcaaccacgtgtgcttcagcccggactcgcggtggctgctgttcacggccaacttcggcggcgtgatggcggagcccatctcggcgccgaaccagttccagccgtacggcgacctgtacgtgtgccggctcgacggctcggggttggtcaggctcacctgcaacgcctacgagaacggcacgccggcgtggggcccggcgagctcgccggcggcggggctggagtcgctgtcgctgggcccgggcgccggggacgagtcgctgggcgagtttgatgagccgctctggctcacttgcgacgtctgagctgagggcgacagatgatgatcgatgagctgcacttttaattagaataaaatctgtggtgaatttgatcggttgataataacgggacgagcctgattgtgtgggctagtacgaaccttgttgggaataggttttttatgcatgaaaagggaataaatgaataatgattctgggtacagggtacgtttttgttccgttgcttgataaagctgattgtgattatgtggacattatccatcttcagttgtactactgtcgactgtcgtgtgaagtcacttttgcattatcaaaagtccaaaaacaaaactggacttctaggcttcttccctaatacagagtacagtacaactgccggtccaaagctttacttattccctgtttagttccccgtaaacttttttaaaaaacatcacatcaaatctttaacatatgtatagagtattaaatataaattaaaaaaaatcaattgcacagtttgcaggtaaatcacgagacaaatcttttgagcctaattagttcatgattagcaataagtactacagtaacccaaatgtgttaataacagtttaattatgctcaaaagattcgtctcgcggtttgcaagcgagttacaaaattagttattttatttatgtctaaaaactcctttcaatatctggtcaaacgttcgatataatattaaaaaatttccatttggccgactaaacagacccttactgggcttaactggaatcgttcgtcgaccaaaggggacaggacgaactgactggggtgggacggaaagcagagcagcacgccacggccatttctgagcggaataagttcatctgacattcctcaattatacgccgagtctgtctgagatccctaaccacaatactagaaatgtgtatcccataactatataaaaccatccaaaaaaaagtcccgatacagtatagatgcttggttttgctgacctggcatcctagtaagaaaaaataaaattaaaatgcggggcacacatgtaactgagaagaaaaaattacgcggtcaacaatcctacccagtaatcttcttgtcttttcctttttctcttctctttcatttttatcttcaccgcagagggggagcggtagcaagccagcgccgcggcgacaagcgaatgacgcagcgggtgaaaagagaaaaatcccgccaccgcctctccgcggccgcactcgcccgctcccctccctctgctccgcccgcgcccggagctgctgctcgccagccgccgccggcctccggtcacgcacgccgctgcccgctgccgctccccctcaacagcaaagataaaaacgaaagataagaaaattgctgattagaattgtttttggaggaaaggcgttaaacgcccggttttcattaaaaagcgaaatagttcatacatgaaaacggaagaacaaaaacaaggctggaatgaaaccagcacacataagttaggcactttagctgctggcacatcttaggaacaagccaggaaactagacaagaagaagataaagctacgaacaaactgataggcatagagatcttcagttcttcagcttcaggtgtttgctcctacagtccttcgggtactggcaagcagtgagtcccttgtagcattcaaagaactcttctcctttgctgacgccatttttttctccgctgtaaaagaaataagatagctttatgaggcaagtgagaggcatccgaaatcatcttgtcattgaacacccaatcatttctcatgagccaaatagcccaagcgcccgcagcgaagcaagcaagccaaatagaatgcgacccttctttgtacaagtttagtttatgtaccagttcgcctctagaattgagaatactatcccaacctagagcatctctataacagcaccacataaacctaggaatggcacatctaaacatcatgtggtccacgtcctcgacttccccacaaaatttacaatttggactaccttcccatttcattttcttcagctggctggcagcttgaattcttcccttcaacattaaccagaagaagattttgacttttaagggaatggaggacctccacaggtcctgcaaaaccctatctttaacccctccaaaacatagggcctggtaaagggatttggtagtataagagcctgtcgatgtttgatgtcgcgattccggtatttgcatagtatggggatcgttggtactatgatatacgtgaggctgaggtaaaagagacggagacagggatttttatacaggttcgggcccctgaattgtcaggtaataacccaacatcctgttggccgaagccggtattactcttattcaccataatcacactagtacaatatttgggataacctatcaaactgttgtcgatatggcggtgtgaaggtctgactcgtagtcgataacagtgtagccttcctcctcgaatccgcatccggcgagatcagagacagcgctatatctctcctgctgacagtatccgtaggcaccgtaagggactagccatgcctatctctgaagtcgatatctggcgtcttgtcttggcgtatgtcaacttgtatgttgtggcttctgttgttccatgtatgttgtggtgggtgtcttccatggtgggtgtgtcctctctcctcttagggggtcttgtatttatacccataggtgtccccttgtccaagtagaactagggaaaccaatatgaatacaatctaagtagtccttgtcgtttccatgtaaaactctggttatcttttcttatccggaactcctcctatatctgtaggttgcttccgtataggacatggtatgtagtgggtcctaccgagatttagtcaactactattaggtatgtgatatccataaccctgacagagccagacttatcagcttccaaaacatttgatctttatcacctgaaagatgaatctcccctacaaattatgtagttcttcccattcctccatctcc

SEQ ID NO: 74812 - DNA, 8452 bp, Oryza sativa
caccacacaaaatttttttaaaaaaataaaaagttagaaaaatttatgtatagaaatactatatataaaaaatttgattcaaattcaaatttgaatcgggtatgtaaactttttgacttataaactttgggtatataaactttagatgtatagaaatactatatatagaaaatatttgaattcaaattcaaatttgaatcagatataattcaaattcaaatttgaatcgggtatgtaaacttttgactaataaactttgggtctataaactttaggtgtataaactttaggtgcatagaaatactatatatagaaaatatttgaattcaaattcaaatttgaaacaggtatataaacttttgacttataaactttaggtctataaactaactttaggtgtataaactttagatgtatagaaatactatacataaaaaatatttgaattcaaattcaaatttgaatcggatatataaacttttgacttataaactttgggtctctaaactttagatgtgtaaacttgaggtgtttaaactttaggtgtataaatttactaaaataggaaagtaatgcggcgcccaacagacaggcacgggacgggcggcgggaagggcggcggcggcatgtggttgtagacggagccgaggaagacggcgtcgacgtctcccccagcctcagccaccggggaaggagctgggcacgggtggcaaccgtcgagggcgtcatggcttcggtcctcgagcgctgtcatggcgtcgcagtcgtcgccgcgttcctcccgccttgccgccaccgccaagccgacgccgatgcgttccacctacctcgtcgccaccgcccagccgacgagctcgccggccgcgcgtgtggctccaactcggccgccgcggtcgctgtaacgtcccgcctctcccaggctgggtccgcttacatctggcagctttcataggtcatagactgtcctcacagaccaacacaagtcttttctgcacactttgtcctcactcgtgcgcacccgggaagaatttcccaattggtcacccatcctaaaattactctaggccaagcacgcttaaccctggagttctttggagatcggcttccggaaaagaagttgcaacttgttggaacgtcccctctcggccacgtccgtgtgtccacccatcccaaaattactctaggccaagcacgcttaaccctggagttctttggagatcggcttccggaaaagaagttgcaacttgttggaacatcccctctcggccacgtccgtgtgtccagtgccagcgcatggccacccccggtccacaccagccatgcgcaccatgcctgcgcaactgcgacacacgcgcccgtgaaaccgcgagagtcggctctgataccattttgtaacgtcccacctctcccaggccgggcccgcttacatctggcagctttcataggtcatagactgccctcacagaccaacacaagtcttttctgtacactttgtcctcactcgtgcgcacccgggaagaatttcccaatcggtcacccatccctaaattactttggagatcggctttcggaaaagaagttacaacttgttgatatgagtattctattaatcctattaagccctaggctaggatgtcacagtcggccgccgctcctcctcgtcggcgagcacggagaggaagcagatgccgctgccttgctcccctcaccgccgccaccgccgccttgctcccttgagccaacaccaacgcattcctccaacctgacgccgacgctggtctccccgtgcctccacgccgtcgtcaccgcgttcctcccgccttgccgccggatttggacttgggaggagctcaccggcctccccgcgcctccgccgattctgcctccgccggccgcgcgtgtggctctagctccgccgctgctcctcctctccgccgcttcttcctcgtcggccgcgccgaccctctttcccaccgcgtcggtgacgccgccgccgcatcggccctcctctccgcgtcaattatgatggccacagccgcgcgccgccatcgccgaccgcacgagggggacggggaggccaacgagctcgcaccgccctgagcccgcgcgccgccacccaggagctgccgtcgctggcagcaccaccctttggccacgcgcgccgccgcttgtgcgagagtagagagcgagaggaaggagagaaatagagaaagagagagagggtgctgacgtggcttactgacatgtggggctcacgtgggtcccacgctgagtcagccgccacatgggacaaaatcagggtgaaaactgccgagggatctattgtgaccggttttgtaagttgggggacgccggatgtctggttttgcggttgagggacgattttgtatctggctaacaagttgagggaccttgcgtgtacttttcccttaggaaattacctatttcctgaaacacggcccaataacacagttacacgcattgttttgtccaacaaggcaatcggataaagttcattgatcatagtccagctaaattgctaactagtcaattgggaggttaattggtcaaaaaaattccttttttaaatgaaaatattagaaaacccatatttctgagttttgacccttccaatattccatccctgctgccgcggttttgtaaaattatagtatgcattcagcaacaattaactgctgcaacttgatacttcccctacatttcaacaggaacatgcacatatgctactgcatttttttgaccggcacatatatatattatacatgtgctacatttgaatacaggctacagctagttttgctttattactacgcttaattaattaattatcacaaacatgtgcgttagtttcaatttatttgcagtactatatcatctccaaatttgtctgctagctcacgtgcggttgcttcgctagctagtttaattggttcagacttaatttaattatattagctcgatgaccgaccggctaagtgccttgtcagagatattgaaaatacaacatacatgcagaataatccaccaatcgatatgatcaacgactctcccgcgatcgtgtatcggccggtgagagagagaaaaatggatcccgttttatgttaatctcagctggtcgtgatctgattcgtagacctaattagttgacgagaagatatatattgtgcaagtaatcatgcatatccctttaatttggatattttagcttagcatgcatacataaagtaggttggccgttttcttctaattgtaaggcagcattgcaattgacttctggccgggataagagattagctgtatgtgactggccaaattaagccgtttgtccatatatataacaatttggtaataatgtttagaaaacaattactccctacatttcatattatataagatattctagcgctgcccatatttatatatatatgctaatactgtttagattcattaacatctatataaatataaacaatgctaaaaagtcttataatataaaacggaggaagtagcaattaagtctccgtccgaattggaagagaaacctgcaagctggtggatatacggtgatagcttcatctttgaacaatcgatagatgacaaaagttcaaatagtatactgctacatcgatccatttaaaaataactttatttttcactcatcccatgtatacatataataaaaaaaatacaagaatatatatcctccagtttatcaaatcctaatatagtcgatctccactttaattatctgatcctaatataataattgttttttttcgccttagtagactgtgttttattttatgtttgttctttttcccgtaaaagactttgttgcgttcgtttgggcttggttaccaagctgggtaatgaaagttgactgttgtaaaaaaaaatctttaaagataaagttatttagagataaataagatggcataaaaatgaagttattttaggaacatggatagtactttgtactccctccgtcccaacaaaagacaaaccatgagtttctgtgtccaactttgactgtccgtcttatatgaaatttttttataattcgtatttttattgttgttagatgataaaacatgattaatattttatgtgtgacttgtctttttaatttttttcataatttttttaaataagacggacggtcaaacgttgggcacggaaaccagtgtttgtcttttttttgggacggagggagtaagaggcaacatgaaagtcttgaaaggtaaacgcgcgtatatgacaagtaattcggactaactgccggcggctagttagttctcaagttattcttttctttttctgcgagagagaatatagcttcgaatgtttcctatatgttatttttaaggtaatacagtatgtttatagaagatgaagctctacgcttgctgattgttcggtctatagaaatttagatgataaattaggttccacacacggctaggcctcatgtatttcctttcactataaaaaatgaccgtgcgttgcaacgggtgaagtctattttaatcttattattattacatggtttagttaagatgaaattcactgtgggagtttgcttggatatatatatttttagaaaatcatgagctgcaattagaagttcgatcgtctcaagttagcatgcgagtttttttaaacagatttcttatatgattccttctgtattaccatgggtgaacgatcttaaaaacgactcaaatacggatatgtatttctaaaagcaaacgaacttaaaaaaccgactcatacatgaatgacgtaccaaaatatttaatatcgtcaaaaatatcttcaatgtttataataagtagagaagagatatagattacaaccaaaacataaaattaaaactgactcaaacacggatgatgaaccacggaaacatcttcaatttttataaccgactcaagcacggataacgaatcacgaaaacatcttcaatttttattttatatatatatatatatatatatatatatatatatatatatatatatatatatatatatatatatatataatagtagagatagagatttgtacaaatttgctgcacccctctataaaggcaaaacgtacgtaatgtgttgttcaaagttaccaattaatccttcatgatggatgatgtccctattagtataatttaataagctttccgggtagatcatttttgttgttttagaaaatatacgtgtaacattatttattaaaatccacgcaacaagacacgtccctttgtcacgtattattttggaagtttttttatccattagtgtatttttatgaattaatgtcaataaactctgcatatatgtatgtgatggtttatgcttaacgatgcttctttttagcctacttggttaggacttagtaccttcttctgggaatatgaaggaatctacacactagtagctatcaccatctgggcgacctaccccaattaagacgagtttatgatttgatattatatttttctagtgtaaaatttggcatgttttatcttgcgtatatgatgtgacaatattttgactagaaattttaatttcttctggtactttaaaaaacagtaaaattttgcacgcatattcaattctaattcagataacttagctactgtatgcatatatgacgcgtaggaataaaaaactgaacttaatcattcgtgagatctatctttatatatgcggcgacgttgtgatatacttttcttgagaaagacttgaccaaatgcagaagccattgtccaacgcgattagattgaaattagagatatctatctatctatctatctatctatctatctatctatctatctatctatctatatatatatatatatatatatatatatatatatatatatatatatatatatatatatatatatatatatatatatatcgtttcacagtatagtaattaaccagtacagtatctcacaagatagtaactaaccagtacagtattttagggcctgtttagggagcttctaactgctacagcttctcccataatcagaagctcccttaaacagtctatcttttggtacagattccgagaaactgttattttagaatctataaaatgaactgaaaccagaaactgtgaaaccaaattttttcagattctcataaactggttaccaaccagctgcttcttagaatcttaacctggaattgagaccaagtacgtagtggacacggccggcctggctaaataattatcaaaattaacttgatttgacacaagctactgaaaccgccgtgtttctattaaagaaagttcgtactgtctagcttaattagatgctttcagaatcgctacgttacaatgaaaagaaagccacattcacgtgatcaaattgaatatatcctgacatcgctacatatcgttttccagctcgttgcgtataaacatctgaattaattttgctccaagacagtaatgtatgtctacagatgaacttgactatttagcaatagtagctaccagtagtaattaattttgtggcccggaaaaatggactaggcaataaagagcgaataggtaatcgtcattattatgttttttcattaggtcattaattgtcttatgttgaccaatagtatattatgccggctgagtgatatatcctctctctctctctctctctctctctctctctctctctctctctctctctataaaaatactagtaacttgaattatgcagaatatatatatatatatatatatatatatatatatatatatatatatatatatatatatatgagatactctagggctatttggggagcttctaattgctgcagcttctccagaattagaatctcccccaaacagtacagcttttaatccagattctaagaagctgtagttgtagaatccaggaaataaactagaagccagaagctgggaaacccagcttttctagattctgaggagctggctaccaatcagctgtttcttacaatcttaagctcccctaaataagaaagacaagagagaaaaaaaagatcattaatatttcagcaatcaagatccaactatccagccatacgtgcatgcataaatattactacatctgtcccaaaatataacaacctttcaacaaatgtttagattcgtattattatgatgtgtcccatccgtttaaaggttattatattttgagacggatgaagtaactgatatagtcctcattaagttgcaattttatcttggttagtagacgatgcattaaaacctttttgggtgtatttgtaaatttgccaccggttttttcaattttgtaaggatgccatttgaatgacagttccagtggtatttttgtaattttatagtaacagttttgcaataacgattcaaagtagtggtaaatttgcaattgcctaacctttttcaatagaaagttgctccaactaatatcaaataaatttattttttaagtatataataattaaaactcaattactcgtgtgctaacgattttcttgttctgtgtgttcttactacatcttcattcgccgttatgttgaacgggaccatatatatagtgtcgacacataattaatatatatagtattctttttaatccagactgaaatgtagtctcttgcatacacacacttagcttgcaatcgtgtgcgtgtggtaccaatatatacacgtcatcgatcgagaaatgagaacgagatggatacctccaaattaaatgtcatcatcacattcacatccatagacagatagattattacagtaattaatttgcttctggtgcaactattgatcagtttggtcagttggctgaaaatcttagtagatgactttctctgatcagaagataagaacgcgcgcatacacgcgcagtcatcatccgatgtaggagtagtatataggagtaaatctgaggcgcctctactaactatagtactataattttatggttcaagattagaaccgcatgtccatgagacctggccaaagtcttccataacaattaattacatacaaatgaatgtttaggaaaatgtacatagcgagtaaattaacctagtggaattaatactaggaaggtacgtattaaacttaagttacgaggcagctgacagacaatagtgatctttgaacattgactatgatcactataaagggtactctccctttgtgtcaaaataacttcatttttaccatatattgtttatctaaaaataaattaatattttagaaatcattatattataatttgataaagtgaagagtactctttttttaagacaaaagtgaagagtattctagtctttttcttttgtattggtatgtgtgaaatggatgatgaacattaaaataaatttattttaggattgaggtagtaattcttagtttaagatgtaattatctatca

SEQ ID NO: 74813 - DNA, 27613 bp, Oryza sativa
aaatatagattttttaaaaaaactaattgcacgattagggaggaaatcgcgagacgaatattttgagtctaattagtccataattagccataagtgctacagtaacccacatgtactaatgacggattaattaggctcaaaaaattcgtctcgcggtttctaggtgagttatgaaattagttttttttattcgtgtccgaaaaccctttccgatatccggtcaaacgttcgatgtgacactcaaaaaatattttttcgtgaactaaacaggccctaagttggcgaaattggcccatacgacgaatacagtaacgcatgtttttttatgaagttcaattcggcgatacgtctacgcccaagagttggatcaataccgaaagtcgttgctcaatttcttacgtgcttacaataaatctagctaaacaaatactcaattataatgcggccggggagaagttatgatgctgaattataaagctgatcatgccacatcgtagcagggtcgatttgtctaccctagttggtaggaaaaaagtgtatcttagttgacagcaatgcaaattttatagtcgagataatatcatgcccatgccttagctactcgctggcaataaagaccttagctactcgctagctagcaatcgttttcgcgctcgaataatgcgtttgaacatcgcaattaagatccagttaatctcatttagttactgatgacgccctgttgttcgagatctgttcaaagctctgaaacctcgacctggcgaaaaagttcagaaacatctctagtcaatccaaaccgtgacgaccttagagacagaaaaggggaaaaattagcatacgtacaactgggttagctcaacattatgctagcttagccttgccattcaaacctgattttgacagtacacaaacacaattcaaaacgggccgtgtcttctattgaaaaagaagttgaaaataaatgcatatcgatcgattgatctgtacgtgcgctttcaggttaatttgttcaacgacacatgcagtatacgcacgtcatttcgatggaatatgtggggttgaatttgttttgaaatttccgcatagatgttgagccacattttgacacagcgccgtgaaaactactaattattattaaataattcgcatgtgcatgtcataaattccacttgatcgcacaagaaaattgtggtgctaaggatcgagcaagtcgcgccatggctgatccacgacctaactagctaagctatagcttaatttgatttctatttaagaccttgacattaacgcatggaggtgtgcccaatacaattgtgaccgatcgatcgaggaagaagacgacgaccatgaggacgatgcttcctctcctcgttatcctcgtcgtcgggctccggctcgccggcgcgagccctccgccgcagccggtggcctgcaccaagggcaccaccgactgcacggtgaccaacgtgtacggctccttccccgaccgcaccatctgccgcgccgctgacgcgtcgttcccgcgcacggaggcggagctcgtggcgcccgtgacggcggcggcggcggcggggcggaagccgaaggcggcgacgaggcactcccacagcttccccaagctggcgtgccccggcggccgcgacggcaccatcatcagcacccggttcctcaaccgcacggtggccgtcgacgcggcggcgcggcggatcaccgtcgagagcggcgtcgtgctgcgggacctcatcagggccgccgccgccgccggcctcgcgctgccgcactcgccctactggtacggcctcaccgtcggcggcctcctcgccaccggcgcccatggcagctcgctctggggcaagggtagcgccgtgcacgagtacgtcgtcgggctacgcatcgtcaccccggccccggcgagccaggggttcgccgtcgtcagggagctcgtcgccggcgaccccgacctcgacgccgccaaggtctccctcggcgtcctcggcgtcatctctcaggtaagtacacaaaccacacgtgttctacttcttcgttaattatttcatcatgcatgtgatctgatccgtacgtatataccatggtgcatgcatgcattgcatgcaattacacgtaattgcatatgggggttaattttgtccttgattgtccttcttgctttggatcttatcatgaaatgaatgaatattactactactaactgcttgttgcatcgatccatggagattgattaattactttatccttccttcaagtgaaagatagccctaatcaatcaaccaaccatatttatgaatgaataaaagcatctagaacatgatcaatttgacatgaaattcatttgatgtgattttgcaggtgacattcgagttgcagccgcagttcaagaggtcggtgaggttcgtgacgcgggacgactcggacttcgcggagaaggtggcggtgtggggcggcgcgcacgagttcggcgacatggcgtggctgccgcggcaggggaaggtgatctaccgggaggacgaccgcgtcgacgtggccacgccggggaacggcctcaacgactacctcggcttccgcgcgcagccgacgctgggcctcatcaccgccagggccgccgaggagcggctggagaggaacggcaccgacatcgcccgctgcctcgcggcgcggctgccgccgtcgctgttcgagctccaggcctacggcttcaccaacgacggcgtcttcttcaccggctggccggtggtcgggttccagcaccggatccaggcgtcggggacgtgcatcagctcgccggaggacggcctcctctcctcctgcacctgggacccacggatccgggggcccttcttgtacaactccggcttcagcatcgcgctgcccagggcggcggcgttcgtcgccgacatgatgcggctgcgcgacctcaacccgcgggccttctgcgacatcgacgccaagctcggcatcctcatgcgctacgtcaaggcgagctccgcctacctcggcaagccggaggactgcgtcgacttcgacgtcacctactaccggagctacgacgacggcgagccgcgcccgcactccgacgtgttcgacgagctggagcagatggcgctgcgcaagtacggcgccgtcccgcactgggggaagaaccgtaacttcgccttcgacggcgccgccgccaagtaccccaactccggcgagttcatcaaggtgaaggagagatacgaccccgacggcatcttctccagcgagtggagcgaccaggtgctgggcatcagcgggagccccaacatcgtcgacaagcgctgcgccattgaaggcctctgcgtctgctccgacgactcccactgcgcgccggagctcggctacttctgccgcccggggaagcttttcaaggaggccagggtctgctccaaagacaaatccgccgccgccggtgatgatgatctcctcgatgaattgtgatttattattatttgatcgaatttcgttcaagtcaaataatacatgcatggctagctagctctgcatgaaatgaaatgcaaatttatatttaattaatcaagaaaaagataagcacgtacgaaataatccacctgctacattgggatggcgtatgtggtaggtagtgatactgtaaattggttggcgtgatttgattttgagatgtaatgatgctttaatgtggacagtgtcagtggtttggaaaattgtactccctctatctctaaatatttgacgccattaactttttaaaatatgtttgaccatttgtcttattcaaaactttttatgaaatatgtaacatttatatatacataaaaatatatttaacaatgaatcaaatgataggaaaagaattaataattacttaaatttttttaataagacgaacggttaaatatgttttaaaaaatcaacggcatcaaatatttagagatggagggaatatattaatttaatttgagttggaagaacaagttcaactgtttggaaggagcgcgcgatctgagtcttaatcagctgttgctttcgtctttcaatatgtgactataaacgtgtctctctatgtttttcgtcgttttattcgttgaataggcagagctcctaccgttgaaaaggtaagtgttaaactttggtttttgttggtgttctctctacgtttaatacttctaatttttagtcccatccaaacaccgtttatttgtttcttgcatttttctacacgtaactataattaaacctctttgtgcatttctctgcgtattctttttaactgaatcggcacagctcctgccttgtttctcttttacggttttgtcaaaggtaggaagttaaagattaaggttaatcctattattactatgaagctacatagtttcttaattatgatggtgggttgttttttttttagcaagagcagagagcccccatttccattactagaaatgaatagcaagctacagagtgagagcgagagatggtggccgggttgtaatgattatcatcatgcatgacattatctatcaaaaaaatctattcatggcaacatgtgcggcagcttattgagggttgagagtgagactgtgtcatcttgtcggtcatggcgtcgaatggctacggtcaaggaaattattttgttttgagtagttgaatggaggtctcaatcatttatgaatggggtatgctatgtttaatgcaactcctttttcggtgactaacgcaatgtcttttaaaatgaccactcctaaatactactatattcttatagaaacagggcataaactaaattgggagaatgactaattaatttggccttggccggcctatacttttttttatggttttgtatgaaatggaggtggttttcatatttatattattattgtgtgtatttagctgatgtcacttaattaggtccaccactttaaaacttgcctcatttaagtttgtgttgtaacagaaaatttatcatttgcgtttaggggtgtgtgaatacaatcaaaccatgcatattccatcaaaccaccatgaaatatggtttagggtgtgttatattatgtgtttgattttcaaagtttaaagtgaaaacaaccggttttatattttaggttgaaaaataaattaacttcgagcaattcatagactttacagtacttatatttggtgtcattagtatccatagttccttataggctagatcgatgtagatttaatttgctacggctacagctgtggtgcatttacagtatcgataacaacagattttgatctgcagaaaagctgaactgatcaggcttctgcagttgcatcgatctgttggtgataaccaaagcaagagttgatgacattctaactgcagtttaattaacgaagtgcataacattgaggtcatgcggtgatcacaaattaaactggcccagtacgaccaagccttccatttacagcccagtgcgacaaaatttcagccttaattgtcaagcgagcccattatcagacgaacgtgaaaaatattggcccacctatagcccactaagtgaaatcccagcccagtaatggcctattaaagcaaaattacagcccacgtaatctagtaaaagtaccgtaccactaatggcccagtaatacaaaatcaaggcccgtttatattacagtatgcattacagcccaatgatgatacagtaagtcaaatacggcctattaagaagacagtacggcccagtaaaggcccattaataggaaatcccagcccactaaagtccatttatagacattacttggtacaaagaatacattaaaaaaaagcatggtacaaaaatacattgaaaaggcgtggtacataaaagtaaatgagttagctatcaatttgcatggtacaaaaaatacattaaaaaacaggtgcatattatagaacgcatggaaaattatacatctgaaaccatttcatatggtaatggaggttatatttgaaaattttgttctaaattttggatgtgctgaggatatatattggtattagtggataaaagatgccgataatggaggttatatttgaaaattttggatgtgcggaggatatatattggtattagtggataaaagatgccgataatggaggttatatttgaaaattttgttctaaattttggatgcgctgaggatatatattggtattagtcgataaaagatgtcgatattttctttttagagaagggtatttttacccgatctctatacccaaccggatatatgcagccttttaaattgagaatttagcccctcaaacaactactcaggtcactgcaaccatcagtctacgtgactcaaacttatcagttcattgagacttttgaggctgacatggttatttttacaataggagattcaatgcattcttaataaaagagatggctttctagtggtgtaattatcagtgccattagcccaattatcatgcatcctgagatggaactataggttcaagatttggcatacattactggcacttaaaatccatggatatctctactggcacttaaaatcgacgagaaaattcgaaacccatctatcagattgctagtagtttgttgtggacaaacccgtgtacccgtgattgatatattgcttgagtaacaactatcacatactacagctgtacagcaagcaaatgatagcatttcctaccattttgaaacttgcaatgaaaaattaagcagcaaaatttgagtcactgaagcgcatttcaaactaactacaagtcaaccacacaaatgtcatgcatccttttacattctaaacctaattagaactactgagcatgatgcgtgaatggtttacatttctgaaatggtttcagccacatcagaaaccatttctcgattgattcgccggcggcgaggtggagagagagagtctcgagccgagccacgtttcgtaggggggaagcgagccgagccgagccgagtcaacaagtacaccgtacacggatcccgtatagagacgagacaagcgtacattcgtacgtactccgtgcaaatactgtttgttgcgtcgaatacacgacaaagtcaacgaacgatacagcgtggcgggggagctcatctcactggcctcgcgctcccacactgccacgtcactcacactctcactaatggctacttggtggttccggcgaagtaggcgagcgcgccgacgagcggcgcgttgatgtaggtggccggctccgactgcgcgaagttgccgcggtcgtcggcaaaggcgtcgcggctgtccggcccgccgacgacggcgccgacgagcacgttcgggttgggctcgccggagtggaggtagccgaagccggcgtcgcaggagatccgccccgggtgggcgcgcaccgacggcatggacgcgccgcggtggtgcgcccgcctcgggtacctgcacccgaaccccaccatgtacgacatccccgccgggttcttccccaggatgtagtccacctgccgcttcgccaccgccaccagctccgccgccgacacctcccccctcgctccgccgccgccgtcgccgcacgacgcggtggcgccgctcgaccggaggtacttggcgtacgccagcatcaggaacgtcgccgtcgtcacgtactgcatgttgctggagccttccctgtacaggaggccgccgggggtgtaccgcgactggaagctcgccgtgccgggcaccagcgagcagatgtagctgtcggagtgcgccttgtagagctcgaggccatggaggcggttgcggaggaagcccttggcgaggagcaccttggtgcccacccgcttgtcgtcccagctgaaggagtagtcgtcgtccccggcgccgagctgcatcccgttcgcctccacgtacgacatgaacgacgcgttcctcgacgcgcggtgcagccacgacgccccccacaggagctcgtcgtggtagcccgagtaggagcagtagaacgggcacaccgacgacgccagcgagtcgctgtacgacccgcggtgccggtcggcgaagtcgaacacctgcgtcgcggcgtggaggaggcgcgcggagtaggccgggtcggcgcggcggaacaccatggacgacgcggcgagcgcggcggccgtctcgccggcgacgtcggaacccggcttgtcggcggtgacgcggtagacgctgcggggtgtgtccatgtcctcggggcgctcccagcagcggtggtcctggttggggtcggcgacctggacgtagagcgcgccgggcgtggcggtggcggccttgaggaggtagtcggcgccccagcgcacggcggcgcgggcgttgggcagctcggcgcccatgaacttgccgaagtcgagcacgctccacgccagcatcgtcgtcgagaacgccatgggcaggccgaacttgacgttgtcgccggcgtcgtagtacccgcccaccaaatccacctgaaacacaaacacgccggaatcacaaactcctcctcgccggagacaaggaagaaagggaaagagagagaggcggcgtacgtacattgtactgggcgccgtcggtgaggccggagtcggcgcgccacggcatgcggttgccgggcgggagcttgccggagcgctggccctcgaagaagatgatggacttggcgagcgcgtcggcgtagttgaacgccatggccgagctcggaactaagagcagcaggtggagcacgaccagcagccgcagccgaatgccggcgccgccgcagctgctgctctttggctccattgctgcctgcctcaccggcgaagtgagagtgtggctcgagagtgaccaactgcacattaatatagtgtgaaaagcagtggccgttaagttagttaatttggccggtgctggagtagtatatcaatttgctgcgagaaaccgggaagttggggggacaatttgcaggagttgagaggaaaagaaatcgaaattccaatttccaagtgagcatttcttttttcctttttgactgacaatgtctcatggctttgggatttgtataccaaaaagaatgaatgaaatataccagtagcacttgctaactggaattcaacagagtttgcagaagctatcaatgtgacaagcacacaacaatttgtggttggggctgtttttagctcagcgcaaagtttatatttgggtagaaattaaagatatgggattgaaaagttatgtgtatgacaggttgatgtgatggaaaatgactgaagtttgaatccaaactttagatctaaacatagccaggtatatttctaaaaccaaaattatcgtatttgttcatctgaagatgaacaaaaaaaaaacagctgccttgtgacaatcctgttcctttgagattcacaggagaaaataatttgatgcacacacacacacaaacagtatcatctgaattctcagcaatgaacaccgtgtttagttctattttttttttcaaacttctaatttttttatcacattaaaactttttacacatataaatttttaacttttccgtcatattatttcaatttcaatttcaaccatacttccaatttcggtgtgaactgaacacacccgaaactggaaagccaaagcgtccggtatgttagctactaggccggtgcagagcagaacgtaggctggggaattcggcgactggtcggctttttgcaaagccaaagcaaaagcatgcagcgacatggacgaccgtctctgctcaccttcagctactgctactggtactcctctgcctgtctttctctctttttcctttttctttctttaaaatcttcaagccagccatccatttctccatctattccgatggccttcctttctccattctcatctcatgcgtgtgttcaaccaaggccacactgcaatgatgcctccagttgcatgaatattcatatcaagcctgtgtttagttccaattaaaaatttgaagaaattggaacgatgtgtcggaaaagttagaagtttatatgtgtaggaaagtttgatgtgacagaaaagttagaagtttgaagaaaaaaattaaaaactaaataaggcccaattgcattttgatctccactgatggtatattattaaggatctgtttggatcatttagtccctagactaaaattagtccacgattaaaaagtttagttccctactgtttagatctagggaaggcacgtgaaccgagggacaaaggagagagactgttattttagggcagtcccaacccataacactagacatggtttccataaactccacatcatcaagaaactactaatagacactactcttccaatgcaaacaccactattccatacttcaatttaatgctacttatctcacatgatgtcttggatgttgtgtagaaaccatgtctcatgcaatacatggtttccctctctttcttcatttattcacttgccacatcattttttttttcttaggtggcaacttatttaatgctatggatactatcctagttattgggttgggaatgcccttagtccctacaagtatctccaagagggactaatatattttagtcctaatatgcacttttagtttttttagtcaccctgtttgaattcttaggaactaaaaagtacaaaaatagagggactaatggattattccgatgaaccaaatatggcataagctatgctacttactaattacctgcagtagaatggcattaagaagagcatgcttaactagtggaatgaatgaacgctccactccaagtgcaattggcaatgatgatgttctctccagtctccaccccataatactgaaggactactcctataatctgaagttaattgcagagctcgaggatggcagatgcatttgttgtgttccatccatgggggcaacaagacccctctgcttgatacaagcacatgtgtagctttccttttgtcttactccaatctcaagtgcaatcctactatcacttcagaaaaaaaaaatcatcaaagtaaagcatagataatgtactagtactactactattccaccatcaaggaagaaattactctaccataactgcttttccttctgtcctactgcaatctcaacttctcaagtgcagtcctactacttcagataagatactccattccaaagtgcagtagggacaatgtactagtaccatcaagtaaatttatcaccactaaatttaacagaagctgtagtaaatttgattgttgggcttgacaattgccatgctttgataagactggttaaactcctgaagctgtgaccactgatgtttaccgaactgttcacatgcagcgtgcagaggcctgagaagcaggtgaagaactgtaaaaataaaataaaaaggctggtcaagtctggagagtggtcaaaactgacaaacatgcgttgcgttgcagctaaaagtaagggcttggctttgcatggcaggcactggccttcatcacagagaatcctattcctagggtactgtactatacgtgctatgaccagaacagtttcatcagtgaacaaagttgacagttgaaatacacacagggggacctcgtcctgattctgaatctgctttcgctggggattatgcagtcatgctgcctgaaaaaagtttaagcaaatctagtgggtttaatgcaaagaaggaagtaattcgtgtttatctgttcctttttcaactcccgttcagaaccgagggcaagtggtagtaaatgggagatgttattttgtgcattctaaaattcagaaatgcagctggggggctttttttataaagctggatatttatagatggaaaaattgcaaaaaccaccctagatattatcccgagtttgagacttcctccatgagacaattcgttggaaatacctcttctaattcacattagtttaatattcctcttcaattaccattgttcagtgtttcttactttctttcctcttccctaattattgttactcgtccattctcatggcgcaaagcatcagaattgcatcgagctcatatttcttatcttgaatctgccagagcccaaagaaaccaggcaccggtaaaccctatgtgacaaacgcaacaactcatcttcgacgacccccgcatccaagagcaaagactcgtgatcactatcacccaacgatgtgctgcccgataggtcgccatgagtggggatgccacggtcgtgtcattgggtctagccaacatgagtgacgaccatgtctcctcgcctattagtgtttgtataagcgtgtatgtagttaatagaacgaatattaataattggggaagaaggaaaaaaaacacgtgaacaatgataatggagggaaaataccaaagtattgtagacagattcagcagaaatagctgaagaatatacgtgcttttattcctttgagaaattagctatagcacctgttggttcttcagagttgttggtactgaattctcagtcagtcacagtgtgaagaacgcagtccgctaagttcttcctcatgggttgccaactcacctccctcattttctgcgtgtatgtttttcaaaccactaaacggtacatattttgtaaaaaatttatattagaaagttacttaaaaaatcatattaatccattttttaattttttttatagctaatacttaattaatcacgtgttaatctatcgtcccgttttccgtgcggaggggaggggttcccaacctctccaaaagaacacacacttgtgattcagatcagagttcacacaaaatactacacaatacgggcagttttgctcatgatcgactcggactattggtcaatcaaacagcagcaaattcagaaccatttgcaccaatcaggactatttttacccaattacaactagcatttcaaacgaaatgcatttgtattgagaccaggacctaaccggggaaaaaatcgcaaattatagcaaagcaactccaagggaaacaagaggcgtctcggcctcacctcagacggcgattcaacaagaggtcgaacagcctcgcgccaccgtcgcctcaccccgtcgccgccaccgccgccggcgacgacgatcgccgggctccacctcggtgaacggcccaccatcgcacactattcatgatcgtgggccgtcggatgacgaaaacgggccagtctttttttgtagactttaagggttcgatgacgaaatctctgaacccacttctctgatcgtttaaccgctgaatcactgtaaaaatatttagtcgcgcgtaaccattaaggatttctaattcttatatgccaaataatctcaaactcaatgcaatacctgaaaacggtcaggatttgaactccagcagcagcatgcagcatgctctctctccgtctgaattttgggacaatttggcactgaggccgtcgacatgaggactgaaaaaagcataaacatcgagcaacatgtatctggaacaaaagtgcattgatcttgtatcgagtggatctttgcttcggttactgtacatgaccttttagctcctgaattgtaccaatgcttagtcagtaatcaaacaagcttcattcagcccatcaaaacaaaacaggttttgaagccatcaaagaacattatcatgcagcctgtcaaaacaagactgttttgaagcaaatttaggtaggaaaaaattaaaacatttaaaatcaggaaaaaaaataaagcattcaaatttgatttggatggggtgcaccagccaaggctgtagtgcaacgcctaggcgacacatgagggccctagtggcaagccactatggtggactctcccccacgaaaaataaatttaatatcaaagtagacacatggcccacatatcagatattaaactgataagaacagatactacacttgatcttagccaaaaggccgagaaaggtatgagttgctatcacgttcacctcctgcttttgtagcctctccgtacatctcctcgtcttgatcgcgcgatgtggtactaaactgtgacaatgaacgaacaaacgggagggggatacaatacatcatgcgatgcgggcttgcgtgggccgctggctcggcgaaaccctcaaatgggccggccttttgaaaagtctgtagttaagggggttcggagtcaaaatctccgacctccctttctgactgtttcaccccatcatatcgcagtaaaactatttgagaggcattgatatagattgatcatatctagctgttatatcaactatatgaggagaaatttgaagataaatacgagcttgccttgcattttttttcttttctttctcaattctcatgatttatttttcctagaatcctgtcatgttcatcctgatgttaagcttcaaagacgcagaaattgttttttcgcgaagaaagacgcagaaattgtaagaagctgcagtaaagacgatcaagatatgaactccagatcgacctccaacaacgtgctctttcctttaagtctgtagtttgggacaaattgctgtggagagcgtccccagtcgacctgaacaaacactagcttcaattggctcttttagttgttttactctacttagttctgaattttcagtctgacaaacacagaattacgaacggtcgaacgcatgcatctgtagcgtgaattgacaattacataaacatttgttatttgcactacactatagaccatagtgaatctttacttacatgtgctgggcataaaaataataatttcagtacacaacaactgtactttttacattctgaacaagggttcttagatgcaaccttccactgtactttgcaagaagaattctcaagctcaaggcaaggccttaattaacccagagaagggaatcattgatgatttgtttatcgccatgtacaaacacaaatgataaaacagagaactatcaggattggaactgttgctttgtgctctatctatatgatctgaagtttggcacaaattctcactgaggcatctaacaagagacctgaaagaaaattaacagagattgagcaacatggtatgtgggaacagccgtgctttcatctaatatattcaaacaaaaaaaagatttgtcagtatgtattttgaagaacagatttgtgctcctttgttcagaattgtcagtctgaatatattcaaacaaaaaaagatttgccagtatgtatcttgaaaaacagatttgtgctcctgacaataccagtagatgtgcaaatgctattcagcaatcaaagagaccatcaaaagtgactcagaagtttaaaggcaaatttcatgccctgaaacaaagagcttggataaattggatttaacaaattcaattggatttggttggggtgcgccagccaaggctgtagtgcaacgcctaggcgacacacgaaggccctagtggcaagccactatggtggaccctcccccacaaaaaataaatttaatatcaaagtgggcacatggccacatatcagatattaaactgataagaacagatactacacttgatcttagccaaaaggccgagaaaggtatgagttgcattgttggctacaccctgcttttctagcctcttcctggtactactctccttgatcctgcgatgtggtacaaaacgaagacagcattggcgtttgctgtgcctgtgtgggccgctgactcgtcgaggccttctcaaatgggccggcctttttttttgcaagcctgtgttactggggttcgtgtttacttgggggttcggagaaaaaaatattcagacccccttctctgatcaaaatctactcactgaaagcgatcaagatctcaactccagacctctgctctttattgaagtctaaagtttggaacaaattggtgtggagagcatcaatgaattgacctgaattaaaacatttagagagacatgtatctgggaccaaagtgtgctttgatcttgtatctattcgctctttgattttgttactgtacttagttctgaaatttcagtctgaagatcacaaaaaaccggaactctttttttttttgcagaaaacagaaacaattgtgctccagtaattgtatccctgctttggatctattatgagcacacacctaataaaattatgaacgtccgaacgcatgcagcgcgaattaacaattacataaacatttgccattttcactacattatagaccatggtgagactttacatgtgctgggcataaaacaataatttcagtacacaactgtactttttacattctgaacaagggttcttagatgcaactgtccacttcactttgcaagaagaattctcaagctcaagtcaaggccttaattaacccagagaaggaaatcattgatgatttgtttatcgccatgtacaaacacaaatgataaaacagaaaatgattaggattggaactgttgctttgtgctctatctatatgattggcataaattctcactgaggcatctaacaaaagacctgaaagaaaaataacagagatcgagcaacatggtatgtgaaaacagccgctttcatctaattgtcttgtatctattggctccttgatttagttagatactgtactttgttctgaattgccaatctgaatatatctatctatcttctattatatactaaaagtccattaaacgtcctacaaacactctcaagacgacacgtggcattcttataaacgctcataaaccgtcacgtggcactatttaatctcaccgtcgattttcatttaaattggtggacccgttattttagaccattagattatatctatatctataccgttgattttcacttaaattgatggatccgttatttagatcattagatatatatctctaatactaatactttccacctatacatacgagagagaataggttcgccaaaaaaaaaaagtaagtacgtaagattgaaaaggaacaataaaacctacatacgtacggtaaaagaataaagccatcatgtcaaaaaaagatagaaccaaaaaaaacatacgtatatagtatcatacaaaaaaaataaaaaaactcccatatactcccacacattagttattattaataaatttgaaaaaaataaatatattcttcgaattagtaaaggtgtctcatgtgattatcaacaataagtattgaaaataaaccaagcgctaaactatagatgtttgtcaaaatataaatgtttaacaccataaacacacatggtgtctactctataccaggaatctactcaaaacttaaaaaaaaaattcttttgatcacctccatcttctcttttagtaccgtcgaattacaacttcgctcattttcaaattgcataatgtttaacaccataaacacgtggtgtctactctataccatgaatctactctcaaaacataaaaaaacattcttttgatcacctccatcttctcttttttcttttatgaagggcataagcatgaataacatagtttgctacgttgctataagtataacagggacgtacatatgggagttaaggcggtcccagtggagaccacagtcaccaatagtgctcaacttactacttaccgatgcacaactcgataagggtgtgatagtaaattaggcattaaaattgtgttccaggttagtctggaggtgcacaactacatcgatatgggacccatgtttcaaggaaatagacaaagaaagtctcgccactacaatcggcttcacgcattagagaagcatttatatataacttgatgttattctattaatttgtacaagtggtatttttacaatatttatatatagttttgaaaattggtgaggcacgaaacacttacgtgtagtggatatttcaatgtattaatgatgtattaggcttattttattgatacattacgtagttcatctatgaataggtacttggcttttaaacagtgataataggttgaagtgacaacaagaaaatttatatgtaaccagaggcaaagtgattttatttaatctaggagataaccttattacttaaatatattaaagtatgcaatatatttctcggcttataaatggtgagatataacctttttaaaaaattgtcttcataaaactgctcgcgcatctgcgcgggctttcttcctagttcaaacaaaaagacaatatattcaaacaaaaagagatatgtcattgttttagttagatactgtactttgttctgaattgtcagtctgaatatattcaaacaaaaagagatatgtcagtatgtattttgaagaacagatttgtgctcctgacaataccagtggatgtgccaatgctattcagcaaaatcaaatagaccaccaaaagagactaaaaaagtttaaaggcaaatttcatcccctaaaacaaagagcttgaataaattggatttaataagttcaattggatttggttggggtgcgcctgccagggctatagtgcaacgtctaggcaacacacgagggccctagtggcaagccactatggtggaccctcccccacaaaaaataaatttaatatcaaagtgggcacaagacccacgtatcagatattaaactgataagaacagatactacacttgatcttagccaaaaggccgagaaaggtatgagttgcaacattggctaccccctgcttttgtagcctcttcctggtactactctccttgatcctgcgatgtggtactaaacgaggacaacgttggcatttgctgtgtctgtgtgggccgctggctcgtcgaggccttctcaaatgggccggccttttcttttgcaagcctgtttactcgctgcaagctcgaactagaaattgctttgttcaacaagtgacatgattctttggctgattatgaagattgcaggtgtgcgtacatcaaaggattgatggaacatgcactgcagtttggtttaacggttacatcgaatcgaagcaagaacaattacatgaatatttgaagtattgcatttgtactatattaataccatgatggatctttaattacaggtagtgggcacaagaatttctgtatacaagcactgcatttttttacatgaggaataaataagggattattgcggaaactatctaactagtaaaatatttatgtggaaatttctcgagctcaaaggcaaagccttaattttcccaggcaaggagatcactgacggttttctgtgatctgtctatctatataccaaatgataaagagtggtacaacgtatgaactgtcgattggcctgcaggcaagtgaacaaagtaaaagaaactaataattagtcatacgcagcaagaacaagatcgtaccacacaattggttaaccgattcttacgtagctactatgggctatgagctgtggtgcgagcgttttcataagaaactgaaaacgtccaacatctgaattcagcattgatgtgatgtgctctaagtctgaagtttgggacaaattggcgctgagggtgttgagatggaacctgaaaacaaaaaaaaaaaaaatcaagaccaaccataataagtctgcgatatgctctgctgctatttcaaactggcagtgctagctagatttggtcagattcttcaatctgagatgttggcaatttgggtgaaactcacatagattggcatagcagggctgttttgatgctgggtcttcttccaagggtgggggcacttggccgtaaatcatttcacagctcatatcttcaaaatctgcggtgattcataaattcagtacttcagggtacataatcagctaggacagtgtaaaaattgagaagaaaaaggatggacaacatgcatgtcaaatggtagtatgtcattgtcaaaagaacaggaagaggaaactgcagagtttggcattgagtagcacaagaacgatgtctgtcttacttggattcatggtgagagggagtccgaactcgttggtgaagaagttttgcgtcggaattttgcacatgttgacgcacattccgacgcagccgctgttctccaggtacctgaaacggagatgaatgttttctgaattttttactgaatctcgcttgaaatccaagacgaacacagttgaatcgtccgtcttacctgcatttctttatcagcactccactcttctgcttcaccccattgacctcaacctccacaacctgaaagatcaaggaattgatgcaatgagttcatgacgatgaactagctgtgtctctgaattatactcctacctctgatgggccgacgagccagtggaagaaggggacggtgagggcagcgttgaactcgcaggcccacctcgtcggcgggaagagcttcttgaactgctcgggggcgccgggggggagcatggagaggagcacctcgcggacggcctcctgctgctgcgcccgcgtccgccccaccatcacccgccgcgacacgtccacgaagctctcgtagtcccactcccacaccgacctcgagctcttctccttcttcttctccttccccttcccgccggagctggagacgacggcgtacttctccatcttgcgcgcgaacagccccatgaaggcgcgctccaccggcccgtcccggtactccgtcttctcccccatcggcgccggcgcagtcgccgcgcaccgaaccctcctccctgcagacggtacacgcgaccatggcgccgccactggcgccaacagcaacgccgccgccgccatagtcgtcgtcgtcgtacgtcgtcctggctcagctcagcctctgcgtactcttggcgcgtctccaggtttcatgggcggtggtggtggttcttggcattggcgttgcgtcgtcaggcgaacctgaggctgccggcgtgacacggtggcggcgagcggggggccatcgccgtggatgcttggcactgggtgcacgacggccacaataatttggtggattatatggtgatggtgatgatgtttgtggcgattcgattggctcgtggcgcccacgattttttgtgtggaggcccaaaggatggcaagtccaatgggctaaaattttcaccttggaataagttcactttgggtccctctatttgtcactcagtccgattttcgtccctcgaccgcaaaaccgggtacgacccgtcccccaacttacgaaaaccgggcaaacgaggtccctcagcggttttgaaggcggttttggatgacgtggcatctacgtggcttgtttgactaggtctccgtcccacgtggaattaacgtagcgcttacgtggcaattttcaacccgaaaaataaataaacctcgcgggacccacatgtcagtttcacatagaaattataaaaaaggtggggcccacgtgagccccacatgtcattctctcccccccccctttcctccaccgccctgttccaccgcatcctcgcagcccgcgcccgccggcactcaccgacgaggcgacgacatgaccccagccgctgccgcagcccggcgaccggcggcaccacccacctccctaacccgccgtggccgctcggggtaagacggttcccttgttgctgctcccgccgtcctccgccactcccgctcccgccgtgacgacgcaagagtggaccacgcccggccgggcgtaggtcgacggtggcgaccagctgtggagcggagcaaaggccggtgacgagcgccgtcctcggtgccccagcgaacagcatgaggcgaggccccatcgaccaggctcggaggggatccggccacccggcaacggcttggagtagaggatagaggagatccagcgaccggcaacggcgtaggcggaggagctcgggggtcggcaagtggagagacgggcggcggcgaggggcccatcccccggcggatggggacgtcctgtggccacggagcccggcggatgtcgacgccccatcggtggaggaagtcggccggctgcagtagccaccgcaccagcggctccgcttgccttggcagcgctaccgcggacaacgacgccgcggccgctccccccgccgccgggtcgacgctcctctgcgcgctcgccgacgctctgtgggctcaacggctgcggcagctagagccacctcccgccgccccttcctctcccgccggccgccgcacgccgagcgccgctgcctctccaccgcgagagaggagaggggagagagagagttgaagagagggagatacgtgtggggcccatgtgggccccactatatttattatctgacttgtgggcccatgtgggccccgctattttaaaattattttttgtgtgcatctgacaggtggtcccatgtttttttattaatttttcaagatataatgccacgtaagcgccacgtcaatgccacgtaggacggagaactagtcaaacaagccacgtaggcgccatgtcagccaaaagcgccctcaaaactgtcgagggacctcgtttgcccggttttcataagttgagggacgggttgtacccggttttgcgttcaagggacgaaaatcagactaggccacaaatagagggaccctaagtgaacttattcctttcaccttccgccctcggcctgatggacctaggcctatgtctacatgggctgaattcacatttcacaactgacgtaggctgagttcgtttcttttacttccccaactcacctctctctcttttccgcaggcacgtttttaaattattaaacggttttttaaatatatatatatatgaaagttttttttaaaaaaaatcatattaatccattttcaaaatatagctaatatttaattaattatatattaatgaggagtatttcgttttgcgtgcgtgggatctcaaccatagaactcagccgtagtgtacttattggctactttattgctatacacgtaatgtcatcgcttatacacttcatcccataaaaacgactttttgaaatgtgtcgtctataggttctactcatccacgcacgtaaaacaaaatgtcgcattagcgcacgattaattactttcttattttcatatcttatagtttcacaactacattttacacctcaatgcataaccacacaatgttattggacgtagatcttctgcagcactgttgctgcaatagcaatggttttcatgtgaacccgaattcacacgtcagtgtctaccattgcactagcaatactgtacataatctcaccatcggatgtcatttagttggaattaaacccggaatacatataattttcatctcttattcctccctacgccattcgtatacgcaagtacaatcgattaatcatcgcaaagagaaaagaaagaaagaaagaaagaaaaatctatactctcgatcaccaggctacatcagtgtgccagtaaagatgctgaaattcatctcgaaacaagatcatatattccacttgatatatctcacgattctttacgtaagttgctgtttaccactagttataacttgatactagtacatcagcatgtcgatatattgcaatcaatacgatgggaagtactattagctagtacagatcaaaaagtaattaatccattgcaacatgagaaaagttcacatcaaacctatcctatcagcgtccatccagtagagaaaagattagaggaaaaaaggagcaagagagctatgtacgggcgtaaaattacgggacagggctgaaattcgttggaatcctaagaacgtgtgacggcttctctgatacaagttgattaattaattaagctgagctttctgtgtcccatttcgtcaattaattagctaccctctcacacaaacacatttaccatttaggccgagtttagttctaaactttttattcaaactttcaacttttccatcacatctaattttttatatacataaacttccaacttgtccgtcacatcgtttcaatttcaaccaaacttataattttggcgtgaactaaacacacccttacccacactcgaaaaaataaacgccagaatgcagttgtataagctatacggttgaacaaatactgattataaaccgtacagcttatcggcaatgaaataatactaccaatttacaggtaaaacttttatatatgtttcttcagtgatttaaattccaatgctaaaaaaaactttgatgaaatatctcaaagtcaactctaaaattaaattttaatgtttaattaaattagatggctgcatgtaaacaatagttatactgaagttcaaatttggcatctttttcttaaccttctgcggggtcattggattgtcaaaagctagcttgcaacttgctctgaaatatttcatgaagattagataagtcaaaagcctgaattaattgtccttgttgtcgggacaatgggacataagcgggatatggtattttgtactacctccgtcataatatgtaggatgaggttaaattatactagaattacgaatccatgaatatgatgtgtttaatcccatcgtaggttgctacttgctactcccaataaaagagagagtatatgttttatcgttacaaacatccttgtacgtactttagattgtcctagcattagattataatttgaagcaaaatttaactttgaaaattacaagcacctaggacggagggagtagattggaagcaggtttcttcaatctctatggcctgcctcgatcgaatgccctcttttaaaaaattttctcggtgaaggtacatatgggccggacagatcctaattagccagcaccaggcagatgcatcccgggatatgatgggattccacaaaataccagatataaatccagatggagaccataattctaattaactaaactgcatgcatgagatctggagctgtttaatttcatcattagctagagcaagccagtttagcatacatgattttcacattaatttatgcatactatagttatttcacacaaactcgatcactgtcgaaccgtcggtttcattaagtttgatccgccgtgcttaactgaaacatagaaaaacaataaattgaaatacgaatagaaacaaaacatgcccatgctcatcgaaatgaactgatcgatgactagctatagcttctcctttatttaattaattcggtaaaagtacagcaattctcatcatgcactgagctctactacatgtgatctgtacataattacacacgcacataatccatagaaagaaaagcagaaaaagatgagatcgatgaactccaagaactaaagaattaattattacatgcacgatcactatcaatatatattgtccgtgtaccgtaagttgctgctagctagctagctagctacttgtcgattaccaccatggacaatggcggcggcggcggcgggtggccggcggcgtgagatcctttgtgatcacttacagtagacggcggttgcaaggagagggcgaggtagacgatggccggagtgcaggcgaggacgaggccgacgggcaccatccacagccggctgttggacgggtggaacgccacggcccaccacgccagcagcgacgcccccgccatggccgccgccaccaggcacgcgtccacggcgacggcacccgctgccacctcgccgccgatggcgcccgccgccgccgccggcggcttctcgtcgtcgtccatgccgtatatactttggaatggtgacaggaagaaagaggaatgaattgaaggtggtcaatggcggcttattagctctgcttcctgtatggctgtatatagtctcgtactactggtgttggtgtgatgtggtggtttacgttattggaattggaagctgcacccaaccattcactgcctataacttactctttccttcctggtcttgcaccactcggtgtaggtgtgttctgggcatgacaacaacttaacatcgagagaccaaatagattgatcgatcgcccagttcgattatttattttattattgtataaaaataccttttttccttcacagaatttaaacttatttctactgtattgcttattattacacttatttgttcaaagctactgttagttaggagtaccgtttcttaaaataatttactgtataattagagaaaatccaagaaataccattaataaacactcaaaatacaagaaatatcatcgataagtgtgagttccataaaatgatgtcgtacaagtgattttatcccagaaatgctatcatcgttagggttccgtccattccgcgccgttaaatgcatgttcattctatagcatttaatggagtgatattaatgtaaccctgatggtgatggcacttcggggataaaatcacttgtacaatgacatttcatgcaacttgtacttgtcaatgatatttttttggaattgaacgcttgtaaataatatttcttggattttctcatataattaagtagctagataatccgtgacaacattgcatgggacgaggaccaaatcaaaccagccatgtaggcaccatatcagctaaaaccatcatccaaatagcattactgtatctggttttacaaaccgattgaggggcgtgatttgaactcgacgcttattgaaggacctaaagtgaactttttactttctaaaccggagtcaggaaagcccatcaattatatccattctttaagcccaattatcaaaagcccatttcagttccttccctgtctcggcccaaacctccccactcggcgacgcgaccaccaccactctcttcttcttccccattgccgtcgtcgatctcgccggcgacaccgccgccaccgcgcctccgcctccctcccttccgcggatcgtggcgggctagggcgtggactctcctcctcggtcctccacggatcgagcccgccgccgatgggggtggtgatcgagcgggaggagtgggcgctcacgccgctcgcctacccgctcctctccgccgcctccctcgccgcggtgctcctcctcccctacttctccccaccgttgcacgccaccgccgccgcgtccccgtcgtcgcactcccccttcgacgtgggcaccaccccgttcctccgattccgccgcggcttcctcttcgtgttctcgctcgcgtccggtaagcgctctcctccattcaccattctgccttgctcgagccagcgtgcgggggggctctgatgggtctcagttgttgtgtagtggcggaggggatccattccgtgttcggggaggatgagttcgcgcggtgtgggcttggaagggagcagatggccgcgcgccttgccgccgccgcagcagccgtgctcttcctcggtgggctttccggcgtcgtctcagataaactgtgagtagttgtgacttttggggagcaaactatttatccttttcgcagctctgtcagtagagattttcattcagactatgaattgctgctggatggtcgaattacttgtaaattcatcaaattcctcacgcttatgtgatctcccattgcatttcgaaacaatgttgatggtattcaatgtttaaatagagggactactgcttcctagtaatcaggcaagctatgtttggtgcctgattctggaacttttgttgactgttttgtttaaaatctagtcatgatgtttactagttggtggttaagatcaataagagtttttcattcatgttgaccctgctggtagaacatttttttatccttcacttgtttattaccaattctataccaagacataccccttcaccac

SEQ ID NO: 74814 - DNA, 842 bp, Oryza sativa
ggggtattgatgaacagatattcaacttgtggctttgccatggctctcttcctcctccaactctacctcctatgattctatttctctaattccaatctcatgcttctgccttccctatattactcttcccaatccctgattctactctcttgattgtattcctgagcacttgtattcttgagtggatttgcaacatatcggtggcacttgtgtgagaaatttggtgtgattgtgttggttcgtgatagcgacctagaagtgcacttgctgagttttcatatatgagcaatcagaagttagatctattttttcctctcgctctctcttttttttttcaagtgaaacacgacgatacgatgtaaattgaacaaccttagcacatatggcttacaatgtttactccaaacacaaatataaccagagtgccccggtcgtgttaaacttcaacacattcttcaaagaaaaacagaacaaggcttgcattgaaatttcccctgaactcacgagtggtcgctactggtacatggcagaaagctcgggcggattaccggcgcattgtgctcaccgaggtaggggtgaaaacggtatggaaatatccaagaattccggctaccgtttccggtttgcaccgaccgtttcagtcggtatcggaaattgtcggtgtcggaaatgaaaacggtaatctcttccggaaatgttagcggaaatgatatgggcttttttccgaccgttttgtcggtaaccgttttttatcggtaatttccgtcaaatttccgacaaaattccgaagaaggaagccgtgttctcgaagactcaaatctatatctaaaaaaagtcggaca

SEQ ID NO: 74815 - DNA, 5075 bp, Oryza sativa
tgcgacgacgtgcagtctcacaaggactggatcaaggacatcgaggcctacaaggtcattttaattaccttcctggcctagttaaatttgtgtgaaaacgtagtaactaattaactagatcgatcgtaataatatatatttttttggttatagcctgggaaccgcgtgacgtacccgatcatggccgatccgagccgcgaggccatcaagcagctgaacatggtcgacccggacgagaaggattccaacggcggccacctcccgtcccgcgcgctgcacatcgtcggccccgacaagaaggtgaagctgagcttcctgtacccggcgtgcgtggggcggaacatggatgaggtggtgcgtgcggtcgacgcgctgcagacggcggcgaagcacgcggtggcgacgccggtgaactggaagcccggcgagcgcgtcgtcatccctcccggcgtctccgacgacgaggcgaaggagaagttcccccaggggttcgacaccgccgacctgccgtccggcaagggctacctccgcttcaccaaggtcggctagatcatatcgatatcgacctcgctcttcgtacatcatgtgcgccacgcgtgcgtgatagcgtgtgctggcgtgatgactatgcgagatgcatccctgtgtgtgttggtgtggataatgccgctacgtttggaacagtagtgcatttactctgtgctactgtctgaactttggctgtttggcagactgtttatgtacccgtatgttcgcccctgtactaatagagtgggtgttgtggttggcaagtactctcctcggacaacattttaactttgactactaataacaaacaaattaaaaagatcaatcagatgttactagacatcttaattttattaattttatagatattgatattgtttgttcaaagtaacatcgtaaagttctaaaatgtttatatttgggacggaattaaaacatcttaattttataaatattgatcaaaatagcatcaaagttctaaaatgaagccatcatttagtatatttcgttaatgaaatttagtatatattgttaataaaatttttatatacgtcttcttagtaattaaagagctttacaaaacaaacttccataaaaaacccctaaaacaaacttcgataaaaatttttatatacgtcttcttagtaattaaagagctttacaaaacaaacttccataaaaaacctctaaaacaaacttcgataaaaaaacccctcgaagataaaaaaagaccctcaaaattaatttgaggttaaaaattaggctaaaaataaacttgataaaaaaaccacccctcgaagataaaaaaagaccctcaaaattaatttgaggttaaaaattaggctaaaaataaacttgataaaaaaaaccttaaaattacttttaaaatgatttatattcatgatttatattctagtacggagaggattctagtacggagagggtgggtgcatacatgcacattccaatgtaaccaaagaatgagaacaaatgattaaaataataataaaacagcgtacacgaaaaagagaaaaaaaaggacgaagagattttagtgagacgtacgcgcaaaattctcagtcgaatccggccgtaaactctccataggaaaagggtcgacaataggtaatcacccaaaccaagtggttaacgaactaatcaggttggcattgcaacgtcatcgatgatgaaatcaaacgccgccttttagtattttatagtaggagggtcagcctcttctttggaaaaaaaactgtgatactacgaggaagcaatcgtccgttggcatcgctcgcgtggttagttgtcaggtcgctccgcttcattctgctgtgcattttggcgagtgcctagacagatccgtgatgaacagtatatgaaattttccacactttggcctggtttagttcctaaatttttcttcaaactttcaactttttcatcacatcaaaactttcctacacacaaacttccaacatttccgtcacattgtttcaatttcaatcaaacttttaattttagcgtgaaataaacacaccctttgattacggtttagtcagaacatttgcgaattgcaatgcgcgcgggtgaaacacctttatcagacgcgatcgggaattcaggatcgggaacagctgcgtgccgtgcagaataatacttcgtattacagaaagtttagaatccgtattacgcgagagcagagtcgatgcagtgtgttttgagtaggggtgtgaacgcagctgaacagcaagcagagttggcagattcgaattcttgtcccgtaaatttttccttgccttatcctacacccaggcctagatgcttgctttttataatcctctagtggcaacacagcctcacctataaatgctgtgactgatgataagtccagtgcattccatcacagacagttcgcagaatcgcagcagcttagcttaattacttttttcaccaactcaactttcagttaatttccggttaatcctcgattcctcatcatgcctggactcaccctcggcgacgtcgtccccgacctggagctcgacaccacccacggcaagatccgcctccacgacttcgtcggcgacgcctacgtcatcatcttctcccaccccggtatatatagtgtactactgcattactgtcgtactgcgtgtgtccgtgcagcagacgagcttgagaagttgagatgttgatcaaatccgtgcgtgcatttcagctgacttcacgccggtctgcacgacggagctgtcggagatggcgggctacgccggcgagttcgacaagaggggcgtcaagctcctcggcttctcctgcgacgacgtcgagtcgcacaaggactggatcaaggacatcgaggcctacaaggtatgtacacgatcgagttcatcgcattcatcaatccttgactgattgatacatttgcagagtcgtatctgattataatttcttggttcaatttgtgatcgatggttgctttagcctggccgccgcgtcggcttcccgatcgtcgccgacccggacagggaggcgatcaggcagctcaacatgatcgacgccgacgagaaggacaccgccggcggcgagctccccaaccgggcgctccacatcgtcgggccggacaagaaggtgaagctgagcttcctgttcccggcgtgcacggggcggaacatggcggaggtgctgcgcgcgacggacgcgctgctgacggcggcgaggcaccgggtggcgacgccggtgaactggaagcccggcgagcgcgtcgtcatcccccccggcgtctccgacgaggaggccaaggcgaggttcccggccgggttcgagaccgcccagctgccctccaacaagtgctacctccgcttcacccaggtggactgagagactgatggtgagggagggagggagagatctgggccgtcggtttcgtgtgtaataaaccaacgcacgacgtagatgcttccacgtgtgtgtttcccgtgctgcttcgattgatcgatcgatcattcggtaagtactctagttatgtgtaatctgctgtttgggtgtagtggtgcatttgctgttctgttgcctgaaagtgacgaacggattatgtttgtcatttgtatgtaaaatgtaaccgtatgttttttatttatcccttccgaaattactgtggaatatagtgaagtaatgctgttaataaacagcccgtttaaatatgttttgtccgtgatgggttgggcgtttgagatgaaacccatcaagagtggtccggtacagttcatttaactaatgggccaaaattctcggccttacaaagattgtaccttacaaagtccgtgatgtactgaaggaataagttcactactttagattcttcagcgtcaaaaaaaaaaaaactactttagattccttagttcgtagccggtctgaaattacgcgtctctcaactttttaaaacaaatgcaaataaagtttcaaggtggtttagatgacggtttcggctaacatgacgcttacgtggttggcttgacttgatcctcgtcctatgtggcggtgacgtggcattagaagaaaaattaaaatgtagggctcacatgtcaccaaataaagataaagaaatagtggaacccacctatcaataggtcccacactcctctccatctccagcgaacaacgacgcttcaacacctcctcccccttctctcttctgtccctcctggccttctctcctcctccccgagctctcttgccagccggctgccgccgttgatgtccatagtcggtggtggatccagaaaattagttcgttggtatcgtaacatgtttagcagtgttatagtgtgttaactatatttagattataagttataatatatagataaacagtctaagtatatttttttttctgaaagtcgcctgacaccagtccatacgcatgtcactgaaattgggcttggagctcagttacagggctcgcagttcatcggcaaccagattagcaatcttcaggatttcactgacagagaacatcaatactattttttttattatattatgtatgggctagtatatatgcattgaaatttgacagtgaggcaaccaatggaatgcttcctttcaagaaaagaaaagggattgcaacctacagggaatctcagtcatgagagcgagtcgatcttaatgcatgcggcatgccaaaacaaagcggatttttgccgaccattatattcagctccacaaagataaatggaaattaatcctattatatcataacaactaattcattgctgatcttaaccatgccctccgaggaatttggcgtgtgctttgggctaatttggcgaggtaatacggtagtatagcacggttatagccaagctgacatgcatggcgtccttccagtcgccggctggcatcaccggcttgtgccgaatcattagcattgctgtgtctttcgtgcatgtggtgttggatcatcttattatggcatgccaatggcagtgatcgcactgttctctactgggcttacgccatgagcctcgatcgtgctcctacaatataat

SEQ ID NO: 74816 - DNA, 1177 bp, Oryza sativa
aagaaatagtggggatagtgcatgcatcaagtttgatgctagagtaaatatagtatgagagagttattaacttttcttggtcttagtgtacctatgaaatatgtagatcaatttggaatggagggagtactgagctaatataaacaataatgtcaaatctgatatccagaacaatccaaaaaatctgactaaagcagccatcaagctcaagccacagttgtaatgaaacaagcaattgaaaatgtaaacatacaaagggaactcttgaggacaaatgccacatatacctgtgataaagaatcctctgcccacgagacacctgatttataatagctctggaggcataagaacaggacagttgcatatatatgtgactcaaatttgctagcagaagaatcttgatcatagtggtgaacgagatcctgcaacagtttagttcattagttcctgatgtaacagtacttatgctataacatttgagtgcttgcagacatgaattctcttataccagatttggaccagagatggtagatctctttccgaccagcaattgtttctctatgtactgtgccattatccgcccagctaaaactatatcagctggcaaaacagctgcccaacaggcacctccacattcatgcctatgttcagcaatttgtttagagtctggagtcttgctctttgtagaagttacactcaattttgcaatatccaccacattattgttagattctagatgagtattttgattacaagacatttgtcctatagccttctcctggcacctgtttgaacagtaaatgggtattgtacatgaagggcagactacgacatctgctggagcttcactaaagcaatagtggcagtgagtatcccggcaagatttcatgataatctgcatacaactgtacaagtaagaggcatatagaacttcagttcaagattacaatagttgactgattatttaacaatgctcatagagataagctactgccctggcataataaaacagtaaaaatatactataacttatcaaatttcatatttgactaggacaaagatctaatgaaactcagtatagctttaggtggcacgtaaaaaactcatttggcataaacaattgaggagatgattcttgatcataccacagcaagaggatcctcagcatgaatcagtg

SEQ ID NO: 74817 - DNA, 18872 bp, Oryza sativa
tatatatatatatatatatatatatatatatatatatatatatatatatacatatatatacatacatatacatacatacatatatatatatacatatatacatacatatatacatatatatatatatgtgtgtgtgtgtgtatacatatacatatacatatacatatacatacatacatacatacatacatatacatatacatacatacatacatacatacatacatacatacatacatacatacatacatacatacatacatacatacatacatacatacatacatacatacatacatacatacatacatatacatacatacatacatatacatatatacatacatacatacatatacatatatacatacatacatatacatatatatattgtagagagtgggaactgactaaagaggctcactgttaggttggtggtgctggtggccagtggccaccaccactaactctttttaatctagtatggataatcagtgctgacatggtttctatttcttgaaggggtaaagtgtattcctatgtgtttatatggcgagcgtggtcagtttatatatatacatttgcagttatattttttctattaaaaactctactttttgcatatttttctcttatttgagaagagtcccgtcaaccaattagatcttatatgaatttattattcagagcaatttactggctttagttctggggccaacttcaaaggagtgaaaaagacacggaaatcatatatgttgcatgctagattttaatcaataatcatgtagtttttgctaactttaaatagagatttagtaataaattgaactttgaataagctactatttttctttggttgatatggccgtcaggccatgtcgtcttttcatctatctttatttatttctattaggctttgagccaaaaaatataatttataataaaatattgcagtttcagttggagtaaacaccgagtttaatattcactattaaaataaacaactaaatcctactatttaaatcaggttacttcatgatcaccatggacccacttgttagtgagaccaatgataaaaaaaaaatcaaagtgacttaaaaccagaggatccacatcctcgacgttaaacttctgttgctgaactgcatgcttaccactgttttgctctcacacgcatcaaatgcacgcaaggcgcatgcatgcaaaagagcgttacgtgcgcgctcagcctttgtcgcgcgcgcgcggggatcggtcgtcagatcacatgatcagctagcaaaatctgccgccaattgcatgttggttgtggctaagctacctgttcttaattagacaagaacaaaatggagggacaaaaagggtgtcatgtgttcatctacagctagatcgagccaattatgcaaagcacgcccgatcgatgcatatggatcccagctagcttagctagtacgtgccgtgtgcgaccacactcctcattttctttgttggaattgctaagccatcaaattcgacggaaatatatgagcaaaatctggtaaattttcaaccttcggatctactttttgcgattcatcctccaagaagttttttctaagaaattgaacaggtttcgctaaaattcgaacaagttagtgccaaattcaatagaatatgaaattcaatagactatgggatttcttttgcctgtaaaaatatcctaccggaacccaaaatggtaaacgtggaaatttgtgaatctcgtaaatttagttacaaaattgtaaacccggttcgaaattgaagcgaaagttggagaaacaccagtgatgtggtggtgaagtcgtgagtgtatgactccacacccacccgaatttatattctagttcctaggaatcttacacatatgtagctgggcttctaatagaattttactaagatcagatatgtgccgcaggttttcatctcctagagtgtgtgttaggggagtgtattcgtgacggtgtaagtgtggtgttacgtgtacagtgatcaacagtgaaaacctagaaaaaacttatcgagggtccactacatactaattatgtagttgttggttggtatactaactaaactaatatagtataaaataaactaggattgaataatttacctggtgtcctgtgatccgggtagtagtgatatgtgtgcgtgtgcctttgttgtgtaatcgaaaaaactaaaagaaaaaaaattgaagcgaaagttagctagctaggagatcgatagatagtgcaaattatatatgtagtgaaaacttaaaaactatcgttaaattgaaaaatgatcgctttagactcgcgcattaatttttggatccaacggtattttcccacgttcgagagaggtacgttttcttaccgcgcggtagcgtacgtacagcgtgagagcgcgcggccgttcccctgagttgcgaggccctgactggtccacgtgaacgcattcatgcgctgcgcgggctggctgcgccggcgcgtcggctccagccgcgcgcgcgcgcgcggcggggctttgctgctgtgtttgtcagccaatggggtcgtcgacgtcgcgcgcccacaggtgacgcctccgctggcgctggcgccatatgggcgcgcatggccaatgtcccccatgccatgcatgcgcacctgcgcggcgcgcgcgctcctggcacctagggggatctatcggtcgccacagctagcggcacagatcaggctatgcgtacgctttgcagtgcgatcgatgcatgggccgcgcggccggcgatcgatatcggtcgcctggcttgctttgctttaggctggtcctgcatgcagtgcatgcatgcatccatgcaatgcatatggtggtcggtcgtcggcaccacgtacagctgcatgcaggatggatggatggatgcacggatgatggatccaattacctgtagattctcatcatggagacaagagtacacagtgccagcatggatgagtaaaactaccgtactcataataagcagattctgtaacgggaacttcttcaagacgtcgtcatccttctgagacagacttcacgtaagaggatctcaatctatggatcgatccacattcaccacaagaaatcaatgctgtagatttaacatgttagccttgatagcaagttggtggcgcgcgctgatgagtacttgcaggcataggcaccactgcacgcctctactacgcagggttgggagttgggagtaggcagctagtgataggttggacctggtttttatccggccggccagtttttgcaagcagagccatgacccatgagaggagaggtcctcgtacaccgtacacacgtgggagtgcttctgtgctgcgcggtggaccagcgtgtgcccatgcattgcattgcccgagacaggtcaccgcctatccgactatagctatcccgctttctcgctctctcatcaccgaccttttcgttgctctccatcagtagcggggccaaagaaaaagaaaaactaaaaataaactgccgcaaatgttttactccctccgtcccataatatttagcattttagattatttagtacagggacggagctagaacaaaaccaagcaggttccactcgcttactttactttggtttgaatcaaatttagcttgatatgggtgcctaaatttaaattaacgggatatatatatatggtgaaaatagataaactataggtaaaaattcttttgaaccgggttcctagacacccccctagctatactagctccgtccctgatttagtatagattaaagtttaataaaaaaactataatatctcttattgaataatgtatgatgggaagttgaatgatggatgagggtgaaatataatgtgaaaatttttacatggaaaaaaattgataggacaactagctatttcatagtgtaactattttgtataaaatttgaagagtaaattgcatattgggtcactattttttaccactctttcagcttggactagggatatatctacattttcatattggaccaggtaaatttacaaaagtttcaccttggggctgttctcacacctacagctccctctctcctctttgtgctctctcactctctctattccctcatcggatgctgggtgggctcaagatgcagtgtagcatgaagctgtcggtcgagctcgacttaagtgaggcaccagagctatttggactaaggtcaagcgttgagttgggctcaaggttgagcgcggcactgacgacagcgcgacagtgttcaaggtcatggtcaaacgcgtagtgacgccagtgtggcttggtggacgcttccatccaatgccgatgctgatccattcattcaccgacgaactaaccatccattcatttgtctcggacacattgatctccatgttgttgggtacatgtcaggcttgctggtcaccttcctaatggagaggatcagccgatcaagccgtttgctagccgggcgccaggttcgtcacattcctaatggggcagccagtgcaattcggtgatgattaatttggaatatggagaataggaaggagagctggaggtagaagaaccagcccaaagtgaagcaatgggtaaacataagtggtccaaagtgaaaatatttgtttacccctagtccaacttgcaacaatggtaaaaaaaagaggtccaagatgcaattcacttaaatttgaataataaagagataagtattttggaacaggggtaataagtgaaaaactttcgaataactctagtatattatagttgtaatataattttatcataactatattataacttataatataacttgtatagaaatattaaaaataagtttaattttttatcaagtatacatatcaattatgttgtaattatattatagttataactataatgtagtgtaattatattgaaaaatattttcacgtagatatgaatttatctggagcagagatcagtcgtctcctctagttcgtggaaggctcgaagcccaagttcgttgatcaagcccgaagattttactagaacatgtctttcaacatgccgatcgacccacctcttttctcaacccacctctctcattttccacgcacacgctttttaaaatactaaacggtatgatttatgcaagaactttctatataaaagttgttaaaaaaaaccatattaatctattttaaaaaaaattaatacttaattaatcatgtaataaaacagtgctaggaaggagggtttccaaccccctttcccgaacacagcacagcccggtcttcgaacgagcaaatctttgacatgggagcaagtctacgaccgaggtgtaaatttgtctcacgtatactccatatacgaatggacgcaggctttcgaatctcaagtgctgctcgaccaaagaaagtgagagagcttggcccacttccggacgagaaacctagcatcattttagatcacattatgtgccacttgccctttgaacgcactagctcttccttaattaaggatatatatgtaggtgaagaaatgcatttcttccgctattttgtatgtgacccattctcctaataattgttattgataacatctttattggtattataagataatttctctaccagcagtggcgtgcccacatataacttaccggtgtcacaggacaccgggtaaaattgttaaattctaactaatttatgctattttgattagtatactagtgaataattagataactactatatagtgtacgctgggtaatttttgttctaggttcgccactatccaccagtgaatgtaacttgagctaagatagtttcacgacaccgctcgtatagtagccatcgatagacccaaggctctataacctcgggcaattgcctagccacgatagcacgtggcaaagagaggagacacatcgctcaatggcttagaaagttggttctcgtctgacctttacaaaattttttgccccactactaaaagtatcgtggtgattggatatactaaaagcaatgacattcgcaccattaggaatagtgataggaaccactccaccctcttgtgacgtggtaatatttactctccctccgtttcaaaatcactattaagaaaaccgttttttaagacgactaaaaatcatttttgccgggggggaggggggcggcccgcctgtacacataagcctgcctgcaaaattcgcaggctgcatctccatcttcgcaggcgccataggcacctgcctgcaaaaatattttgcgcgaacaaaaaaaaatcgccaccacccccggccacccccacccacctctggccacgttgccgccgcaacccacccacctccggccggatctatggttagggttttgggatggagaaggagagaaagggaggggaggccattgccgccactgcctggagccaccgtcctcccccctccctccagccggatctgggaggagagaggggagtcgtcgctgccaccgccctcccccctgcccccttcatccggatgaatctgggagggaggggagggcagccgccaccgtagccggggagagaaggaaggagaggtgggaggagaggggaggcgaggggaggggagcgcggatgggagggatgcaaggaggagttaagggagagggacttaggtgactttttactgagtaggtggcgatttttatgatgcttaatctttttggtatttttgcaggcaagagatccgcatgtaaaaatagattttcgtaggtaaatgatgatcttgtccatggttgtcatttttgtaggcgtccatttagcttccagagggttacccacctggaaaataaataccatcctctgaaaaaatggtttttctggtagtgaatatatggtatattttattttgttaggataaggctttgactaataattgcttccctaatacttgtacaaaaagtataatcatacaaaaagaagatgaacctaataacatcaattttacttcacaaaaattttattgtaatagagtaattattggtcaatatattttttaaaacaaaataaaatatatatatatcctatatttcaaaatagatggagtacctgatatactgttttgctcaccgaataaaaacatgtacataatatcactaccacataacacctaaaagttgacagttgggaaacctccttaggtgtcggtctttccaaccggcaccatgtaagcggcactgataagtgcgccgacaccaaagccattttgaaaaccggcacctctgagaggttcgcgagccaaaaaaaattgctcaatgcaccggcttgaatcgagccgatgcatcgagctcatccaccccgcatcaatcaatcccaaattaaacaacatcacaggaaacattgaaaaacattacagaaatctttcactaaaacattacagaagaacatctaaataattacagaagaacatcacaggagggagggcgccgccgggccaccacctcctcctgccgccaggtagccaccgcctcccgccgctgggccgccaccacctcccctcccatcgccggatctggcggagggaaaggcgtcgccgccgcctcccctctcgctgccggatctggcggaggggaaggcgccgcaatcgggccgctgacgcctccgccggatccagcctgcgggagttgtcggcgagggagaagagagggggaggggacagggaggagagggagtgagagggtgcgccgttgctgatgcctcaggaaaggaggacgaggaggaagggaggagatggggacgacggagaggggaggaggagacggacggtggagaggggaggagtcgaggagatggccgagagcaagagagccgagcggggctcggtgggagagagaagcgaaagggaaaggataagatcgatggttgccttatctcttgcagtggaccccaccagctcggctcggctgtttagctggctcggcttgattcataggtgcccgtttttttaaagaaaacgacacctataatatattaaatgtgcagtgtcggttcttatttagaatcggtacctataattgcttaaaggtgccggtttttcgcgatttggctataggtgccagttttagcaccgacacctattttatgttttgtagtagtgtatgcatcttatacattaacttatatctgttttaaattatatatagtactggccggttggtgcgaaacgacctgagcccctgaactatcacagatgcaccctgacccaattgatcataaaacaagccactctcttaaatatataaaaaaggatactaggaaataaacaaagcatttctgctcatcacaatcaactctcgacggcggaactctaaagaaaacaattctctgattgcttgcctcattgactgcactagctcatatatgagcacttaaaaaatgcaacattcattctaaaataagtttatttttatacatcccacgcatatcaatataatatatttttatcaaattccaatacaactatttttactttatttactcttaatgtatttattcttttactttggtaaactctaacataataattacattaaaaataagcttatttgaaataaacatgagaaacctaaaaataaacttatcctagaccagatggagtaccagcgttgatctttctgctttacaaaatactccatgggccccacacgcaccagccgagaaggggaggggggcaacggcatacagcaagaatgtggaatgaatgcgagaaaccgcaatacctaccgatttgacacgccacttaattaaggagagccgcattaactgagacagactttccctttgcatttgccgccgtgtttagttctaaaatatttcttcaaaattctaacttctttatcatatcaaaaacttttctacacacataaactttttaaatttttcatcatatcgttttaattttaaccaaacttacaaatttaacgtgcactaaacacaggcattcgcatccatccatgcatgaaaccagccgctctgttcctgcatgaaaccagccgctctgttctgctctgttctggtactgtgtgctctgggcccacctggctagccaccccctctgctggctgcctaggaacaacgggaaaagctatcccttgtgtctccctgtctgtcgccgggggcaggcatgtgatcacgtacacgcatgcccacctgccggatccatcagtttttagctacccacagccagctatatgctctcccctttccagaataagtttatttttaccttttcacctatatgctaagattaatttatttttaaataaccattgcatatcaaagtttacaaaagtaagatatatataaatttattgaaatttgagaaagtaaagatatcttgatatttttattttatattgatatgtgtgggataagtgaaaaataaatttattttagacggagagagtaggtagcccttctctctcttaggctgccctctctgggtgatcactgttttctccttgcctttccctttgttactgttgcatataaaagatcatcaatgtttaaagaattggagctactgtagtcggttgatccggaaatctagaaattaccatgttacttcaaggacgaagaaaataaagacatgttcgacgatgggtttaaattacaatggtattagattagatcattttacccggaagatactccctttgtccttaaataatttagtcaaaaacatcttatgtatgaaagagtttaaaaaaactattatgtcctttatatatggaaagaaaacgaggaagatgaggttttactattggtgtacaatgactaaaaatgagacggaaaatatatagtagtattttagaggtacactaatatagtacgccaatagtattttagtctaagaatttgctctaaaactaaaaagttttaggtaaaaattcttatactaaaaccacactttttttgtaatgggtggagtattaatttgtttggaatgtgggtggtaagtggatagcatgttatgaaagatattctagattagtgttggtgaacataaagctttccatgtatgggtaaaaatgggaaattgaacattgatttccatgtgttgccaaatatttgtaaattactttttttttgtttaaatcatcacttaaagaaaactgagagtgatgtggcgcatctccggcctttctggccttgtaatatatatataaagatagaaaacaaatttgcctggaacaataagcccttgtgtgaaagcaactatgtttgatgaaaactagaaaaataagcacatagtatctaacctaacctagtggtactactctacgcgaggtgatagagctagtacgtaccagctagctagccaatcacgatatacaattatacatccgtatgtaaatgattcacaattggattggttaaaattttaatgttaatttatataatttcaaagtattaaatattaattttacgtacaaataatgtgattttggactcgtgatgacttttttatattaatgattaattaataatcaagtgtcgaacacgttttgttaaaaactaagcatatgaccaaactacggtttccagtgtgttcttttctcctttattaactctactttttcatcatccacccacccacaaggacgtttttaggaaaaaaaatttacaaaaactgttttaaaaatcatattacttttttaaagttcttttagctaatatttatttaataatgtactaatctatcgctctattttacagtatttagaaaaagatttctcgaccattcaaaaatacagcctaaatgattcatcttgggcatggtgtgaacatgttccacgattagtttgaaacgtgtatggaaagattgctttcctaaatatctattcaacaaaatcagccagattaaactgcacgaattacgtacgcccaattaattacatgccaaatgaagcaactgcacgccggagagatgacatatatagcaccatgtaaacctgccatatgccaccctcttgcagcccaacccaacccaataaggatataaaaccactcgcggttttgcacagctagcgcggcgcagtgtgtaaccgtccagggtgacacaattgacttataaatcacgcttttaattaattaattttcttcctaaacatatccgctaatcccccatcccaggtggaatataaacccccgcaagagggagaagaagaagaagggcgaggtgagcgaggcgagactcgagagagaggagaagatccagaaatcgcaagctgcacgctatagctaggtagctatctccggggaaagagagagtaggctgccatggagagcttcttcgtcttcttcacggcggcggcgttgccggtggtggtggcggcggcggtgatcgccgggctgtgcattacggcggcgtggctggcgaggccgcggcgcgtggcggaggtgttccggaggcaggggatcgacggcccgccgccgtcgtcgttcctggcggggaacctcccggagatgaaggcgagggtggccgccgcggcgtcggcggcggcgccaacggcggacggggaggagaccgcctccgccggcggcggcggcggtggccgggacttcgagaaggacgggttcgacgactactgcaccaggatcttcccttacttccacaagtggaggaaagcctacggtacgtgtacacaagcctctctcctctctactgctcgatttcacatcactagctacatgcatgatgcttgcttgctttgcctgttaattactccgctcatgtgtgcttaattagcttaattaattcacactccggttaatcaagtcatgcaaaacccacaattaatcagctatcaattgagatgagtatataccagaatatatatacttacagtaaatttaataaaaaaataaaaaaaagaaaagaaaagctctctcgatctctctgtgacgatgatacaagaaatttgtggttgccctagtaacaagttgactagagtataaaagctgctaaaatgtcaagagctctccatataaaaaagaacagtgggggagaataattaatactgtcccaaacagcgagaggaagagagggggcaaacgagaaaagagagaataaacaaaattaatgcaggatggaaaccgtggttgggacgaactactcggtttgcttccagtcaaccgtcctgcatcattaagctatggattaataattaattaactgcagtatataaatatatatactcccccacatatattaatcggtcgttggtccaattagacaacagcaaagccatgcctaggtacctgtctaggtaggctatgactgtagtacactcgtactactcacttaatagcacattagtgctcttattttgcgaattaatgaaactttaatcaataataactatatataactataatatatttagtataatttaacaatatatctattcagcgtgctatcgtttcttcagcctatcaatcaacttaaaaaacttagtgttaaattgattttggtgttttcttatcgtaatttttcttcagttttggattgttttttaagttgctaacaattttagttaacaaagctatttggaaggagaggaataatgcatccatgacaaaagtatatgcttcataataattttcatataccagatcttgcccctggtggtgacgtgttaccaaataccgactggaattaatttcttctctctttctttttctctctgccggtgcaatgaggcgacatttttgagttataactgtgcgtatgaatgcatgtattaattgctgtttgctgaggttaataggctagcaataccgttgttttgggggaccccgcagtttgacctagtagagtttatcatggacgcagactgcccctacctgttcttcttcacggacagcatgattaattagctatactagtggtagtactcgatgtcattaataattggtctctccgtacgtgaataattatcgatttttgactttgacaagtactccctccgtacttgttaaggaagtcgttttagacagcaacacggtctccaaaacacaactttaacttcttatttctataaaaatatttattgaaaagtgatatatgtatacttttatgaaatattttttaagacaaatatattcatataatttttacattttaaaacttaatggaaagttacttttccaagatttgactcaaacattgttctaaacgatttcctttatgagtacggaaaaagtatgttttttcactgttcttatgaagtgtacatggaaagtgatcgaatagctctgagcagtactctaggtagggaattacttttagttgcgtacaaatctaacaattaattaatatgccatttttagtgaacataattgtatattttctccgtttcacaatgtaagacattctagcattttccacatgcatattaatgttaatatgtctagattcattaacatcaatataaatataagaaatgctagaatgacttacattataaaacggaggaagtaatttatgctagaatgacttacattataaaacggaggaagtaatttagtacatcaccttcgtcgattattacgaaaacatccatcatatcgatcgatatctgtgtatttgctactccagaaaaatattttctgagaccgacccacagatgcatatatatgcacattattgtggcggttttcctttctttttagatcaatcggtggcctgacggccggcccagcttcgattgaaattaagctgaataattattgtggccgtcatgtgctaatcacccatataattaggcgtggttagaacctgactaagctatttaagccggtcagttaggctttcccaaaacggccatcaggccatgcatgttgccattagctgtccgagcacgccggccaaagctcaaccctcgtgatcacatcaactcgatctccccgatgcttatccctttttgcaagcaaccggtatgtggtgcttagataattaatgcaagaattaacagtgtacctcctatcaatttgccgttagctatgcatgtaatggattagaaattctatatgcatgttttcgtctaacagagtttgatcagcagcagtacttagctaactaattattctgtaatttatataactactataagctagagtttaagcagagtatgtaagtatgatattttaactaatttagttcttgtcatatggcactgtagttgaaaccataaaccgatcaattaataggacaaatattcaacctggttgcctcactgcatgcgttgttttagtttgacaaatgcatgcatgtgtatgatattttatttgcttggcccttaataagtatattatgttgaagtcatgcatcttgacacagaaacttggagcaaaaactatataatatatttcaagaaccaaagggcctgaatactagtacttgcctacatcgatcacatgatgctagtgtcaatcttatttaaggtttttatttcttctttaatgtcaaaatggctattgtttaactatctaaaaacaccaataattagaagactcccactagaccatctcatgatgcattgcacgtaggatcgatatatatggcaacattaattattttacttgaacatctaatcgcgttcgctattattcaacttatgttacatgttctcccctaatttaagcaaaggccggtttgaccaacgggaaacaaataattaaattgatcttccaggcccagtacttatattaattacctagtcattaactacattttctccatatttaatttgaatgcttcgttctgaaatatttaaaggccattaacactaacacggcacacaagaaattaatttaaatatttaatttggctagcatgtatacatatatatgttgatatgcatggatatatatatatatatatatatatatatatatatatatatgtatatatatatatatgtatatatatgtatatatgtatgtatatgtatatgtatatgtatatgtgtgtgtgtgtgtgtgtgtgtgacaatagctaactttagatatgtttttttttcgatgatacatggtcccggcctctgcatcacaaatgcacacatccaacgaatatcgtacaaataataataaaaaaagtgatgggacaaaactcccgactcctacataagacttaggactagtgagctaagggtgtgtttagttcaccaaaattggaaatttgattgaaattagaatgatgtgacggaaaagttgaaagtttgtgtgtgtaggaaagttttgatgtgatggaaaatttggaagtttgaagaaaaagtttagaactaaactcggcctaactgaaaacaaatcaattgatatttgttttcagttatgccgagtttagtttgacaaaattaaacgaaaccatacaatatataattacaaatcaataattaattcctaatgctgcttgatgctactagcttctctcctacacagtgccattgactaggtaattgctcctaaccctagctagctaagcatgcagctcgatcgaatcgatcgagcatgaaagcaacaggtcgatcgatagatggtaagccatgacgatcaatatgatcatatcatgcatgcatgacactgtagagtgtgtactacgtactaccaccactccaccaaccatgcatgcattcctcccccctctctcttgcaccttttaaagctagctaggacgtgtggggacttcaatatatttcttgtgcattgtctctcctacaaggattcacatggagatgtgcatatgcatggggttacaccaattaaaagtgcagcccacactctatggattgaaggtgctagctagatctctgtactctatccgtcccaaaatataagcatttttagttataaatccagatagatagttatccagattcgtagctaaaagttattatattttaggatggaggtaatatagtttagatggtggaaattaagtctagtagctatggggaaaaatggcaaaaataaaattacagtatggggttgtactggaaaattttcatttgaatatatctcttcacaaatatgtaagcctaaatttaatctaaatatatatgggcacaaatgaattaaaaaacatattttctatgaacatatatagcaggaataatatgcattcctcgattttattcccttcaagtgttcatatagtacgttaaaagtttgggttaaaaattttaaataatttctttagttattttgaaatggtatgaatgaaataagagcgtatacccttaagtcataaaagatcatccagattgaataaaaaaacaaagttaagataattaagtagatgaatgtaaatgtgcatatacatatcttgtctttctgttgactagttgtctgttcagaaattatatggcggaaaccctaactgaggtgaaaattcatgtgtaccaagacaaaaaaagaaagttctgaaatcacacaaacaatctcataagtagataagatgatagtgaacaaccatgtaaagatcttttccaaatttaactttcatttgtcagatataaaatgacaaattttgaatcagaaaatattttttttgtttgaaatttaccctcgtttcttgatctgaacagtaccactagatacacctagctacatgtatggtcgattgtgataggctcacacacatgctatagcttgatggttgtcatggtggttgcctagttggcaaaagttcgatgtccagctgtgctactatcatgataattggcagcagcctagctagctagttcaaggggacaatattacactggctttaataatttcctcgtcaccaccttttacctcaaaaacatattcttgaaaaaatgaagaatatgatcatttcaccaaaaatcatggactggccatgattaaccaactcattttggatggttttgttggattcctcaaaccagacacatcattctctgtgtcgagaatggagatgacgtgactagcttttatgactttagaaacatactccctccgtctcaaaaaataaactttaggtttctgtgtccaatgtttgatcgtatatcttatttgaaaaaaatatgaaaaaaattaaaaagacaaatcacgcataaagtattaatcatattttatcatctaacaataattcttttcgtgcttgtgattgtgagtattggaattcttttaatatatgctgaatatactaatgagcataaagtataacagactaatcaagtatgtgagttattcaatccttggcaatttccaatacaaatacagacacactatgtatggaacttttttatatatagtctattaaacaatatatctttgagccgtctgaaaccaaattatatgatatttttttagttaatcataccaagatcattaattgagtaggaatataagacttcaagggggaatcaacaatattaattgtttctgagaacaattattcaaagcaattcataataaaagcatatttattttaggagtgggtacacacactatctagcttgtaccatatataagtcaatgaccacgatatatggctagccacctccctccatcatgaaataaattaacctcatacgaatttagatatagaatatgtccagatttattgattaaatcctagattgatttattttaggacgaagagattacctgcctgcctgcactaaccatctgcgacgccgacgtgtcatccatcggtcgacaaaacgtacgcaggccaacacatgcatacgtacacacaattgcccatttgcaccccgctccccatgtccacgtcagacggcgacacgtacacattaacacatgtacacgtcgttttcacgtacgagctaagcaaatccaacgtacagaaaatagttaatttacccggttgccaactgggacacgtacgccggccacgtcacaggtctacgtggcgcggtgtgggccgggctaggagggttaaaagcccacgcttgtgtgctttggtcaactcgtgcacttattactctgaagagttattagccggttcgatgtgtcgcgattactgttgtaattaagtctgtctctgtggcgatatgtacgttgacgatgattaaggtggtgtttggatctagagacttaactttagtctctgtatttagacactaatttaaagtattaaatatagactaattacaaaactaattacataaataaaaacttatttgcgagataattttttttaagcctaattaatccataattagaaaatatttaatgtagcatcacataggataatcatgggttaattaggctcaatagaatcgtctcgcgaattagtctaagattatggatagtttttattaatagtctacgtttaatatatataattagtgtccaaacatccgataagatagagacttaaaagttttaggtggtgtttagatctagggacttaactttagtccctatatttagacactaatttagagtattaaatatagactacttacaaaactaattacataaataaaagctaattcgcgagataatttttttaagcctaattaatatataattagagaatgtttactgtagcatcacatatgctaatcatggattaattaggctcaatagattcgtctcgcgaattagttcaagattatggatgggttttattaataatctacgtttaatatttataattagtgtccaaacatccgatatgatagggacttaaaagttttaatctcatctaaatatggttttagtctcatctaaacagggtctaatagcagaaagttacgtgagattcgtatactcgtacgtacgtatttgcatcggaattttcaaaatcctagactctttctagtactggtggtacagtttggcaaatctgg

SEQ ID NO: 74818 - DNA, 950 bp, Oryza sativa
cataaacaccggttgacatagtcaaccacctcagtgaagctctgtcgtaaattaacctcattcaccatggatggatcaaggacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaaacctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcaccgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaagtgtcctttactgtatcgatggacaccttggcatacccagctagcaggtctgcgccgtggaccttgtc

SEQ ID NO: 74819 - DNA, 2593 bp, Oryza sativa
tcagggatggctgaaaacggggcagggacattcgctgctgcagcggctgcatcttcttgtgcccatattgcctccttgccgatgtaccctgcggtgcccagccgatgcgggtgctcattccgctgttgcagtaggcgatgtgcctcgcttgattccctaaactcttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctatagattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcataaattacaatcatttgcatgaagggataaaaagaggaaatcagctactaggaggaaaaagcaacccaaagaaaatagaacaagtgtagttcatctgttcttatccataaaatagaacaagtgtagttcatctgttcttatccataaagaaaagagcaagtccaggaaattagagcagtagcaacagcatggccatataatagcagcaataagagcagtagcagggccatataacagcagtaggggtatatatgccacaggggcagcaacagcagggggcgattcacataaacagcaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaagagagcaagtgcacaaaatctgttcttatgcataaaaaaagaacaagtgtagaggtatataaccactctacactggccatttaataaggaacaagtgaacaagtggtggggcaaaaaaatgaacaagtgtagataatctgttcttattgagcaattcatcactggccatttaacaaggaacacattgggcagcagaagcaggggcaaagatactccacaggggcagcaacaacataaaacaaggaacaggtgtattaacaagtagcccacaataacagcagtagcaggggtgtagataaaaaaggagacagtactactaacttcatgtaaacagcaattcatccattcaattcaagcaagtctagataataaacagcccacaatcattgtggcagcagcagcaagggtatataaatcatgtatataaacaacaattcatacaattgacctattcatagacaacaagggtatataaatcaacaagtgtagataatctgttcttatgcagaaaaaaagaacaagtgtagataatctgttcttatgcattaaaaaaagatcaagtttagaggtatttctgttcttgagcattcatcacagcccaccattaatttatcaagcagaggcaagtgtagataataaaacagcccacaataatttatgtggcagcagcagcaagggtatataaatcatgtatataaacaacaattcatgcaattcacctattcatagacagcaagggtatataaatcatgtatataaacaacaattcatgcaattcacctattcatagacaacaagggtatataaatcaacaagtgtaggtaatctgcggccaatctatcaattctttcatttgaactaaatttcaaaccctaaacctaataaagttccttaattatcaaagaatgacagaaaacaaaatgcatggagaattttggtgtctaggtccggtccgtccatggactacactgaccaatccaccaaaaattccccatgcattttgtattctgtgatggtttgataacctcagaactaccttaaatctacagccaatctatc

SEQ ID NO: 74820 - DNA, 9665 bp, Oryza sativa
gcttgactacatgtacacatccacatccttaccatattcagtggttaaacgattccggaagagcaaaggtaacacaggtttgtagggtttcgttttccattggctcatatgcagattctgttgattgcgatgtggttcctatgcaagcttgttcacttttgctggggcgtctttgggaacatgataatgatgctacacatcatggtaggagtaataaatacacttttatgcataatgggaagaaaattactttgctacctttgacccctgctgaaattgtagaagctgataaagaacgagctgctagtttgaaagttgatgaatctgaaaatcagcaagtggctaaatctgtttttccacctaaaaaggataagctttcacctagttttaaggttgagggaattaagttgaagggtggtgttatgcttgcaacgaaatgtgacattggtgatatttcaaatgatgatatgtgctatttcttgatatgcaaaccagccttggtttctttagatgatattgctagttcgatacctcctgttgttactaaccttttgcaggagtatgaggatgtctttccagctgagatacccccaggattgccacccatgagagggatagagcatcaaattgatttgattccaggagcatcattgccaaaccgtgctgcttatcgaaccaacccagatgagactaaggaaattcagtggcaagttcaagacctttaggaccgcgggtatgtacgtcaaagccttagtccctgtccagttcctgtaattttggttcctaagaaagatggttcttggcgaatgtgtgttgattgtagagccattaataatattactatccgatattgtcatcctattcctaggttagacgacatgcttgatgagttgtgtggctatattattttcacaaagattgacttgcgtagtggctatcaccaaattagaatgaaacttggagatgaatggaaaacagcttttaaaactaaatttggtttgtatgagtggttagtaatgccttttggtttgactaatgcacctagtactttcatgagcttaatgaatgaggttttaaggccttttatggacgatttgtggtagtgactttgatgacatattgatttacagcaagtctttggatgaacacatggatcatttacgtgctgtttttaatgctctacgcgatgcacgtttgtttgctaaccttgaaaagtgcatcttttgcatggaacgagtctcttttcttggatatgttgttactccacagggaattgaggtggatgagtcgaaaattgaagccatcaggagttggtcggttccccaaaccatcacacaggtgaggagctttcttggtcttgcaggattctaccaccgtttcgtcaaagattttagtacttttgctgcaccattgaacgagttgacgaagaaaggcgtggtcttccattggggaaagacacaggagaagtcctttgacattttgaaggagaagcttacgcatgcacctttgctacaacttccaaactttggtaagacttttgagttagaatgtgatgctactggagttggcattggaggtgtgttgatgcaagatggtaagcctgttgcatactttagcgagaagttgcatggtcctattttgaattattccacatatgataaggaattgtatgctcttgtacgttccttagaaacgtggcgtcattatttttggcctaaagaatttgttattcactccgatcacgaatcgcttcaatatcttcgctctcaaaataatttgaatcgtaaacatgcaaaatgggttgaatttattgaatcttttccttatgttatcaaacacaagaaagggaaagataatgtgattgcagatgctttgtctaggcgctatactttcttatcccaacttgaatgtcggatttttggacttgaatcaattaaagaacaatatgcacttgatcctgattttaatgaagtgatgataaattgtaaagagggacgtacttggaacaaatttgtgatcaatggtgggtttgtttatagagctaaccgtctatgcattccagttggttccgttcgtcttttgttgatacaggaagcgcatggaggagagttgatgggacattttggagctaagaagacggaagatgttttggccatgtatttgtcacatcctgatttttgtttcaggatttataaattatttaatgaattattattagaatttatattaaatgttcattaatttacaagtgaagttaaatgtgggaaataaaattttctaaatataaagcatggatggatttaattttttattaaattctccatggttaattatactctctggaatattctcggatttttcggagctcaattcctaatttttaatcttacaaagagcatttcagtaattacccacatattaaattgatcattaaatggtctaattataattttgttaagtactttgagtgtccaagtattttcaggatttttcttgaaattatttgagcattggaagtatttttaacgattcaaagatcatttcattgattaatttaattggaaaagtaataataatcctcctcctcagcttgggccattttcggcccattccttcctttccttcctctctctttcgccggcccaacctgagccgcctcctctcctctcagccaagccggaaaagtctacttttcctccctgagctactgttcatcttccagctcaggcagatcccgagctagccgtgccgtgcacagtgccgccgtctcttccttctaaatctcgcctccccgttgctcctttttccaatttagttgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaactactccactgttttacttctcttaaaagttttgctaaatgctgcttttgcaaatgagcctatattatgccatcctttggtatccttgtgcacttgcatatttgctatgtggcttgttgagtatgtcatatgctcaccttgcaataatcaatcaacctcagttgaagaaaaaggatccagaaggagaagacgtttggcttatacccgagttgagctgcctgtgggagtggagccggagattcgctagattttattttccgctgcagttttcttcatggtgaggactaagtgcctcttaagtaagtatttagcgttttagttaatttgatgaatctgtatattaaattgtcagtttgtgtacctcggctgatttctggacgaggattttatgcacaaataagttcggaaattactagtgaatttctgggcgtgacatatttcttttggccaaggatgagaaaggatgttgacaggttcatggcacgttgcaccacttgtcagaaagctaagtctcatttgaatccacatggtttgtatatgcctcttcctgtaccttctattccttgggcagatatttctatggactttgttttgggattgtctagaactaagagggggagggatagtatttttgtagtggtggatcatttttctaagatggcacatttcataccatgtcataaaagtgatgatgctgttcatattgctgatctatttttccatgagattgttcgcttgcatggtatgccttctattgtttcagatcgtgatgcaaaattcttaagtcatttctggcgcacgctatggaacaagttgggtacaaagctattgttttctacaacatgtcacccacaaacagatggacaaacggaggtagtcaaccgcactttaggtaccatgttgagggctattttgaagaaaaatttgaagatgtgggaagaatgtttgcctcatatggagtttgcatacaatcgggcaacacattctactaccaaggtaagttcttttcaggtagtgtatggtttcaaccctcgtgctccaattgatatgttgcctttacctactagtgagagggttcataatgatgctaaggcacgcgctgaatttattttgaaaatgcatgagtcaaccaagttcaacattgaaaagatgactgaaaagtatagaattgctggtagtaaaagtaggcaagaggttaagcttgaaccgggtgatttagtttggttgcacttgagaaatgatagatttccggaattgagaaagtctaagttgatgcctcgtgctgatggcccttttaaaattgttgagaagattaatgataatgcatataaacttgagttgcctcccgagtttggggttagtcccacgtttaacatttcagatttgaagccatacttgggagaagagtatgagcttgagtcgaggacgacatcaattcaagagggggaggatgatgcggacatcactacctcggatacacacaacaatcctccaatggtcattcaaggaccgataacaagagctcgtgcgcgacaattaaatttagaggtgagttcgttcctatgttcttctttgtatgaattcgagaatagattgcaacctaatgattatattgtgcttaggaacaatggaggggacaaagagacacttggagaaggacttagagtcatggaggaccatcggggacgtccaagtcaaggtggaggcccaaaccaagtcgacgtcgggtgcaattcggagtccaggaccagtctgcactaaaacgggcgcccaggtcgcatacgtgctcagattggggcgttctttatatggatggaaagctaagaaggtaacctttcaaatggttttgctcccacatccaaattctttccgagtcaacaggaattgaccgaacaatttgacgtccaaaatctgtcccagtgctgcgtcaccgtatttgggcctttggcccgtgtatcgtgttggaacccattagggttgcatcgagaggggtttgcacgaccctaaactctatatatcagtacccgccatcatgtttaggtttttgggttttgcttagattaatctgtcgagaacagtttcgccgctagttcggtttgtaagaccccaactcgtgagcttaatcattcatctgcaattttggttgtttttctatctcgttcttctttgtgttcttcgattggcaaacagggattagccttctcggtgtggtcattcgcgtttcgacacgggtgataaccagaggagacgtggtgctgcaattgcggggctcaagagcgtgcgcgttcaagaagccggatcgatttgtgtggcgactccgcccaaatcgttgtttatcagaaccttttggaagatcgggaaccctagtgcacatcatatacttactccagaactaacgagtatatatatatactgattatgtctttttattggtacgcgcagtatatactactgcaacgagcgaatgagtatatactgttctttcacggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttcttttttttatcagtatatgcatttgttattatttgagtatatattgtatgcactacttgttctgtcagtatactgcatgtactaattgtcatgtttggtcggtatactgcatcgtcctcgctaaaggaggttatactgccttcttgtttgatcggtatatactatgtatactactttttttcactcagtatataaataagtatgtaccagtatttcttagataagtcgtatatttgctatccatggaagctggatgcatatgcttttcagttgaatagaataattaatatgcttttcacgtgcaaattcagatgtatgcctgaatcactggcaaagtatcggctgttgcattatgaataaacctaaattaatgaaataccctagaagggcactgaattctgaatggacattaccagaccaaagaaaaagatcaacgcagactttcggaaactaagaacaaaacataacgggatcacccctcgatgtggctcatcgaagaatctctgcatccccacagacagatctcggttaacatcgatgggatcacgctgaccgcacgccggagagaggtggacaagaatgtgtcttcctggattaacaccattagctaggaatcacggttcaatgccgacgacaatgctgtcgccgcacggccacacatgctgggctgttctgtcatcagcaccatctacgtccacgatacatgcatctcgcatttgcatgcaccaaacaaattcgatctgcatgcatgcattatcgatttgcaacgtagaaaaagcaaatcaagaaaatcggaagaaggaaggacttgcctgcagtatagtcgatgttccagttccggacgacgctcaacgtcgtcttgatcgtagcatgggcctgcatcgatgccgtcgccgcacggccacactgacttgcccgaagatcaacggcgtcgttgtctggtcatagctcttcggccagccagtcgcctgcggatagtcataccgaaggcattggtaatggaagacgccggcgtagacatcagcagatgccacgaccttcgaatagccgatgggtcgcgccgccgtcgccttcgaatcgctgatcgagatacctgcggatcgatctatcgattctgtttacaaccacccatgagattttaatacgagctattcaaaagggttccggttattacggaataattcagattatgaggatttttttcgtaactaaaaatcaaaacgggctcggtatctggatccgcttgctgacttggtcggtggtgttcgctgatggacggtggatggaaccgggagtacctactcctgggagtatagaatcattatatatatatatatatggggagactattctatacccccggtcgccgtcaagagcccaacccactaccccctctttttattgggctcaaaacccacctgctaccccagtcaaagcatggtcaaaggacggtcaaatcgctgccatgtcggtcaaacccgtgtgctaacttcctcccacatccacctatttgttgtccttgtctcgtacgaacggtgcagtaacatgacgaccactatgcagtaacactgtaccttacttgcagtaatactaataaaatatagttaaaatatagtcatgacggatctagttttgtagagctttttttttaaagcattacggtgcaaacggttcaaaaatataatatgtggtgtgagagatattattgtttaaagatgtgaattcaaaagatatcacttgcatttacattttactagttcaaagtgggtgataggtcctgtacctgtgtttggttgttaccacctcttattgcagtaatgctattaagaaattgcagtaacatgcagtgttactttaaaagttatagttgttactgcacacatacagtaacgccatgatggaatggtagtaacacacaataaaaagtagtaacaataatgatttagtattactacttatggagagataaatttcaaaataccaatcttcgagaagaaatagtagtaacacactcgattactgtaaaagcacataaactgttacaactctacaggacacaaagttccatagttgtaagaagctaattagaagacaaatatatatgttattacaaaactcataacaagttactatgttttagtagtaacattatcgtataagtatagtaacacgtcacgttactgcaaaacatataggatgttactgcacttttgatagtaacatcgtagtgaaattgtagtaaactagaaatcgaaaaaaaaatatatgagttaaaagtctacatgctaaccatatatttgttactgcacaaaagtgtaagtgttactg

SEQ ID NO: 74821 - DNA, 2814 bp, Oryza sativa
aacgtggagctaagaacacggtagaagctcaagatagagatgacaagttcatcatccccaagaggatgatggagctttagatgcctgagtggtggattcatagagccaagcaaataatctattttatctcctgcagtagcttgagctagtggcggccgatggaactggtggttgaggatgagaaagagaagggaaatggaggaataatattgaaaaatgtgacatttcactagcttaatggtactgttagaattttgagaagatgttatgttattaattggtaccttaaaaatccgtggtattatttgactacgatggaatctaatgttggaatttaatttgactttgagtaaaatctcttgtctccactcttcttgctctctttttgtgtttcttgctctagtccttgtggctcctgtaactctgtttctatgttgaaatctaggggtgaaattaggataaatgatcgcggggtcagtactaactagggtctatgttttcaaccaaacctggtcgaaaaccatgcaatctcgatgttccaacgtggaatggaagtagattctaagtaaaatttttaatagttttctaaaattcaaatttgaaacgataaattcaaccaaaattaataaaaatttatgaaattttggcaaaaaagtcatatctctatgttcagaatctaatattaaatcgaagaggtgaaccttgatgcaatctgggtttgttcagatctatctacaggttctaaacccttccctcccagcacacacaatggagcgaggattaacacatgattaattatcattaaaaaacttgaaaaaacaatagattaatatgttttaaagcaattttgtatagaaactattttgctagaacacttgagaggttgttggccactagccttatgcatggtctcaaatctcaaagactcaaataatgtatatgcatattcggctgtataatcataagttctagctaattttctctttgatgcttctagtatcgttcctagttgtcaattgggctttaacgcagcaatcaacaattaatgtcactgaggtcatagctggtaaaataaagaggatatgagaggttaaaagcgacaactttcaataccaagtgttcttaactctgtttttccctgattaagatacatgttttatttcggttttcattagatgcttttcaaacttctaaactgtgcatcgcgtgcgaaaaattttctatacataagttcctttaaaaaatatcagataaatccaatttcaagtttgtaataattaaaactcaaacaatcatatgctaatagctttctcatttttcgtgacctaacttcatcttcattttcagtaaaaacgaacacctaattttaattttctattaatgtgatactccctccgcccaaaataagtgtagttttgcactattcacgttcaacgtttaaccgttcgtcttatttgaaatttttttatgattagtatttttattgctattagatgataaaacatgaatagtattttttgtgtgactaaatattttcaaatttttcaaataagacagacggtcaaacgttgggcacggatatccacggctgcacttattttgggacggaggtagtactaagtttcaccttaattgtatctttcttttttttttcttatcctaacggtaacgggagttccaaacatggaaatgacaagttcatcatcatatccaagagcatgatggagctccacatgctagggtgaattccctggagctaagcgaactactaccttgtctctgataatagctcgtgctagtggccgctgactgagctggtggctgagtctgagaaagagggaagggggaagaataaagaggaaatatgtgacattccgttaggttaatggtatagttagaacttttgagaagatgttgtgttattaattggcatgttaaaaatttgtgatattatttgactccgatggaatcctcatgctattaataaaatttaattcctcaaaggaaaaaaaaaaccattctagtgtaataagatgaaacagcatttctttggccagcaacctcaaggttatttggagatctctatttgtcggaattagcgacaagggatagatagaggaagtgaaggtcaaatgctatgagattataaatcagacgagtgtaattgattaccacgagctagctaattgatggctgaccgtagaataaccctcttaaaagtggtatgcatttacatatgagccgtatcaattacaaagtgacggtagcacaaaaatgttgttaaaaaaaacagaggtgttgacgatttgtttttgaaaataaaccctctaaaacccttattattagaaagatcgaaaattttccccggccaaaagtaaacaatggttgacggagctcgtggctcctcaccgggagaccgcgcaggcccccctttgccggttcggccgggggcttagggtgagatctcaagctctctcggtatgtggaaagatcgtctgttagcaagaaaacgcgagactcggacgatgtatacaggttcgggccgctgagaagcgtaataccctactcctgtgttttggtggatctgtgtatgaatgagctacaagtgtgagctgacttctcccccgttctaagctcaccatctgggaaagaaccaaccaaccccccccttcatgggcaaggtcctccttttatatttcaaggggataccacatgcacccttctctttccaaactggactgttctttttctcttgaatgggcggagatcagcacggttgccgtccgaatgacgctccgatgggacagcccacac

SEQ ID NO: 74822 - DNA, 1491 bp, Oryza sativa
actccacctaagacttcttctccaaagcttctcttactgaaggggggaaagactgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctaaagctacacagtattactaatcaaggccgtgaacccacacgaacctgccttaacccaaggcctacgatgattcagaccgaactggcaacccgaccctcggtcccagctcgtcccaagccaacccatgccaaccattccacattttagttattaagcaggttttaagaatttaaaacactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaagacgcgacatagtttccaacccatcctagccatagacaagagtaccgacccaacccacctacggccggaacccccggacaggcaggcagaattgagcccctagcagcaggacaccagccctgtgccatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactaacaaaaccatgcaccccgagcccagcctaaaaccattttgagggttttgaatagagggggaggtgtgcattcaattccacaataatccaaccattccatagtgtccaagtgatatgaatattcccaaagtctagagttataaaaccacctaatgttgcctaattaatcagcgaagcatctacctaaattcatactagtggaaccatgaatagagtacccactagttggggttttatttattctagggtgaacaaggtaataataacaatagcaataataatgtcataacaaaggtaaataggcatggctaaataaagcagtgaaaacgcgggaatttaaataaagcgataatgcattaatttaaatcaaaataattttataaactgggattcaatatgctcaaggatgatgtgacttgccttgctaagagagaacggccttccgaaccttcggcgacgaccgcgaaccatgcttcgagaaccttcggaacgacagaagctacgcgaagcacacaagcaaagctaaaccctataaagaagcaataacaatacataaaaagaaagcacacggttctttaggttataacaaacattaggagacttgaa

SEQ ID NO: 74823 - DNA, 2629 bp, Oryza sativa
acattgttcctacaaatcaaaggggccctaaagatttcaatattgaaatgatgttggtaagttatcaatggacctccacgaccccttgaacgacccctagcagtaattgtatctgacatatctgcagtggcgtagctagctatgtggcactgtggtccatggaccatctaaaaatttgatcgagattaaaactgtagtatatgtgtgagttaatataataaaaattatatagtaggccacccatttaattgatctattacatatagatagaccacttttactctaaattctagctacgccactgcatatctggtacaataatattattatactcagaggttggtttagtttaggaaatattcccttttccgccatctcctataaattaataagcatgcacaactcgagccccacatctcctataaattagtaagcatgcgcaactcgagctccacatcacagctaataaaagctgcagctaacacgtactgttttgcatgcgcgcgcttagcttaattctcacgagctgatcgatcacaggttattcaattagttaagttcagctacttaattagctagctccattacactgcaagctaggcccagatcgatggcagcttggtccatggcgtctctgatgatcgtcgccgccatcttcctgctcagcctcacctcggcgagcgtcgtgcatggccggagcagcaggaggagcttcttctccagctacgacgagccgtgcatggagatgaggctgtacctccacgacatcatctacgactacagtaacagcacctccaactccacgtcggcggcggccaccaagccgacgccgctgagcaccgccgtgtccaaccccggctacttcttcggcgagatggtggtgttcaacgaccccatgacggaggggagggcgctgccgccgtcgccggcgatggaggaggagacggcagtgcgcgcgcagggggtctacctctacgacaagaaggaggcgcccaacgcgtggttcgccttctccgtggtgttcaactccacggggcgccgcggcacgctcaacctgatgggcgccgacctcatgtcggagaagacgagggacctctccgtcgtgggtggcaccggcgacttcttcatgtcccgcggcgtcgccacgctcagcaccgacgaggcctcggcggacttgtcatacttccgggtgaaggtggacatcaagctctacgaatgctacgtctgatcccatgcatacgtacgcttgctctttcatggccgtggatcggatcatcgcgtgtcctaaatatgcgcttgtatttgtgtgattgtgtgtgttgaatttccttcttgacattcatcatctttgcgtgacgagtcatatgcacggagaaatgtgcaaaatgtgttttttttttcgtgttttggatttgcatctcatgtattgtttgagtgacgagtcagcgatcggcttggcgtggtggtttgttttgtctttctttttcctggttataatcttcatagttataatcttataattttttttctacatcaatataaaatcttgtattatctggtgtagtttgttaaaaatacttgcctttttcaatcaattgtcatagatgtgaccggacgtcgaatgacagttattcgcttggatgtcttcgcgagtgacggttgaaagtcggttatgccatgggctagatcatctaaccactggaagtgacctggctgccaatcaagagtgggcccagtacagtgcatttaactaatgggctaaatgacgtccttcatgggtatcttttatgtgttcttttggcgttagggtagcatcgcggtgaagtcgaagctgctgtgtcgtttgggtggcaagctcggcaacgataacatgcgtgggctatttgtaggggtgggtgttcggtcagaccgaaaaattcggtctcggtcttcggtttttcggtcagttcggtctttgcaaactcaggaccgaatttcatccaaaaaaactcaggaccggcaaattcggtctcggtcttttcgatctcggtctcggtctgaccgaaattttttaggagaaagtttggaacgaaaaaatttgacagaggcgtcgccggcgcggtggagggcggaggcgtcggctgcggcgcggtggaggacggtgtcggccgcgttgcggtggaggacggcggcgtcggccgcggggtggtggaggacggcggcggcggccgcagccgcggcgcggtggaaggcggaggcggcggtggcgacgcggtggaggctggaggaggaggcggcgcggttggggcggagccggcggtgggggctggaggaggaggcggcgtggtggggttagaggaggaggcggcgctgtgcggcagtagtggtagggttttttttatgggcttattggacttcctaggcctattgggccaaaatttctgtcatttcggttaattcggttaactgagcccaataaccgaaatgaccgaaataaattcggtcttttgagggctgagactgaaaaggttaccgaatttctcggtctcggtattttcggtctcggtctcggtcttttcggttcggtctaaatatgcccacccctagctatttgtgtcaccacggcgatgccttgtgtcgggctccattg

SEQ ID NO: 74824 - DNA, 1875 bp, Oryza sativa
agcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgaatctctcctcctcttgcacacaattagcaatgagcttctcaaagttccatttctctggacttatgttgtagttgacaataaaattgtcaaactactttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacatacttaatgttcctaaaattaaattctcccgttggttcgaaatttaattttagaaacactgattttcatcaattacatctatttgcagcggaaaactatataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaatggaaaattgctactgttctcttttattcattttcggcccccgagggacctaatttgaacttttgccggcggccaacggcccttttggcatgggcgggcgccccctttccccaagccgcaacctgggcctgggccaggaaaaccgccccccgcgcgcgccttcttgggccgatttcggcccggccggcgtcgaccgtccgatcagctagggtttcgatcggacggccgggcgccgagatcggaggatcaaaacccccctctcccggccggccgccgaaaaaccctagcttctcttctcttctctctctcacgcgaccgcgtggacggcgtcgccatcgccggcgaccttcgcgccgccgcgccatggccggcgctcctttcttttctcttcttctccgctcccccaccgtctctaacccccaccgtgtgagaga

SEQ ID NO: 74825 - DNA, 674 bp, Oryza sativa
cctgcaccccaaagatgacattgaaagacatgggattcaaacagaagctgattcctcagttgagggtgtttctttgaagaatgggctacgcacatctgtatcctttataagaaaattcaatcctgataccatcatgcccttcatggagatacatagatcttagttttcattcccatgataaatgcatctaaacttaatatatcattgcttttcctatgctacatttttttaaaaacagctcaaggcgatctgcagtatcacggagagatggattgcggacaagtcctccttgggcaaagaagatgcttcactgaccgaaaacaccattgaaaatgctaaagagctgctgactttctgccggcgtgcaatgggtattgctgacctgtgagtttggaatacggaggttttgacgtagagggcaaccacgtacgtgaaaaattactaggagttttgctgtatagcacgagatcatccggaagtctgttaaaaccaactaggagttttgctgtagaggatcacagtgatgcatagatcatcagttgctaaagtagatcactactcacatagctctgccaatttacattgatgtggttacattattggtgctagcgatgtaatgaacgcgcataaaaatgatacggggctagaggtttctgatcaacttgtgctcatgg

SEQ ID NO: 74826 - DNA, 971 bp, Oryza sativa
tgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatcaggtgttccatggactgaagaggagcacaggaaattcctggtagggctcgagaagctcgggaaaggcgactggcgcggcatttcccggcacttcgtcacgacaagaacaccgacgcaggtggccagccatgcccagaagtatttcctcaggcagagcagcctcacgcagaagaagagaagatccagcctctttgacgtggtaaacttcaaacatctttgcaacaatatctacacagacagtttcagacagcaagaatcatgtatttatatgagtgagttacagtaacctaacatgtctgaaaatttgatgttttttttcttttctttcagattgaggatgcagaaaaggctccgagtgtgaatgaacgtctgaaactgagacacgagacagcctctgtgcctgctgaaatgggattccctgcactgtcactgggtatcagcagcatggcacagccagaagccatgctgctgcctcctccatccttaaccctgacgccagctgttcatcaccagcagtgagcagcagcagcagcgaacaaccaagaacaatccatccttctctgatggtggcaaagcctcagtgcaactgcaactacaccacctgatctggagctcaagatctcgactgtccgtcagaacgatcagcccagttcgtcgccgaggacgccttttttggggacaatcagggtcacttgaacttaaagagagagagaagaagaagaaaaggaattatcttagagattactgaattatt

SEQ ID NO: 74827 - DNA, 41181 bp, Oryza sativa
  unsure (1)..(41181): unsure at all n locations
tttgcccttcttcacacaacatcttgcctgtaatggttaggatgaagcctggcatatatcgactggggctaacgtgtcatctctaagagataacacgcttaactccggcttgagacgagcgcctagaggctttcgtcttgacgggatggggcaaggagtgcgtcagaccgccagtcgccacctaacccgtgatctgaccggtctgtgactgatcacagaccggataaaagaacgcgccgtactgcgctgcatgcagcgtgacgcgcttgaccagactgcaataaatgctgctaggtgagcacagctgtgctcacttgccccatatatgtggcgcagatttctttaaggggtcggggtgcctcggccctcggggccggggcaagcacaacccgaccccccctcgggggaaatcaggaggagggcggacacctcaccctcgggcccgacgcccccgaaggtgccaggccacgtgggcgattgtgtctgcctcaagcctctggtcatgatactcccggtcccatattaccgacagtagcccccggcgttatgccagagcaatttcccttcccaagggaagcggtcaggtgtgacgccaccctgtgacaggtgggaccggtctccgtagttgggcaaaatacccaacggtctcaatccatgcacattggtattggtaactttggttgtccataatgggtggtctattcaagactgccacaccacttgagcagcgcgcgaatctgggtgagcagattcgtctcgcccggagatatggtaacgccgcttcggtcggcgagcgtaattaacgcgcgcacgatacaatccatttcgattgccacaaccgcatatccacttaatgcgccgtaagcgggcgaatgggattagtggatgcgtgggcacgggaaacgagggagcgagatagcgagatacgagggagcgaggtagtgggcgcgagaaacgaggagtcaggcctagcgatggcaagggtataaaagcatcgaggaaaggatttgctcccttcctttcgccattgttcctcttgccttcgccgcctgagctctaactctttctctgctacgccctactttcgccacacgcgctcgttcccaaccatctcttcctccaccgccatggcgcggggctctgctctgctcgacggcagtgtactgccgccttcccgcatcgtgaacgagaggcacgtcggactgccgcgccgcttcatgccggagtccgccaccggtcgggagatagtgatgctgggcgaggggcgcccggcaccagactacccggggcggtccatcttcttcctcccctttgcaatggctgggctggtcccgccattttctcacttcttcatggatgtcctggagttctacgatctccagatggcgcacctcacccccaatgcggtgatgacattggccatcttcgcacacctgtgcgagatgttcattggggtgcgcccctctcttcagctgttccggtggttcctcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccttcgccgacgaagcgcgcctccgacttccaagccagcccccggcgccggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccgaagcgcctgggagtacactgggcctgaagactacatgcggacccaccagggagccagatgggattgggctcctgaggacttcaagatcgtagtccaaagggtgctgaatcttagctctgcggaggcgtctcgccttcctcaggagatcctccccctctgcatagatcccgaccgcgtctccattctaaccattatgttgggggtcggggcctcagaggagagagcccctaagggccacgacggcgcgggcgagagccgccgggggaaacaatctgccccaggagggggtcgtgcttctgggccccgcgtcgggggctcggggagcagccgtcctgccgacgccccggggaagaggaagctgggaggaacacctcccccatctcctccccgagggggcggggcggcgcgtgccagcagtcggcgcccggagggggccgcgccgacatcgcagcccgagggggtgcgcaagaagaagcggctccgcaagacgggggagacggagccatgccggggaaacctgatttcccctccaaggtggtcattcacccgtccccctcgcaggttcgtctcactctcattgcaaccatctttctccaaaaagaagttttttcttgctcattttgttcgtcttctggttttttcttctgctttagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggtcgcccgggttcgccaagcggaggaaactgctcgggaggaggccgcccgggctcgccaagccgaagaagctgcccgggaggaggccgcccgggctcgccaggctgaggcgacagctgctgctggcgcgtcacttgggcccactccctcgggcggccctcaggcgacatcctccgaggcggctcgcgacgtggccgcgggcgcatcgcctgggcctacctcaccgggcgacgcccaggaccaaacgggcccgggggacatccccgagctcagcgcgtcctccggggggccaagccgcgtcgccttttctccaaggcggcttttctcctcatcttccgtcgccctggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgccctcatcgccaccaccgcgatggtcgaggcgcaagacaccctccgccttcaacacgcaagctgggaggcggagctgaagaacaagctcgacgccgcccaaggggttctcgactccgccgctgtccgagagcggcgggcaacggaagccgaagcagcgtcccggcggcgcgaggaggccctcgaggcccgtgccatggcgctggaagaacacgccggcaccgtggagaagggcttcacggaccgcgaggccgccaccgctctccgggaggcgacgctggcggcgcacgaggccgcctgcgccgaggaggagtccgcgctccgccttcgcgaggatgcactcgctgagcgggagcgagctctcgaggaggccgaggccacgacgcaacggctggcggatagcctctccctccgcgaggcggcgcaagaggagcaggcgcgccgcaaccttgaatgcgtccgtgccgagagagccgcgctggagcagcgggctgccgacctcgagacacgggagaaggagctggccgcgagggcgcgcatcggtggggcggctgcgggcgaaaacgacttagccgctcgcctcgcggctgccgaacacaccgtcgctgacatgcagcgcgcgctggattcctccaccggggaggtcgaggcccttcgcttggcgggcgagatcgggcccgacatgctttgggatgcggtctcccgcatgaagcgcgccggtcggcaagcaggcctctggagagaccagacgacggtgccccccaccaatctggaaggcctcgctccgcacctcaacaggatggcttgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgagnacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccagcgacccgggtgcatttgaatgagcccccaggcccccgccaatctttactttttttctttttctttcttctaaggccttcatgcctcttttgtgtatagatcaacttaatctgcaatcaaaaatgatgaaaaattttctatgttaactttattttgctatgcatgtgagttgaggatgatctgtgccgtgatcctctttttgtgtcttagcctgatttaagggctcgtgctcaagtcccaatcctcagatggctcgggtcggggctagtgcctggggagatccacatgtcgagactggccaggccgggaacatggtgaccgagggttatgggtgacccgattgtgggtttttgccgattcccccccggagttcaccatgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaacttcttttattgaaaagctgaaataagaaaagtaagactgtgcatgtgtggtagcccccggccaaccctgcacacccgaggggggtgcggggttggcccgagccaaaacctgacacccgaccccccctcttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagagccgcgcgccgccttcgctcttctaagtagtcgaggtcatctctgcgaagctgatcttggtcagcctcgcagtacatggtggcccggggagacctcagggtgagctcggatgggagaaccgcttctgcgccgtagacgaggaagaaaggcgtttccccggttgctcggcttggtgcggttcggtttgcccagagcaccgctggcaactcctcgatccatgaatcgccgtgcttcttgagaatgttgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgttataatacggttaggcactccaaaacgggccgtgatgcccttaatgaatttaagagcagagtgcttatcgatcttaacaaccggataagcctcgggccacttagtgaacttgtcgatcgcaacatacagatactcaaacccgcccggggcccgtttgaacggtcccaggatatcaagcccccagacagcaaatggccatgacagcggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacaggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgcctgggcacatgccgaagctctattccatcgaaatggcgctccatacgccgcacttggcgtacgtaggcgtccatctgtgggtcagagcaccggtactccttacagacctgattaacgactagctgggagtcgcctaataccaagaggcggcggatccccagtccaactgccactctgagtccggcaaggagtccctcgtactctgccatattgttagtcgctcgaaagtcgagacggaccaaatatctgaggacatctccgttcggagaggtcaacgtgacccctgcaccggcgccctgaagagacagagagccgtcgaactgcatcacccagtgggcggcgtgaggcagctgtgtggggtccgtgttggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggcctctgcacccttcggtggggccgatcctctctgctaggggccgtatccccggggcgttcttcgttcaagtggcctttcggggcgcacttgtcttctgtaccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttcccgggtcgagtcagcacagggttagcctcggggtcaaagggcgttaagtgcggccttcccacagtggcctcggggccttcctgagggtcgggggcacccggcaccttctgacaagcggggggagggccgactccggtcgtcgggggccttaggccaccgttcgactcgggggtctctcctccctgcctgctcccgggcctagtcggcacagagtgggggtgcgcagaatgaggattatcctcatcgcgctccacaaccaacgctgcactaactacttggggggtcgccgctaagtaaagtagcagggactcatttggctccggggcgactagaaccgggggagagctgagatatgcctttaattgagtaagggcatgttcagcttcctccgtccaagtgaacggccccgagcgtttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatacgggcggagcggaggttctcaaaagtttccgctagatccgaaagtaaagtttcttggttgcgcgtttttacaaccaagtcatcgacatacgcctcaacattacgtcctatttggctacccaaagaaattcgagtagtacgctgaaaagtgggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtctagccacctcctcgcggatgaaggcttgacgttccggggcttgccgccgcactttctgccggaccggccttgcgcccggccgcacggcgagacgatgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcctgtggccatccgctgcctcggggcggtgggggcagaggggccaagcctctcgtcaccgccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagctcacccgctccgtgcggaagttggcaggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagacttgagcacatgctcctccatccacggtggcaatggtggccccaggttcttggaaacctaggtcatcatcaccatcatcaatgtcaacagcgggggccttctgcttggcctcacttcgccgtttgccggagggaaccgccggggacttgccctcacggcgttcctgcctcctgtcctcctcccacttcctcgttcgctcagccaggtttttgactgcgcgacagtccgcgagatcgtggagggaggtgttgtggacggagcaccacctgccggcggggcgctccctgctgggagtaccagcctctttcttcttgtcgctcgcaggcctcccctttcgggtggcccgcggagcgccctcgacggcgaggacatgaccctcgtcgccagaacggtccgacctcttcttcctcctcctgtcacaccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgtggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacgttccgaagactcgccacaaaggctctacagccaacaccaccagccgggggcacggaaggctgatcttcacgtccgtgtcgaggtgacactctggacgaggaggcaccctccgttgcacggggagtacgccggctattacgccggcgcccgatgttgaggcgggcatccggctccccatgctgatcctccctagtcgacggtgtcgacgagggagtggcagccgaatgacgtgcagccgccgccgctcgccgcgccctccgccttgatgacacggagccggtggtagcggcgccggaggtcttggtggtggcggatcgtccaccagcacccaggcgctgctgtgccgtcatgaccaagttggccacgtcttccagccatcgttgggctggagactccgggtcatggacgacaggcgggtgtcgtagaagcgcgccagcagcctgaagcgcaccctgaggcgtgctgccgtcgccgtagacgaggaggcgacgctccccatctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagccctgaaagcacacgctgagccccctacctggcgcgccagatgacggagctcgtggctcctcaccgggagaccgcgcaggcccccctttgccggttcggccgggggcttagggtgagatctcaagctctctcggtatgtggaaagatcgtctgttagcaagaaaacgcgagactcggacgatgtatacaggttcgggccgctgagaagcgtaataccctactcctgtgttttggtggatctgtgtatgaatgagctacaagtgtgagctgacttctcccccgttctaagctcaccatctgggaaagaaccaaccaacccccccccttcatgggcaaggtcctccttttatatttcaaggggataccacatgcacccttctctttccaaactggactgttctttttctcttgaatgggcggagatcagcacggttgccgtccgaatgacgctccgatgggacagcccacacctacctccacttccgccgggggtgagcgcgtcgtgggaacatggctgtgcgctgacgatatgatcagtgtcagaccggtcacaaatcggtcattcttgtctaccgcgtgtaatcttggcaatgtgcatgtttgcccttcttcacacaacatcttgcctgtaatggttaggatgaagcctggcatatatcgactggggctaacgtgtcatctctaagagataacacgcttaactccggcttgagacgagcgcctagaggctttcgtcttgacgggatggggcaaggcgtgcgtcagaccgccagtcgccacctaacccgtgatctgaccggtctgtgactgatcacagaccggataaaagaacgcgccgtactgcgctgcatgcagcgtgacgcgcttgaccagactgcaataaatgctgctaggtgagcacagctgtgctcacttgccccatatatgtggcgcagatttctttaaggggtcggggtgcctcggccctcggggccggggcaagcacaacccgaccccccctcgggggaaatcaggaggagggcggacacctcaccctcgggcccgacgcccccgaaggtgccaggccacgtgggcgattgcgtctgcctcaagcctctggtcatgatactcccggtcccatattaccgacaatggtagtttgttacttatagttctattgcttatagcacctccataagtaatgtgatgcaatctttatcacacgctagggtttttaacctacatgagtacatgacaacgttgttctaccgtgttttgaccaaaaggttagtaaacttgaaaagggatatatgttatactttttgtctccgttccaaaatatcatgatttttagtttgtttaacaaataccaaggttagaataaaatattccctttttaatcatgtcagttgtcaatatttgaattttaaattacttaaattcccttcgcaagcatgcgattggctttataattattgaaataattgaaaccacgggaatcactgcatagatccttatattgtaattcccccattccaaaatataaaaaaatttagttagatgtgacacatcgtaatattatgaatttaaacagactccctatctaagatttatagtagtagaaagtgtctctgattttagttcggactaaatcctaaaatttcttaaattttgaaaacaagagattaaattctactaaaaccgtggaaacataaaaggaaaagtaggccgagagcaaagctcggaaatttgtcttgtcagaaagggttgacacttcaccaaaagctagtagcaggcagctggctatcgatcagctacccatcaaatcaatatagagttccacattaaaattaaaaatttaaagaaattggaactatgtgatgaaaaagtttgaagtttaaatgcgtagaaaagttcgatatgacggaaaagttaaaagtttgaaggaaaaaatgttggaatcaagacagcgccgtaatcaaacggcgacgtcaatcaggcctggataggcatcgtcatgtcgccgtggcatcgatcgtcgtcgtgtgccgtgtcgtctccggcagacctcgccggaaagggacgcgagccactcgacgacaggcaccggtcgtctccgtctccgtcgcggtcgtcgccggccggccgtctctatccctccgactgttacacagaatgattcggccgtgcgtgccagctaagggcccgattagttctctaaatttttttccaaaaacatcacatcaaatctttggatacatgtataaagcattaaatatagataaaaaatgcatgaagcattaaatatagataaaaagaaaaactaattgcacagttatagggaaatcgcgagacgaatcttttaagcctaattagtccgtgattagccataagtgctacagtaacccacatgtgctaatgacggctcaattagtctcaaaagattcgtctcgcagtttccaggcgagttatgaaattaattttttcattcgtatccgaaaaccccttccaatatccggttaaatgttcaatgtgacacccaaaaaatttcttttccccaactaaacacaccctaagctagctagctagctgcaggtgacgtgaaaatttcagctatttggtactttggttttttaatggtcgtctttgagtatgcaccggtgtcgtcagccaatgacgccatcctgcattattttcgttatttactattattacagtttgaaagatgagctcatgcaccatgttggttcttgaatgcacaccgtaccagtgagtatactgtcaatatataatcttctaggaaaaaaatatttgacttaggtgtgttagattagtactcctatctttaaacattattgattagaggagtggtaaacagataaaaagaagttataaataaacctaataaaatcctatcaaaacgtagttacaaatacatatattaatttgggtagaaggatttgaactctaagaatataattgtgctccaacgcttttaataagaccactccttcaaaaagttaaactcgaaattcaatatattggacctcggaaaagaccgagggtgtcattacataggtggtacctattagggcacccacaatggttatctataggctctctacaaaagatctatgtcaacatattttcctacatggaagatattaaatgaagagagagagcaaaactatctactaacttagagatagtctatagagaaaaacgaggcaatgcatgagagagctatagatacccatgtagacatactattgaggtggtttactattaatctagtctattgctgagatgtacatgttttatagatagcaccttactttaccattgcgggtgctcttaggactcttttttggaggctacagttattcatagaatatccggcacctccaaacaatctagatttttatctagattatgagaaattatcgctgaaacataagctaaaaattgagttttccagcttctctatatacttatcagctggtacctatgccagctgttttgcagaatcttgaggctacgttcgttccccagctctagcacataaaatggagcgacccattaacacatgattaattgagtgttagttatttttctaaaaaatagattaataatatttttaaagtattttttttataaaaaaattttataaaaaaattgtaccgttagccgtttaggaagcgtgcgcacgaaaaaaagatggcgagttggaaaagcaaacaaaaaacatagcctacggctgcgtttggttggatccaaagtttggattttggttgaaattggagatgatgtgactgaaaagttgtgtgtgtatgacaggttgatgtgatggaaaatgactgaagtttggatccaaattttggatctaaacacagcctataaacgcttagaagtccggttgacttctcagacaggagaactggaagaacttgcccaaatcaactagaggaggggcttgactcctggtaattccttcgcttggaatctcaggaaggaaagagatgcccacgttttcaatggtacattcacctcggtgcaagcactggtcaacctcatcctgcaggaagccagggtcgaagcaggcgcgccggccacagcttaattggagacctccttacgccttcctccatgttatgcctgcctatatatgcagcttgttcattttcaagatcatggatcctatttttacttcactagttcactgttgtttgcgtctacacaccaggatttacaaaaccgtacggttatcacgataatcatgtcagtaccttagtttttgaaaccacagtatatcttacggttttcatagtaataaccacatgtttaccacgataaccgccaatccatagagtaacggtaaccccaccaaaaacggtttgagaaaccttggtacacactgctagtgactatataaaacgagataattatgggtgatgatatttattttaattagaagtttaggtgttttttgtgttctaaaaatatttatgtttgtattcgtgtccggttatatttgatccttatttttatttgagataattcatatttgttttcgtatatgaattattcatatttatttttgtatgtgaaaaaaaatacaaaaataaatatgatattagcattccatccgtatttgttctttttcattcctagctgcgggcggcctaatcgttattctcagcttctaatgtattcatggcaaagcttttgcgtactcgaaaaataaccagcttgtaaaaaataaaaacaataaaacgagcaagcatgtgtgtccccgtcatacatgcatcagaaaaaaggatgttcatattttagcacgaaagatggaagtcatttaagtggaaaaaacattttttttttgggttatggtggttcattgggccaaaaacaagcccaatgatgtgctaatcgggccaaggcctttgattgcaggtgatgaatgaaatttctaatgtatagtctagccaggtgattccaagaaatagctgatgagttttcaattgatgagaatgcgaaccagacgagggtgtttttactattattattattcacattttacggctgctgagtttcagaatctggaaatcagctatctcgtttgcttgctagctcaattatcaaccatatctaaattatgaaatataaagcttatattttaagttgatttcgaggtttttctatcgcattatatatttttattagtctttatgtcgctaaaaatatatatacaagtagacatacacattacagatgggttgtgtcgtagctaaaacacaacccacccttaccccctacccacccaggtgcgctttagcgcttccttatgtacatactttatatacaaacgtacatatgaaaaaaaaaaaggacgcattgcgcggagagtggcgcgtgactaggcaccggttcgcgtgactcttacattcgcgccaatagtagctaaactgtttgctaccaaaaatacatttggacaagcaaataacgatttttcatgcttatttatatatatggcaaaattagatcaggcaaaatatgttcccaagagctgacttgaaaagcaaaaccgagagcaagaattcatcagtgcacgtggcagctgcatgacatatactgcaattagttcataaaactgtgacactgcgattatatcttaattgtacaaagttataacaatacattgatcaaacataataaatacaacaattaaccacttaaaaaaggaggggaaactgcagaaacatattcagttcctcatccctgtcgccctgcttgtcctacgtaccctatatattttcaaggatacgtaccctatgtatgaaatacggtacatacatacgtatatacgtactgctgcactgtaggcctgtagctactggtacaacaaaaaaaatcaatggtaaattaattaatcacttagtaataagtaattaattagttactatgcttgatcgattaattagcttagctaattatcctttgctattagcttgcaatggatcgatatcgaatcgatcacggctcgagcttgacgaactcgtaatcgccttcctcccctttcttggaccccgacccgccgccggcttgctgctcgccgccggcctcgccgccgccggccttcctctgcgtgagcgcgacgccgccggcctcgcccttggggctgccggagtgggggctcgccgccgcgtggtcgccgccggcgtcgccgtgcttggatgaggacgccgccgccggcttcttcttgacgccggcgcgccagttcttgagcgccttggacgtctggtcgtcgaagattgactgcttcatcgttgaccccatctgaccgtgcacggacacgtgtcagtccagggatatgaccacgtggcaataatatttttttaaaggaagaacacttaaatataataggagtactcgctttgtttcatatttgcgatatgctttaactttttttaaactcctttaacaaaatttatacaaaaaaacgtagtagactgtaaatatataaatatattattaaaatatattcgatgttagatttaataaaattaatttgacgttacaaatattgctaatttttttaaaaaattgatcaaatttaaaaataagtttaatcaagaaaaaaaagttaaaacaatttataatataaaagggatggagtaatatacttgtgagacgagtgcatagagggggagagtgacatagctacacaagaactgaaccacaactctgcaggcacacaaaatcataatcaattttcagacgataaatcaaaaccaaattcaatgatcacaatatctacaaattctggatcgaaacttatcgttctgaaatgaaaagtttggtgttaattaattattacccgaggcagaggcgagcaaagacgaactctttggagtcattgaagcaggagtccatgccgtactcgtactacacaaacacacaacacagaagcagtgagacaagatcaatcaatctactgaagattttcatgaagcagaactgaagaaattcagtgagcaaagattgggtcaccagtatccagaggaagtagatgatctggaagccattctgcgcaaaacaagaagaagaatcaatcaaaggtcaggtatagtttatcactaattgcaatggtggatggtgacaattaattcatggagatcaatggagagagaaaaaatgattgattgagaccaacctggaagagggtgaaatggatgaggaagaggacgaaggttggtcggctgaaccagaagtaggagtcgctgacctgcaccagcggtatcccctggatcaccgcgtgccgctccgtgatgtcgatcgccatcctgcagatgatcccctgcagcttcgtccccaccgacaggatcgtctgccattttcacccaatatatcactcactcatcactgattcatcattcttcagttcagctcagcacaattcagttcagttcagggcagttttgtttacttcagctcagttcagtttaggattgaaatgtatatatgaacattgtactacttaccaccaatgtcatgatggaaattcagctaagtcagctcagtttagttcagttcagttaagttcagttcaggattgtggtgatgtatgaacattgtatacttaccaccactggcatgatggagatccaaagcatggtatgcaaccctggaacatatgaatgcagaggtcagtaattcatcaagtatatactcgaacaaatcaggcaagatcactgcatatttttagaaaaagcaagaaatgtgcagatcagggactgaccgctgacattgaggagcaggaagatgagagcagatgcccaaaggggagggctgcaataaacattcagaccaacaagaatatacttaattcgtgatggttcagtaccaagaaaaaaattgacagattgcaagatgagaatgtgattagcatttagcagcacacctgattccgacaatgaccttgaaatcgtcctcgagagaccgtttgatgtacttctggaaatcgaacttgctgccaggagctaaatgaacctgcaaaaacattattaaccactcaaaagcaagattatctgggatataatatgttttgcacgcagatgctgagagatcatccaagcttgtgttgtactcacgttgacgaagctgtgacgcaacgcgcagtagtcggccctcctgactgatctgaagaactgcctgaagaaattgctctgcatttgacgatcatcagagaggaaattcatgtcaaacgaactgaatttctcgtcttcttgtggcagttggtttttcttgtcagaaatggtgaaccgagctgacagatcgatcttacaatgtagaacgacgccggcgtcttgttcagcacgttcatgtgctgcctgacgaacgacgtctcgtgagtaaatctgaacttcgtcggatctgcaatgcaatgcatagagttaattatgcggaaagtagtattttctggtattttccgcacctactgtatgcatgtggtataaatagttaaataaaaatatgaaaaagtttgacaagatatattatgataatataagttaatatacaaactagaaaggtagcccgcgcacatgcgcgggcacgttgctgacaccttgtttaatgttgcttgaaattttatgaataatattaacacgtgggtgattttttttggtaatatttttttattatattctaaatctgtttttgtccataatttgtttaggattgctttgaatgttggtcatgattttcttctaactaccctatcaacatataaattctacactaaaactatttgaattcgtaaaatcttgagtttatgagaaaatatcgtgtcgtggaaatggagttgattcacatggacctatcatttgtactatatgtgtttttaatatttagtatatcttatttttggagtttctaaactttacgtaatatccttttcttgtgtactatagatatctttatggaatttaggatatttaatggaagaaactttctattaagatatatggtaagaggaaaattttatcaaattatgacaaatttatatttacttctgctacctccttttttcatatgcttactatgttcttggaaaaatgaatttaaaattgaaataagagagcaattatataaataaaatcagtatgtgtagagtatttataaataaaattgtaaatgacatttgttgaagttaggcgtttgtctatagcacttttggattttgtaatcctatttagtcgtaaatatttgtcaactgataacatatatataatgatatactttatattgtcatttgttatataattttcatgtctgtttggattacatgaaaagaatcaaaatgcgacctaaaatataattttattttataagttgaaatatattcaaaacagataataatatgatggtctaaacttcgttttcaattgtagagtgaatttagttatgcatgtttgtaaaagtgatatatgataaaataatatatgtcgccatttgtttgtcatatacgatgaaaagggtcaatatacgacccaaaaaacatttatttatttattataatttaaaatatgtcagcaccactttaagcctatctcaactattacattatatgtatgtaaaaattgtatgtgtaattttgaatttatagttgtttagaatttattatgataaaataacaaatattatctcaactactataaaaaaaattaaaggaaagggaagagaaggtgaggagggccggttgcgtgcatgcagtatgaagtgatattttttaagggttaattggatccatgccactacaaacatgccaatttagaaaaatgtcattattattcacgttattggctacgtgccactggaatttgagaaaattagaaccatgccactccatcacgttttccgtcaaaaatctccgttagccccaattgcacgtgggacctagctgtcagtttcatcttcacctccctcccctcttttctctttccccttcctctctctccaccactgtcgttgaccaccaccgtcgctgccgttgtcattgaccatctccgtgaagaccttgggagccactgccatcgccgctatcgttggccctatccgcggcgggaggcttgggagccggcgccgccgctgccgtctgtggcaggaggctcgggagcagccgtcctcaacgctatccacgtgggagggctcgggagcccctaccgccgtcactatactcgaccccatccgcgacgggagggctcggaacctgcagccaccgccgccgccgctatccttgacgccatccgcgtgggagggctcatgagccgccgccgccgtctctgtcctcgattggatccgcgatgggaggtctcaggtgccgccgccaccgccatccttgacgccattcgtaatatcgtgaatagtagtggtatttttctaaaatgacatatttgtagtggaagaaaatataagtgattttggttgaatgggatagcatagtactacgaatctaaatccatgtccatgcatccaacaaaaatttcttctattttgggacgggggaatatgtagtttctaattaacttctttttattttaatcttattaattagttttgtgtgttttatattgtctagtgtaaactacgtgttgttaatcacatggttttaaactctatgtgtttttccattaaaatgtatgttgagtggccaatagctggtccaaagcaatgtatttcttttacttgttaaatacagttaatttgggacttgcattataaattttgttataaatgatctaatagtatacatggataaaaaaaatagctacatatatatgatgtagatgttacagttgttaaaaaaaattttacaacaaaatatgtttcaatctaatagggcatgaaaatagaaaagaggagatgcacctgtcagttatgggcgtacgtatgtgcagtttgcttcacacgtacatgtacaggccctatgggccttttcttttattattaaagtaaatgcaatgaaggaaaatagtgggtcctttgttaaataatagaaattggtgggtccaccttatttaaaagtgccacgtgtcgaatcaagagcgtttgtaggaagacatgtggcagcttaggagtgtttttaggaagtttaatggacttttattagttagtatataatagatagaagatagatagatagataatagatagatagatagataatagatagaagatagatagatagatagatagatagatagatagatatgaagctacaaattctatctaaagtttacgaaataaaaataacagattttatctacattctgcggtgtcaatttttttttcttgaacgataaatcatatttgactatgtatgttaccatatacttctagcatcacaatcaatctaatcatttttatttttttctacaactattcatgtaataaataataggtgccattgcatctagttgtaaaaaatatatatccgttaattatgttagttaatcttcagagggtgaagaaataacaaaaaatgcaacatatcaaggcgtatatatgtatatatgtaccattagcgaactcgaaatcttggcccgcggcttctttttcccactctttccatccacgaatctgcagcagcgtcgccatgaacgcggctcgaagctattagccgggatcgccatgaaagaagaagaagaagaagaagaagaagaagaagagaagaagaagaagaagaagaagaagaagaagaagaagaagaagaaaaaagagagctttgccttggccctgccaagcgccatggtgatggcgctgtaggtgacgtggaagacggcgaggaagaagatgaagatgtgcagctggtgcagcgcgttgattgagatcagagacaccttcccctgcacaagttgacagcatccatggagcttgttaatcactacatccattttttacgtgtgacgtcgttggctcttcgcataacgtctaaccattcgttttatttaaaaaatagtatatatatatatacatatatgtgaaaatataaattaaaattatagtttttaatgatagaataagtcacaacaaaataaataaaattatataattttttaaataagacaaaatttgaaacgtcacattaacatcctttcgcaatcggtctcgcaggaggaggaggaggaagaagaagaaggaggaggaggaggaggaggttgtgaccgacatcggggcatttggttgccatcttggcctcggcgagcaaacggtggtgagggcgggagaaggcggcggtgaagggagggccgacgccgacgaggctgaagtgctcggccggcgtggcctcgtgttcgccgccggccggcgtggccccttgttcgccgccggccggcgtggccccgtgttcgccgccggccgtcgtggccccttgttcgccgccggccggcgtggccccgtgttcgccgccggccggggtggtcccgtgttcgcccccggccggcgtggccccgtgttcgccgccggcttccatggtggtggccccgtgttcgccgccggccggggtggccccgtgttcgcccccggccggcgtggccccgtgttcgccgccggcttccatggtggtggccccgtgttcgccgccggccggggtggccccgtgttcgcccccggcctccatggtggtggccccatggccgccggcgtcgccgtggtgacccttgccggtctcggcgtggatggtggaggccttgaggcggcacgggagcatggtgtcggcggccttctcagtgatgcagatcttgatgatgtagttctggccgaacacgagcagcagcgagatgaaccctagcaccatgagctctgtcttcaccttctccagcgcctccaccatcgccttcttcttccggtgcgagaagaactccccgatcttgtggagccccttctcgaggaggatggagatgagcacgatgacgccgcacacggaggcgacggcccatgtcggcgtctggtcgagctccctcgtgttgccgccgccgcctcccccgccgcccatggcctcccgcgccgcctagagctcaccgccgcgctcgccggtgggattggatggatcaaccaagaaagatcaaaccaaacgagggagacaaagaagaagaagaagaagatgatgaactggtgaagcaagcggagctaagctagatcaaagagaggaagaggaaggcgaggaggaggaggagagggggacggcaatggtggatggcaacggtgatcgatttgccaataatttcttggtcgcgtaggattagggcatgcatgcatgcatgcatgcgaggagtgatgaaggattgggaattttttcctatcaaaaaaaaaaaaaaaggattgggaatttttgaaggccgctattttggacgcacgcagcttttgcgcgcgaagcgtggagggtccgttaatccatttccgtttcagttttcccgcctaaaaatagccatggcatctcttctagcagtgctacttgtttaatagccagctggtgaatatcttttcgatgtcatatggaagatgaatgcgtgctatgcaatttttcattttaaactagatttttgaccttagatcgcaaagatcgcaaagaagttagttaattcattaaggttatgcttataccatgtagaaggttacatcggaacaattataatttatttcaagccatttgggttctttcttaatcttcacaaagaaagaaatttcgtaatggaaagatagaatgaaaaaaaagaaaaaaatctgagcacatattggcgatgtgaataatctgcatttaagaaaaatctctattttttttttggaaagttccattcgcagcttagttacaagcacggctatacaagttattgtcgtttatcaagctagtgccagttgtctgtgcatgcatatacacgcatacgagaatgcatgcatttgcttaatggaattgcaaattaatattcgacataaaacttaggagaaattatgttgaattttcggatggactttaagatccatgcaggctggacggggtaaaaatatgcaaagggcttttgtttaatggaattgctatttaacattcgataaatgtattttatgaaattttcctatattttcactatttttctttatttttccattcgatattcatattccctattttctttatttttctgacacaaacggttttcccatgttttttaatttgttccctataaatttttcatatttcttttccaaaattttcatgggccaacattgcacggttaccgtgcctaccagtatgtaccataatgggctatgctaatactgggactatatccttggtaggcagggttgttcatttggccttcttaagatatcatttattatgccactgtatagctgttaccaaactatgtgatgataaataacattgatgcttccgatactgaacggttgttcattttatttctaaaattaactctactaagttttgtcttaccgaaatgtggcaaagcaacaatctaaacattaccaaagattgcctcaactatgaatgtttggcaattataagatcttcctctcaaaaaacttattaaaggtattaaaccaaacaacccatatatctcaatcttattaaaaaaatgatatttcaaattttgaggctaccaaaattaacccttttaaattttggctttaggcatcaaagcgaacaaccctcgattatggcaactaacacatttttcagggcacttgtccaccacggattcgttgcttgcacacattcattgaggaagaagtctgaagctgaagtcttatactccctccatccctaaatatttgacgctattgacttttttaaacatgttcgatcgttcgtcttattaaaaaatttaagtaattattattattttcctatcatttgattcattgttaaatatacgtttgtgtataaatatagttttacatatttcacaaaagtttttgaataaaacgaatggtcaaacatattttaaaaagtcaatggcgtcaaatatttagggacggagggagtatatcctcgtatcagattgcatgtatgtggaacttgttcaaagcttctttttcttctgttctttggaaaaaaaaacaggtatgtataacacaaattgttatacacacacacttcttactaattctgatgtggcgtattatgattaaatctagcttttacataacttccaactacttgaattaaatggtcgagagctttagttagtaagattttttttaataatttgctagtacacatagtattttccatcatttgtttcaatagttcttcgatcaacgaatgagtgttggtcatcctcatccatgaatgagttaggcagaaatcctaatatgcgtatgtttttgtgggctgtgtcacacacatccagctcacgagagtccacgtgggggcttaaccttgacgcggtgctagcgtaccatgtatgtccgtgtgtgacatccaattttttttaagaagcgtgcatgcttgtagttttgcatatatctgaaactcaatatttttcaaaaaaattaaactaaaattagaacttaaaattgaaaaactttcgttcaaacgtagaaaactttcaattgaaaaatttaaactttcaactcaaaatttaaaactttcaactcaaaattttgaagcagggcgatgaaccctcaataatgagaatatattgtaaagtcaaaaattggatccaagaagataactaatataatacaatcatgatcaaatgtgcgcacgtgtgtgggaaatggatgtgtatgcggaaaggtggaagatggggttatgattcatttctgtgtgatcctcttccttgcactttatatggagaacatggttatttttatattattttttctctcttttttacattatgcgcgagaatattttatccttctcttgtaagcatttttatgaacatcattttttagctcatatctcacttggcatggatagttggagggacaatcatagacatgtgaagtttttatttggtggacagataatgtatgctgacttccggcatgtaagtttatcatatggtggtgaatggaatattttgataatcctcaagtgtaagcaaaataatgtgggtagaaggtatattcgttgctaacctccactgtggaggaagaacaaacttggtgcgtgtacgtgattttgatcatgaaagcataaaaagaatgaaagaattaaaaagggtctcaacaatttgactacactcgaaataataacaaggaacatatgcataaggtttgcagtatgatcgacgtatggcttgggtaggaataagacattaatgaggagcatgcaaagttataccatttttttcatttcataaaaattccctagaactcaacaaataggagtaaagttcctttcattaggctatctctcattcatcaattacttagatgatatgtgttcctatagatatgtgttcacaagcagtagctaacatgcgaggaataaaaattatgcaacgcatttccaggaaaatcatatactctagttgaagcatccaactccattgtaatcttgagtttaatttttttcagatattttctatggtgagaacagattaaactcaaaatttcagggagtttcagggaaaggatgcgcaaaccatcacttagtataaagtgtaatatgagggggctcagggatggtttggccgacgcggctgacccttccccagttccagtcatcttgctccttctcatgtatgttctgttagattaattggctaggcccaattaaatcctaataaattccattgcctcacattaagtgtgacggagcgtgaggctcctcaccgggagaccgcgcaggccccccttttgccggttcggccggggaccctgggtgaggttctaagctcctagtctgtggaaggttcgcgagaatggaagaagcacaagacacgggcgatgtatacaggatcgggccgctgagaagcgtaataccctactcctgtgttctggtggatctgtgtatgaagaagctacaaagagccggagagtcagagagcttttactctagaaaccctctcctctggttcccaatccagcctcgatcgttctggatcccctttctcagtgcgcaaggtcctccttttatacctcaaggggataccacatgcaccatctctctcttttgtgtggggacttatcctatctttactcaaacttgacttctcttcataaatggacggagatttgtaatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcatgttcgcccttcttcatacaatatcttgcttgtaatggttaggatgaagcctggcatatatctgaccgggaccaacgtgccatctccaggaggtaacacgccggctccggctagggacgagtgcttggaggctctcatcctgacgggatggggcgaggcgtgtgtcagaccgcctgtcgccacctaacccacgatttgatcggtctgtgactggtcacagaccggataaacgagcgcgctgcactgcgttacatacggcgtgacgcgctcgtccaaaccgcaataaatgcggttaggtgagccccgctgcgctcacctaacccatacacgcggcgcaaaacctacaaggggtcggggcgcctcagccctcggggccgaaacgggagcggtccgacccctcggggagacaaagaggggggcggccacatcaccctagggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctcctcagttgggcagaaacccaacggtcgccaatcacgcacatcggcaatggtaactcgactgtcaataatgagcggcctcttcaaggctgccacattactcgagtagcacatgaatcgggatgagccggttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacaacgttggcaagggtataaagacaccgaggaagagatttacttccttcctctcgccattattccccttgtcttcgccgcttgcgccctaactccttgtttcctgtgccctaccttcgccacacgcgctcgctctcaaacatctcttcttccggcgtcatggcacggggctccgctccgctcgatggtagcgtgctgccgccttcccgcatcgtgagcgagaggcaggccgggctgccgcgccgcttcatgcaggaatctgccaccggccgggagatagtcatgctgggcgagggacgcccggcgccacgctacccggggcggtccgtcttcttcctcccttttgcaatggcagggctggttccgccattttcttctttcttcatggatgttctggagttttacgatctccagatggcgcacctcacccccaatgcggtaatgactttggccatcttcgcgcacctgtgcgagatgttcatcggggtgcgcctatcccttcggctgtttcggtggttcttcaccgtacagccggtgtcgccgtcgtcggtggttggtggttgctactttcagccgcgggggccggtgctgaaccgctacattccctgcgtcctccgcaagaagtgggatgactggaagagcgactggttctacaccccccttgccgacgaagcgcgcctccgacttccgagccagcccccagcgcaggcctccaactggcgggcgccggtagatctgggagatggctacgacgccgtcctcgaccgcctggcgggcctgcgatccgaggggctcacaggggccatggtgtacggcgactaccttcgtcgccggatcgcgccactccagcggcgcgcccggggcgcctgggagtacaccgggtccgaggactgcatgaggacccaccagggggtcaaatgggactgggctcctgaggacttcaagatagtagtccaacgggtgctgaatctcagctccgtggaggcatccctcattccgcaaggagtcctccccctctgcagtgatccagatcgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcagccgccctgccgacgcccgggggaagaagaagcaggaaggaacccctcccccatctcctccccaagggggcggggcggcgcgtgccagcagcaggcgcccggagggggccacgccgacgtcgcagcccgagggggagcaaaagaagaagcggctccgcaagatgggggggacagaaccatcccggggaaaccttatttcccctccaaggtggtcgtttaaccgaccccctcgcaggttcgtcccacgcccgtcgtggctgtattcattctctcaacgcgagttttcactcacccatcttgttcgtcttctggtctttcttctgtttcagcgagatcccgtcgcgtccctcccgccattccaagtccggccagtctgaggccgaggatccggcgaccgcagaggcccggaggcgggaatctgaccggcgagaagccacggatcgcctacgggaagccgaggaggccgctcgggaggccgcccgggctcgccaggccgaggaagccgctcgggaggaggccggactccgccaggccgaggcgacgacatcctccgaggtgacccgtgaaactgaccggcaagaggccgcagatcgccttcgggaagctgaggaagctgcccagatggccgtccgagctcgccaagctgaagaagccgctcgggaggaggccagacttcgccaggccgaggcgacgacgacttccgaggcagctcgcgacgaggccgcgggcgcatcgcttgggcccactccctcgtgcgacgctcaggacaagccaggtccgggggacatccccgagtccggcacgtccatcggcgggccgagccgcgcggcatcctctccgaggcggctcttccccacgccttccgttgccccactgagtgccgagccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgcctcagagctcgaagcccgtcggaaggtgttggcggagatcgccagggaggtggaggaggagcggggggctgccctcatcgccactaccgtgatgaacgaggcgcaggacaccctccgccttcaatacgggagccgggaggcggagctagggaagaagctcgacgccgcccggggggtccttgacgctgccgctgcccgagaacagcgggcggcggagaccgaggtggcatcccggcggcgcgaagaagcccttgaggcccgtgccatggcgctggaagagcgtgcctgcgtcgtggagagggacctggcggaccgcgaggccgccgtctccatccgggaggcaacgctggcggcgcacgaggccgtctgcgccgaagaggagtccgcactccgcctccgcgaggatgcgctcaccgagcgggagcgagctctcgaggaggccgaggccgcggcgcaacggctggcggacagcctgtccctccgcgaggcagcgcgggaggagcaggcgcgccgtaatctggaaggtgccagcgccgagagggccgcactgaaccagcgggccgctgaactcgaggcgcaggcaaaggagctggacgcgagggcgcgcagcggcggggcggccgcgggcgaaagcgacttagccacccgcctcgcagctgccgaacacaccatcgccgatcagcagggcgctctagactcgtccgccggggaggtcgaggccctccgcttggcaggcgaggtagggcccggcatgcttcgggacgccgtctcccgtctagaccacgccggccggtaggcaggcctctggggcgggaggaccgcaaagtacgccgccaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggatcccgacttctccccatggacggcgctggacgagttccctcccgggaccgaggacggcgcgcgcgcgcaggtccgggacgccgccgaccacatcgtccacagcttcgagggttcggcccctcggctcgcgttcgccctcaactccgacgaggaggacgatgacggcggagtgggcggcagtggcgacgaggctggcgacccgggtgcatcggattgagcccccaggcccccgccaatctttaaatagtttcttcttccgaggccttcgggcccccttcttgtatagactaatttaatctgcaatcaaataaagaggaaatttttgtgtcaattctatttgttgtgtgtatgagacgaggatggtctgtgccgcagtccttttgtgtcttggcttgaacaagggctcgtgcccaggtcccagtcctcaaatggctcgggtcggggctagtgcctggggagatccacatgtcgagactggccaggccgggagcgtggtgaccgagggttatgggtgacccgattgtgggtttttgccgattcccccccggatgtcgcgtcccaaatcggctctaaaaattcatcctcaaaattgtgccaaagaataagtaaaatacaatgtgaaagcctccaacaattaaaatgtgcaaagataaaagtcaaatgaggcttggaggatttttgtatatttcctaaaagcctaaaatgcttaaataaattttagtggaattttcagagcacaaatgataattgaaaagaaataaacaaagttaaaaaggtttataaaaagaaaaccctaaaagaagttctctttcccccccccttccctcttgggccggctcggcccattccctccctccctctctctcctctcccgcggcccatcggctccccgcgcgcgcgcgccgctgacaggcgggcccgcccgccactctcgctgacgggtgggacccacctgtcatccccctcctctcgccgcgcccgccgccagcgcccgtgccctagcgccgccgccgccgcgaatcccgccgctcccgtccgctccgcgtgcaatcaagaggggggatttactccccgtaatcccctcccccgtttccccctcttttccctctctctctccctcggattcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgtcgtcgctccgctcttcctcccggctcggcgacccctccgtaggcttcgccgcatcgtcgccgaccccgtccgccgctccgcttcgcccgtcgactgccggagcaccgtcgtcatcgtcatcccgagccgcgccgccgtcttcctccgctccggccgccgctctcgtcgtcgtcgttgtcccggggtgagccgaagaccgccgttcgccttcccccttccctcctctctctcgggcgccgctccgccgcgccggtggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatgggatttttaattgaaaattaaatgaagaaattcgcaaatatccatttaaagagcatataagcttcaaatggccatatcttggccatttgaactcggaattggaccgttcaagtctctaatttttccttaagatgtaaagaacccatttttgtgctttgtttctgctgttatgtggagttattttgtgttaaggcctttttcttttccgttggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgttattgttattattattaccttgttcaccctagacaaacaaaaccccaactagtggacactctactcatggtatccctagtataattttaggtagatgcttcgcaatctaattaggtaaccttaggtggttttacaactatagactttgggaaatattcatatcacctggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgctaggggctcagttccgtctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttacaattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtatagttctaagatcgtgtttacaaaatggcctggagcaactaaatgtcttaaaatgctgttttctgcaactctaaccctttatattataattcccttgtactcccttgcatttattatgcattcgtgggtgtgtcttgttgagtacggtggttgtactcagtcttgcttaattttcccaagcccagatgaggagttccctgaagatgaaggcttcggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgaattgtatcaacttttggtgtaccttgcctcctgggacaaggaataatacacgcacgtcaggaacgcctgttgggtgatttccggtcgtgacattgcacctttaactgactcagactaggctgcggtggttgaggatggggcttcagttctagaacttcttatcattcatatctttggcgtcaacctcataccagttaccaccttcgtgacatgcgtcgacatcagctttgtcattactaggatatcatgtttggcaacttgcccctaactgcctcatattagctttcctggtctccgggtgctagctacttctgctattcgatttgagggtcgataactttgcctttgaattatgcttcccaagagaaccaatttatcccacttgacatgctttgacgtcttcccgaatgactttgctgctggacttgttattgtctggtcgtgatcctgccagatctgaagcttcgttgttagaggtgattttaatctgacctctgtagactatcttcgaacatatcacttggttcatcactgggaatagctcccacgaacaagcaactcagattcactttctttatgttcagtttactttccgctattctcttcatgttgtcatcatttagcattcaacgtattcctgtgcaccttcagccttgatgtgttctttcccatgggatcatctcccaagacatggcgttgcctggtaaccggggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcttgctatctgtatctatgccactagggtttagtgcttcctcgagatggggagcatccatattgttcttctgccatatcacctttgacccttttctgatacctgatcgactaattaccaaccatcgactattatgttctcaaatattgatgtctcctggatcttcttaactgtttgcaggtatatccgaacttatcaatgtagaggcatggcgggtacccttatgggtttcatccaacaatccttatcttgatctgtaacaggcgtatccaaactcctattccccaactactgtctcattggcttttttttttttttttttttttaacccaatacagtttaattggttttcttttccatcaacaggttggttattaactcgaggttagaacatagttcctctgaaatgagaccctaggtctcctttatcagtaagcaattatacacataatcacatatccgcatcttccaaaagaatcctcatggaacttgtctgtattacacatttctcccacattacatgaatacgaggcactgccttaaacaaaaagggacggtgcttaacatcggtacattgtatcctcaatatgaatcatccataagcatagcaagctcactgtttatagacatgaatatatttatgtattacatgattgctgcaaactttcgattacaccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttttgcttggtatcgccctccggaggtcgattgccctttgcttggcctggagtaggtcggggagagacacaacttcttccatggacgacaattctttgctggggctgtcggtgcagagaatggttagtgctgaaggtattattgccatgatttattgcagagttaggtggagcaagaggagcattggtgctgtggatgatatcatcgatgttgttgttggagctgactagctgacgagacaatcgtagggtcgttcgttggatttctgcggtcttggtcaacaacacactgagttggcaatccttgggcacatggtttgttccttcgcacagaaaacatgtcaccttgcgagtgggacactcccctggtggatggtcttcttcatagggagtgcagagtgtgagacacatgctagcaacgtgtccaatttctccacaacgggtgcatgcctttgatccgaagaagacacatctgaaactcttagtccaaacaaatgtctcttgggttgatcacttgattttcttcgccatcaatcgcgaggttatttgattcataatagattatgagcttacggaaatgagaccctgggtctccctaatcagcaacaaagtgtacacaactcaccgcacttgcaatcttaacatggatccttcataaacttatcaaactccttcataatctcatgtttctctgttattacatgattgacggggaacaactataaaacataagtatatgattactgatataagagtattatggttgcttctgactagagctaggcttaacaggtactgcatttgctccagcgaccacttggcgatgggcatgtccgcttccttaacaggtaccacagttgtaacagacaataactttctcgcgctcgggttcttcatcttgtacttgatttcttggctgctgtgctggaacatccaaaggtacgatgccgatactggcctctgtcttgtcaactgctggctggggctgaaattgagcattgacaccttgtggtaatgcgcctgctggagttggagctgttgcaacgcgggctataggactgcttcgggatgcatggatgacaattcgctgaggagcaagcttctgattgcagggagttgtgtggactgacgtgctggcagctatgtttctcagttttgggcacttgtcggcgaaatgacccattccttgacaattgaagcaacagatatcttcccggactcggcattttcttttctcattttgattcctctgtcctggcactggttttaagctgagactgtaatcttggcgaggattggtgttgccttgaggcttctctccgttggaactggcgggttggttagccatcttcttcgtcagcagaaaactgaattgacaattttttggtacatgatcagttccttcacaaaagaaacaagtgatcctgctcgttggacacctgtcgggtggatggtcttcctcacaatgaacgcatatagtggcacacgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgccttgtcattcctggtggaggccattctgtgctggtaatagtcatcttacgtacttcttcttcagttcgcatcggtgcttttctcttttgattcttactcttcttgcctttggcttgcttagtacgtgaccccacgtggtacgaaaggctaggaggaaagcattttctaggattcaatggattgtctccattgggctcttcactttgcacactaggctgcaagcttgacttggtgcgaggaggctggtttagcgatgtctgccctgctgaaccaaaggaaggggcttctttgacatatacccatggacaattcagggcatagtgtccttgctctctacaatcgtgacaaaaggggacatcctcttctagcattggaagctcattgacctgggtggcaaacgctcgatcaaacacatactgattttggtcttgacttccaactaatggtagctgtgaactaagcagcatgcttggaatggaccgagggtgtgcccttgttaactctcttgaggccagtggcggattgagttgaaaacttgagttactggaggcatacccgctgacattctttcctttttctctgttaaacatctgttacagggattgaggtgagagaggaaaccaaccaggaaagaatagaccagaactagagacaggaccttaaaggaactaactctttttgttgatgtgttgtttgttttgcttattctgcaagttgattaagcaaacaacctagcatggttacatcacaacccactgatgcaaaccacgcgctacacacacaagcaaggaacacacgactaacaacactaccctatagggtggcttaggttctacgacgggttctccaagatcttcactcctgcttcacagctggcttcactgcttcctttgcttcgctagcggatcctgcagtcttccggagcttcggcaaacaactgacgatgtcttcttcttcacaaagctgaccaactagtactaattgaaatttgaagaaggaagaaaagggtaaaccttttgcaaatagcattaggggaaggagaaaaagaggaactttcgcaaatagttttatttataaaatatgtccttaggttttatccacttggcttatcctacagtcgagatggctctgataccagcttgtcg

SEQ ID NO: 74828 - DNA, 17544 bp, Oryza sativa
gggcggcctggctgggcctcggcctgcggccggcccagctgggagggggaaaaggagagaatgggccggcggcccattcgaaaagggaaggggaaaaagaaaaagaaaaagaaagaaaaggattttccctggaattaaaatattgcttgctcaattttaattggttaaaattatttctagggctctgaaaattccactaaaaaacttgttagcgaatttagacatgtagaactcaagaaaaattccacatgccagattcgattattatttgtattactttcttagggttttctcatgctttgcaccggcattttcttagggtcatttataaataaaattttaggcttgggaggagaacttcagggtgtgacaattatcacccgggaaaggctaatgtcgtagcagatgcccttagtaggaaaggctattgtaatgctatggaaggatgacagttgccattggaattgtgcaaggaatttgaaagattgaatctgggaattgtcagtagaggctttgttgcagctttagatgcgaagcctactctcattgatcaagtcagatgtcacgcccggaatttctatccaaaattccaaacgcttacatgtgtgttaaaccctcgtccaggaatcagccgaggcacacaataataaattgataatagagtacaaataaataactatttaatattcgcaaataataaattattacagaggtaaatagttcctctcaaagaataacatactacgcagcggaaaataaaactaaagcaaactacgaaacagctatggcaactccactccacaggcatcttaaccaagaacaagcttaatcctccaggacatcaccttcgctgagatactcctcctctgatgattgaatattgcaagaatgagcatatgacatactcaacaagccacacagcaaatatgcaagtgcacaggacaacaaaggatggcataatatagcttatttgcataaacagcatttaataaaaatttaagagaatagtaaaatagttgtataattaatcaatattaaataaacaccatacaacacacccgtgttgcataggcccaaccacatttgaacaacctaccccagttgaacaaattaaacctccaaaccaggaatataccattccaaaccaggagtcacattaattaccaccgttaccatttaatgtgtaatatgagactaatcacgaaaaacattgctcaactcacccataaccgcgggtacggctattcgaatagattaaactttgatcagaggtgtaccactgtacccacaagacacaatcccacaacatgttaccatgcgccttagtaccaccacggtacctcggaaaggaactgtgacattacccctcgcacaacacaactcaccacagtgcaccgttcctggatcataatctccccctcaaaaccaaaggcaatggactcccttgcgacccccacggacttttcgccacttcacagtctggcgcactataatgaatcatgctataccaaagaatatacccgttgcccacgctggcttgtggttggcacggtaaatgtttcacaacagtagctcgcgaaccggtccttaattgtcatgagcacaaccatcaaaaccatatgctcacaacccactttatccaggtttcaattatcaattaattaacatcacacgtttaaccatcgtgagctaccatttaatataaccatcattaataataacaatataatataatatagtatataattaatccctttagttagctaatgtgtctaagcatggctaagcaaacatacatatagcatttggctgaaccaatccaatatataaggttcatgctaatcaaattataacctataggaaaataaagtcatcgtaggccattaattaattgggaaaggttcaccacccgatgacattcgaaaacaatgcatagttgaaataaaataatagctttaaacgggttcaacatgctcaaagggttgtttgagatctgtgtgacttgccttgggcttccacaaacgcttcggaatattcctcaacagaaacgcactcctccggaacgtcggaaactaaagcaattaaacaaaaatcaacacaacagtacaaaaacaagcataaacagtacatgtggatatttttaacatgtagatcttgattttagaaaaatttagcaacttgaaccacttgaaacggatctacggttatttagttatgattttccgaagatttaatctattagaaaatcgggaaaaagaaaaaccgatgatgtcatgatgacatcatcaatggtggccggctcggatggcaagctcgccggagctagagcggccggctgcggatttggaaggcatgcacacgtcgagaacgacgagacgaccgcaacggtgctcaccaacacggctaacgacaaccgacgacggccggcgacgaggtgggtggcggcggcggctcggtcggcggtggcggcggagcaccggcggtcggcggcttcgagggacgggcggccgggcttctcctcgctcccgcgcacctaacagtggtggcggcgaccggcggcgacgacggaggcggcggcgcggcgcggatggagtcgtcggcggcgacggtgagctaaacggcggcggcgcggcggctacgaggcacgggaaagctcgggagatggggcaaacgaaagagggggactagggggtcctatatatagactttgattgaagagatcggactcctcccgcaagaaatcggcccgagaaaacaaaaactcggttttggagataaactcaaaaacgagtttgattcggataaaatactcaacggtttgctccgatttttgggggtaaagatagaggaggatgagaggataaaaacccctaaccaatcagaagaaaaagggccggattgggtgcggatttggagcgggaggcggcgtggcgcgccggcttgggctcggcttgcagccggcctgaggttagggaagggtccgacatgtggggcccacatgtcggtctcccgagtggaggggtggctggcgggctggctgggccggctggtccggcttggccgcgggtgagagagggagagttgggccaaaaacagcccaacaacttaaggaggggtttttggaactttttcaataaaataatttgtgaaatgttgtttcaattattaaaaatacttcccttgctcaaataattcccagaaaattctagaaatagaggaacaagcaaagtatttaataaaattttatctagctcatttttatgttgaaaattttcctagattattagggtttagcttgtaggcttttaatttaatttctaaaaatgacttaaacaatgtatttttaaattaggcgatttttagggcgtgacatcagagaagctcaaatcaatgatcccgatatccatgagatcaaaaagaatatgaaaagaggtaaagctatcggtttcttggaagatgagcaaggaactgtatggttgggtgagagaatctgtgtcccagacaacaaagatttgaaagatgcaattctaaaggaagcccatgatatgttatactccattcaccctggtagtactaagatgtaccaggatctcaaggaaagattttggtgggcaagtatgaagcgtgagatcgcagaatatgtagcggtatgtgacgtttgtcagcgagtcaaggcagaacatcagaaaacccgcaggtttgctgcagcctttgaagataccagaatggaagtgggaggaaatcggtatggatttcatcaccggtctacccagaacatcattgggccatgactctatttgggtgatagtcgacagacttaccaaagtggctcatttcatcccggtaaggaccacctattccggaagtcgtttagcggaattatatatggccaggattgtgtgtttgcatggtgttcctaagaagatcgtgtcagatagaggtagccaatttacttcaaaattctggaagaagctccaggaggagatgggttccaagctgaattttagtaccgcttatcatccgcagacagatgggcagaccgaaagggtaaatcagattttggaagacatgttgagagcttgtgttttagacttcggtggaagttgggataagaatttgccttacgcagaattctcgtacaacaacagttatcaagctagtctccagatggctccttacgaagcactgtatggtcggaagtgccgcactccgcttttgtgggatcaaacaggagaacgtcaggttttcgggacggatatcctgagggaagcagaagaaaaggttaaaatcattcaagaaagattgcgtgtggctcagtctcgtcacaagagttatgccgacaatcgccgcagagatctaagttttgaagaaggagattatgtgtaccttcgtgtcacgcctcttcgaggagttcatcgctttcacaccaaaggaaaattggcaccacgtttcgcgggaccttacaagattgtcagtagaagaggagaggtcgcttatcagttagaattacctcaatccttagcaggtgtccataatgtgtttcatgtgtcacagttgaaaaagtgtttaagggtacctaccgaagaagcaaatcttgaatagattgaagtccaagaggatctaacatatgttgagaaaccaatccgtattttggaaacaaatgagagaagaaccaggaatcgagttatctgtttctgtaaagttcaatggagtaatcactcggaagaagaatcaacttgggaacgagaagatgaattaaagccaactcatccgcatttgttcgccagttcttccgaatctcgaggacgagattccgtttaaggggtgtaggtttgtcacaccctaaaaatctccaaattataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaatttcatttaatgaataatttaaatggaaaaaggtttttaaaattcccttttggttttgggacgaaaccgctctctctctctctcccttggcccaagtcagcccaagccgagcgccgcccgcgcgcgcgcgtgcgaccgccgctgacaggtgggtccctgtcacgcccggaatttctatccaaaattccaaacacttacatgtgtgttaaaccctcgtccaggaatcagccgaggcacacaataacaagttgataatagaatacaaataaataactatttaatattcacaaataataaataattacagaggtggatagttcctctcaaagaataacattctacgcagcggaaattaaaactaaaacaaactacggaacagctatggcgattccactccacaggcatcttaaccaagaacaagcttaatcctccagatcatcaccttcgctgagatactcctcttctgatgattgaatattgcaagaataagcatatcacatactcaacaagccacacagcaaatatgcaagtgcacaggataacaaaggatggcataatatagctcatttgcataaacagcatttaataaatatttaagagaataataaaacagttggataattaatcaatattaaataaacaccatacaacacacccgtgttgcataggcccaacctcatatgaacaaccaaccccggttgaacaaaccaaacttccaaaccaggaatataccattccaaaccaggagtcaaattaattaacacatttaccattaatgaataatgtgagactattcacgaaaaacattgttcaactcacccataaccgcgggtacggctattcgaatagattaaactctgatcagaggtgtaccactgtacccacaagacacaatcccacaacatgttaccatgcgccttagtaccaccacggtatctcggaaaggaactgtgacaatacccctcgcacaacacaactcaccacaatgcaccgttcctggatcataatctccccctcaaaccagaggcaatggactccccatcgacccccacggacttctcgccgcttcacagtctggcgcactataatgaatcatgctgtacaaaagataaagtcgttgcccacgctggcttgtggttggcacggtaaatgtttcacaacagtagctcgcgaaccggtccttaattgtcatgagcacaaccatcagaaccatatgctcacaacccaccttaaccaggttttaattatcaattaattaatatcacacgattaaccatcgtgagctaccattaaatataaccataattaataataataatataatataatctatatttaacccctttaattagctaatgtttctaagcatggctaagcaaatatacatatagcatttagctgaaccaatccaatatataaggttcatgctaatcaaattataacgcataggaaaataaaatcatcttcggctattaattaattgggaaaggttcaccacccgatgacattcgaaaacaatgcatagttgaaataaaataatagctttaaacgggttcaacatgctcaaagggttgtttgggatctgtgtgacttgccttgagcttccgcaaacgcttcggaaccttcctcgaccgaaacgctctcctccggaacgttagaaactaaagcaaaaatactaaaatcaacaaaacaatacaaaaacaagcataaacagtacatgtggatatttttaacatgtagatcttgattttagaaaaatttagcaacttgaaccacctgaaacggatctatggatatttagatatgattttccgaagatttaatctattagaaaaagggaaaaagaaaaaaaacgatgatgacgtcatgatgacatcatcaatggccggaccaagatggcgacctcgccggagattggatggtcggctgcgaaattggagggcatgtacacgtagaggacgacgcgacgaacccaacggtactcaccctcgtgccaaacgacgaccgacgacggccggcgacgaaggggcgtcggcggcggctcgggatgaccggcgacggtgagctacggcggccggcggcgaagggggaggtgcggccgggcttccccacaccttggcgcaccaagtggcggcggcggcaagcggcggcgacggcggaggcggcggcgcggcgcggatggaggatggccggcgacggtggcggggtggagcacgtggcggcggcgctacgaggcacgggagatcgcgggagagggggcaaacgaaagaggaggactagggggtcctatttatagccttggattgaagagatcagactcctcccgcaagaaatcgctccgggaaaatctaaactcggtttttggggataaatccgaaacgaactcgattcgggcaaaatactcaacgatttgctccgattcttgaggggaaagatagaggaggatgagaggataaaaacccctcaaaaaaccggactaaaagtggagagattgaggcggaatcggagacgggagacggcgcggcgcgcccggctcgggctcggcctgaggtcggccggaggtggaagaccaccccgacaggtgggtcccacctgtcggcggctggggaggggagggcggctcggcgacgggttgggccggttttgggctggcttggccgcggggagagggaaaatgttgggccgaaaatggcccaatgactttaaggagggattttggaactttttaattaaaatattttgtgaaatgttgttccaaatattaaaatacttcccttgctcaaataattcccagaaaaatctagaaaatagaggaacaagcaaagtatttaataaaattttatctagcccatttttatgttgaaaatttacctagataattagagtttaacttgtaggcttttaaaataatttataaaaatgatttaaacaacgcatttttaaattagacgagttttaggcgtgacagtcccacccgtcagtcgtcgtcttcctcttgccgaaaccctagccgagctgcgccgccgccgccattccaaatccggccgcccctttccgtttccggtgaaattgattgaggggaaaggatccccgtgatccactctaccttttcccttttgaaaacatcgtctaaatcgctttggaaatcgccggatttgagttcgattcggatcgatctctctcctccgaaccctaaactttccttcccgtcgccggtcgccgtgggccttcgccgccgctccctagcccctataaattgacccccgagctcccctctacccgtcgccactctcgtcttagcccgccgccgtatgtagcgccgcctccgcgtgagaccttgagccgccgtcgccgccgtcgctccggtcgttgtcaccactcgggaaggccaccgtcgtgatcgccgtctcgttgctgtctccgtccgcaccttctccgtcaccgttgaccgccggaacgccgtcgccgtcgtcaagccgaaggtcgccgccgccttttcctcgtcgccgacgtcgtccgttgctcgtccgccgtcgctttggtcaccggtgagttcgcagcgatgcccgcatcgtttcggtgccctccattcgcgccgccgtgccatcgtttgccggcaagcatgtgtgcccaagccgctgccagtggtgacgtcgtcactgacgtcatcgtcgtcgtccctcgtggtctagccgtggaccgatggatctcggtcgtccattttggatggatcgatctcggccgtccgtttcatgaaccgccgccgtgcacccggtccaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaattttttctaaaattgagatctacatgttaaaaatatccacatatactgttcatgcttgtttatgtgctgttttggtgattttgttcttttctctttagattccgacgttccgggagagtccaattttgcaggagaagactttgaggatttccaaggccagcaaggcaagtcacacagatcccaaacaacccttcgagcatgttgatcccattgaaagctattgtttctattcaactattgcatttattttcgaatgtcattgggtggaattaacctattgtttattatggcccttttgttcttgattactttattctttgataccttgggttaatgtaatttgacaagttgagctttatatgatggttcagctagatgttagtcataattgcttagccatgcttagaaacattagcacactactgggataacttatgcttcactattatttaatgatggtttaataatagctcatgatggttaatcatgattggttaattaattaatttgccaactaaaacttgataatggtgggttgtgagcacatggttttgatggtcgtgctcacgacaattaagaaccggttcacgagtttcggttgtgaaacatttaccgtgccaaccacaagccagcgtgggcaacggctttactttctgtatagtacggttcattgtagagcaccagactgtgaagttgcggagataagcccacgggggtcgctggggagtccataccttgtttataagggggtgattatgatccgggaacggtgcactgctttgaattgtattatatagagggtattgtcacaatctcaattcgagtacttgtcaagtatcgcgacgcatggttgacatgatgttgaggttgtgtcttgtgggtacagtggtacacctctggccagagttcaaactattcgaatagccgtgcccgcggttatgggcgggtctaacaatgtctttcgtgattagtctcacacttctcaccatactaaatgatgctgttaataacttgatagctcctggtttggaatggttaattcctggtttggagatagaactgtgcagccgggattggttgttcagaatggttggcctatgcaacggggtatgttgtatagcgttggatcaatattgtttaattattatttaactgttttattaaattctgaaataattgttaaatgctatttaagcaattgagactatactatgccatgctttgttatcctgtgcacatgcataattattgcgtggcttgctgagtatgtcatatactcaccttgcaatctttcatcagaggaggagttctacagtgatgctgatggtgtggatgattaggcgtagccctagtcaagttgcctgtggagaggagtcgcctgcgctgtttcttttattttccgttgcttagaactttattgattgagaggaactatttacctctgtaatgacattttattcgcttattaattagagtaataattgtgctctattatcaatttgttattgtgtgcctcgactgattccaggacgagggtttacacacatgtaagcgtttgaaattttggatagaaattccgggcgtgacaacctatcatgcgtctctaatggcgttctataaagaatgcttatctttttgtcattaatatagtgatgatccttctgtcgtcatacagtctatgacgttcatcttcgtcactatcaagcccagaaattatgataagatgccatgtggcctgttaaggcccatgtagtcagggccggctcgggggggaggagggagcgggatggccgctctaggcccccacccacacaccttgtcaggtgtcacgccctaaaaatcgcctaaattaaaaatgcatattttaaatcatttttagaaattattttaaaagcctacaagttaaactctaataatctaggaaaattttcaacataaaaatgagctagataaaattttattaaatactttacttgttcctctattttctagaattttctagcaattatttgagtaaggtaagtatttttaataattggaacaacatttcacaaattattttaattaaaaagttcaaaaatcccttccctaagtcgttgggccgattccggcccaactcctctccctcccgcgcgcccgggccagcccaaagccgccgagccggcccaacccaacccgccagccgccccctccactcgggagaccgacatgtgggccccacatgtcggacccttccctaacctctagcagtcgcccggccgagcccagccatgccacccgagccgccccctttcccctccaaatccgcatcgaatccggcctccccgagtccgattgtttgtgggattttgatcctctcatcctcctctatctttaccccgaaaaatcggagctaatcgttgagtattttatccgaatcgaactcgttttcgagtttatctctaaaaccgagtttttgatttcccggattgatttcttgcgggaggagtccgatctcttcaatccaaggctataaataggatcccctagtcctcctctttcgtttgccccgtctcccaagccttcccgtgctccgtagctccgccgccaccgccgcctagctcgccaccgccgccggccaactccggtagcgccgcgccgccgccttcgttgtcgccgctgcttgcagccgccgccaataggtgcgccaaggtgaggggaagcccggccgcccgtcccccgtagccgccgaccaccggagcctactcgccaccgccgaccggagccgccgccgccgttcatctcgtcgccggccgtcgtcgttcgtcgtttggctcgagggtaagtaccgttgggttcgtctcgtcgtcctctacgtgtacatgtcctccatgttcgcagccgaccatccaatctccggcgaggtcgccatctcggtccggccaccattgatgatgtcatcatgacatcatcatctttttctttttcccgtttttctaatagattaaatcttcggaaaatcataactaaataaccgtagatccgtttcaggtggttcaagttgctaaatttttctaaaattgagatctacatgttaaaaatattcacatatactgtttattcttgtttctgtaaggttttgttgatttttgtttaattgctttagtttccgacgttccggaggagagtgtttccgttgaggaaggttccgaaacatttgtggaagcccaaggcaagtcacacagatcccaaacaaccctttgagcatgttgaacccgtttaaagctattattttatttcaactatgcattattttcgaatgtcatcgggtggtgaacctttcccaattaattaatggccgaagatgactttattttcttatgggttataacttgattagcatgaaccttatatattggattggttcagctaaatgctatatgtatgtttgcttagccatgcttagaaacattagctaattaaaggggttaaatatagattatattatattatattattaattatggttatattaaatggtagctcacgatggttaatcgtgtgatgttaattaattgataattaaaacctggttaaggtgggttgtgagcatgtggttttgatggtttgtcacatcctgattttcgtcttaggatttataaattatttaataaattattattagaatttatattaaatgttcgttaatttacaagtgaagttaattgtgggaaataaaatttcctaaatgtaaagcatggatggatttaatttttattaaattctccatggttaattatattctctggaattttctcggattttttggagctcaactcttaattttaatcatacaaagagcagttcagcaattatttaaatattaaattaatcattaaatgatctgattttaatattgttaaatactttgagtgtccaagtattttcaagatttttcttgaaatcatttgagcgttggaactatttttaacaattcaaagatcatctcattgattaatttattaaattggaagtcctttgttgctcccttccggcccagcccaaaaagtctaatctacctccctctcgctacagtgtcgtcttccagctccaggcagagcccgagctgccgtcctgtgcctgctgccgtcgcctcctcctccatcaaatccggtgcatccgttgatccccttctaaaattgattgcaaaaacggattcctctctatctcctctacctaatcccgaagaaacccccatcaaattcgttatatatctcacgaattttggccgtttatattcgggtgaactcagataaatcctaacttctttcaccaaatccatccgttcctgagccgatctcttcaatccaagcctataaatagcaccccctagtcgccctctttcgtttgacccatctcccgagctctctcgtcaaccgtagcgccgtcgccggtcaccggagagtcgccgctgccgacgaccgagtcgccaccgccgcacaagctcgccgccggccgtcatccgtcgtcgttcgtcacgttggtgagtatcgttgagatcgcgtcgtcgtcctctacgtgtagatgcccttggttagtccggccgaccaccctagctccggcgaggtcgccacccgtgccgtggctgccgtcgatgacgtcatcatgacgtcatcatctcctctttttcagtttttctttaatagattaaatagattaaaacttcggaaattcataactaaatcatcgtaactccgattcgagtggttcaagttgctaaattcatctaaaatcgagatctacatgttaaaaatatccacatatactgtttatgcttcttttttactgttttgtttattttgttctttcgctttagtttccgacgttccggaggagagcgttttcgttgaggaaggttcgtgagtgcgtcgaaagtgttcaacaagactaattgaagaccgattattgcaaggcaagtcacacagatcctaaacaaccctttgagcatgttgaacccgtttaaagctattattttatttcaactatgcattattttcgaatgtcatcgggtggtgaacctttcccaattatttaatggccgaagatgactttattttcctatgggttataatttgattagcatgaaccttatatattggattggttcagctaaatgctatatgtatgtttgcttagccatgcttagaaacattagctaactaaagggattaattataaattatattattattattaattatggttatgttaaatggtagttcacgatggttaatcgtgtgatgttaattaattgataattaaaacctagttaaggtgggttgtgagcatatggttttgatggttgtgctcatgacaattaaggaccggttcgcgagctactgttgtgaaacatttaccgtaccaaccacaagctagcgtgggcaacggctttaccttttgtatagcatgattcattgcggggcaccagactgtgaagcggcgagaagtccgtgggggtcgctggggagtccattgcctctggttttgagggggagattatgatctaggaatggtgcactgtagtgagttgtgttgtgcaaaaggtattgtcacagcctctattcgggtactttccagtatcgcgacgcatggtagacatgatgttgaggctgtgtcttgtgggtacagtggtacacctcttgccagagtaaaactattcgaatagccgtgcccgcggtcatgggcgagttgagcaatgtttttcgtgattagtctcacactactcgttaatgttaataatgtgataattaatttgactcctggtttggagtggataattcttggtttggaagttagatctgtacgaccggggttggttgttcaggtttggttgggcctgagcagcatgggtgtgctgttcagtgttgattaaaattgatgattaattactttactgttttacttctcttaaatctttgctaaatgctgctttcgcaaatgaaccctatattatgccatcctttggtatccttgtgcacttgcatatttgctgtgtggcttgcggagtatgtcatatgctcaccttgcaataatcaaccaaacctcagttgaagaaaaaggatccagaaggagaagacgtttggcttataccccagttgagctgcctgtgggagtggagctgaagccatcgctagatcgttaatttcgctactgttttcttttcttttgtaagtatgtaacgttaatattatgatggatttgtatattaaattgtcagtttgtgtacctcggctgattcctggacgagggttttatgcacaaataagttcggaaattactagtgaatttctgggcgtgacatggttgtgctcatgacaattaaggaccggttcgcgagctactgttgtgaaacatttaccgtaccaaccacaagccagcgtgggcaacggctttatcttttgtatagcatgattcattatagtgtgccagactgtgaagcggcgagaagttggtgggggtcgctggggagtccattgcctctggttttgagggggagattatgatccaggaacggtgcactatggtgagttgtgttgtgcgaggggtaatgtcacagttcctttccgaggtaccgtggtggtactaaggcgcgtggtgacatgttgtgggattgtgtcttgtgggtacagtggtacacctctgatcagagtaaaactattcgaatagccgtacccgcggttatgggtgagttgagcaatgtttttcgtgattagtcccatattattcattaatggtaattgtgataattaatttgactcctggtttagaatggtatattcctggtatggaggtttgatttgtacaaccggggttggttgttcaaatgaggttgggactatacaacatgggtgtgttgtatggtgttatttagttttgattaattactcaactgttttactattctcttaaatatttgttaaatgctgtttatgcaaatgagctatattatgccatcctttgttatcctgtgcacttgcatatttgctgtgtggcttgttgagtatgtcatatgctcattcttgcaatattcaatcatcagaagaggagtatctcagcgaaggtgatgatctggaggattaagtttgttctagttaagatgtctgtggagtggagtcgccatagctgttccgcagtttgttttagttttatttttccgctgcgtagaaagttattctttgagagaaactatctacctctgtaatgatttattatttgtgaatattaaatagttatttatttgtactctattatcaatttgttattgtgtgcctcggctgattcctggacgagggtttaacacacatgtaagcgttcggaattttggatagaaattccgggcgtgacatcaggtcccaaaattgaagattcggtaactgacatgtttaaactgtatcaagccctggatcagtagattgatacaggttcaacaatctgaatcttcatcgcatacatttgatcaaggctccaaaggtgatttctttacataaaataatagggtatttacaagattgtggctatctattactgtagaagctataggatgagccaactctaatgttttgctatagaattaaaccatctatctaatctataattgggaactaagttggaatgaaactaatttatatgtttaaactcatggttcggcaaaaactccaaattgattctcaaagagagggttaaagcaatggtgagtacaacatactcatcaagctattatatcaagtaatgaatgcatgaaatagtaatctctgagtagggtttaggacttaccctaaaccctatacaaaaaggtccatgggcattaggtgaattgcgtttaggtccataggcccacatggcatacaaagcaattttacaaaaagaaccttacaagatttaaatttctactaatgaaagtccttacgcctaatgaagtggctaaatagccggggcacacatgtcggtgacttggcggctagggaagcagaggcaataggagggcaacggcgaccaatggcgttcgcggcggcgtattggcttgatcatttttgggcgtctttctcctgggacgtaggcgacgtcggtggcgcaatggctcggccggagatggttcgagtcgacgggaatgacgaagtggggcgatggcggcgctatggacaccgggaatgccgacgagcatatcactaactgttcgatctatgccaaaatagaaacaaagaaaatggattgattaggtagagaaggaacttcacgttcccatggttggagtgcggtgaagctcaccagagaatacatgcgatggatgaaactccttcaggtgaaaagagtaagtggaagttcttggagattccgaggtagtttttggtggtttgcatagtggaacactgtgagaaatagatgaggttcacagtggcgagttggctagattaatgactactacagggacccttttagattccgtgcaggcggcaactcgttgcttctgggaaaatcggctcattttcacgtgcggtccttttaaaagga

SEQ ID NO: 74829 - DNA, 1605 bp, Oryza sativa
  unsure (1)..(1605): unsure at all n locations
ggagagctaatgcttatgcttattgggtattttggtttgacactgcttcacgcccaaaaagaaggcactacgtctgagctaaacttggatatggaagtcttctttcgtttagggtgaagtaagaccaagctcatgagcttattatcctaagtcggaacaaattagttgatagtgataggatcccctttttgacgtccccatgccccccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtagga

SEQ ID NO: 74830 - DNA, 657 bp, Oryza sativa
tcctagttagtaagatcaagaggcttgaaggagcaagagatgaagtcgctaatgtcgctataccactcgtccaagctatgttcctcaataacagtggtccgagtgtactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttgcagacaggacaagcgtagaggctgctcttgatcttatcagcaatgctcaaaatgcggctgacaagattgcaagtgacgtcgtagatcaattccgcaacaccgatcttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaaatcacacaacccaatgataaaccaaggaagcaaattgaattgataaaaaatcacactccgttattatga

SEQ ID NO: 74831 - DNA, 515 bp, Oryza sativa
acaaataattacattgtattatatttacatatatcaatttttttctaaaaaagttttatgacaaaatgtattagctggtcccttaaatgaaatgggccgtggaggtgggccggtccagtaagagtggaacgttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaaaaagaagagggcggcggcgatggcgaggcggctgatcccgtcgctgaaccgcgtgctggtggagaagctggtgcagcccaagaagagcgccggcggcatgctcctccctgagacgtccaagcaggtttcccccacgctgttcttccccccctcgatctctcgaggagctactgctgcttctgcttgctgcttcaagttggctgcgagtgtgatgcgatccggcgaggggaggggagt

SEQ ID NO: 74832 - DNA, 638 bp, Oryza sativa
agatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcaaattgcaggaagagcagcgagagccaataagccatttttaccatcagatctggcgcaatgcaccaaggaggaagcgaggacgaggaagcagacgagggagatcctggaatccattctcgccgacacaattcctcgctgctgcagcggtgttactgttgcctcggccggggaggaagaaaagtgaggtgcgaggcacgcaaaaagtatgagaggagtgaggaggaaagaggcgagtttctgtcaccaaccacttctttttaaatttactctttattgaatcttgataatctttactctttccttccgggctgggctaaaaactttttaagtaaaa

SEQ ID NO: 74833 - DNA, 14518 bp, Oryza sativa
cctcacctaatttatcgttattattaaaaaagtatttgaattgatttgtaaattatcagaattgatttgtaagggaccaaataattaaatttctgtttgcatgcagtcatatggaaatctgcgactttggctgaggtggtgagaattatttctgcatgattttggactactcgatcagtcacaagtcacaacgtaccttgctagttaggaaaactagtcttgccattttatttgtctttttgagagatcattactaatttggacgcataaatccagacaaaaccacaagcatatgcctttgttttctctgcaaacgctcgaatatgcatgtagtggcaccttaaagcaatggcacgtgtacgtgtaatgaacgtgctaacgaaaattttggcttttaaaggccctccttgtaatgttagaaaattttcttgatcctatgaacacgtcgtctctgcttgttgattatcagccctagtattctattgaaatccagtatgagaaaaaaaaatgagccacatcatcaggtaatattaattagttattggattcactagaagataaaagaggatgaattaatcttgaatggattagatggatggtataaaatttgaattaatcttgaatagattagatggatggtataaaatttattaaggtttccggagatttacgaagctattggaaaggattagctagatggatggtaaaattcaagactttcgaatatgcatgaagttattgaaagaaagaaaagaaaagaaaaaagataaagaataagcacaagaagagatcatgtggtgcatataattttaggatctacacgtacagtaaaaactgttttacaaataaaccctcgtcacattccttccaaagaaacaggcagccataatcgcctaattttttagaatgatttcgtaatgatttttttataggtttattaatttcacatgaatttaaaatacaaataacctattttcttacaaaacccaaaaaatatatgtgcatgatctataaaagcatatgcaccaacagaaaataagaggatggtgagaaggcaaacgataatatagtgactcgtacaaatataaagtttgcactgcatattaagccatttataataccatcataatatcatttatcctagccaacgttctcttccgatcaacgagagaagtccaatatagaaagattgccacttccacgtaaacaagatgtttatagtcgtgccattgcgcgatattataggctagtaattttgaattttaaaaacatgattttaaatttatttaaggttttctttcaatatagcttacttttatgcatttgcttttggaccccgaataatgtagatgcaaaaaaaatacatgtaaactatttttatttggttcattcatatctttgcagattatcattataactcaaccaatcaaaaatagattcatgtatttcaaagaaaatataaaaacaataaccatggtaacaaatatggacatgttcagtaaatgggttataaaaggtgggattgtgatagggtaatgaacagagggttgggatgaaattaagcatgaaaaatgaatggccagtacttaaatatacccttcagtgggtgtgatattatttcctaaacctctttgccaaccaaacactatgccccaattacaccgacaccaggctcagattgaaacagactattcagcaggttatctatttaattatagggttaaattaaagattttttaaactaaacttcataaataacttagaacaatgattcaaacaatgtcataaaagaaatatttttttgagatgatatatttttagaggcataaaccaatgattcactaatgatctaatgaagtagtcggaaaaaatcaggaccctttaaaataaaaaaaaagattgttgtggtacgagcaaacgcatcaagtgcagctcagggatgcgtcgacatcaaacgatagtggaattgacatgtgacgtatctcccaaagcaaagattagctaaaggtccatggatttgacaggtgacgcatctccgaaccttcggatcaaagccaagctcgccatcccagaaagatccgggaagccaagccaagaaagccagccacctcgcgtttctcaggccacatggctgcatataaattgcgagcctcgccgccctgaccatttatccattaccatcacagaagaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgtaagaaggtatttttggtgttggatatattgattgattgatggattaaaattggtactgaattgtttttgtttgatttgattttattaggatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaaggtacacgaatattgacgtcactgccactatgcccatttggctatcaatcttaattaattagtaccacaagtttaatcactagcttaattactggcgttctggccaatcaaagttttataatcaccttttctgaaatatcatctgttcagggttaaaaattttagaatgcaaaaaaattgcggagattttgaactgaattttcagacaaattttgtaatttgaacaggttttcactttacttgaaccgaatttgagaaaattcaatcaaattcagagtgtttggtcggtattacttcctaccgggactcactgatagacccaaattgaatttcattctgaaaactgtaaaccttaggagtgcttcggacgaaatttcgttccaaattaaatttgcattggatgatgaaattcatcaatctccctgtcaattttttcagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctattcggcaggcggctcgctgctcttctgaggctgatgagtttgtctagtactagacacgcccgggagctctagctaggatagaaaactagagaaagtttaattatacctgaattttaattaatcacctcacaaaactctgatgtatcatattatatcgtgatagtgactgcttgttaatttaattttgccgatcgatgtgatcttcggttcgtgtgttcatgacttaacgtcttcatgtatgtttttagcagaaagatcaactgctggttttaatatacaatttttaggaattttaccccgtaaggtcgaataccattacttcataatttagtgggatcattttcataaattttaatgaattggcatgtaaaaaccaagagttgtaatgatgtttgtgaaaaagttatagggttaagtgaccccaaagcctcatacatagctccaccactgactgagcattttcttttctttcgcttgctgaagtgatccactttctgagcgccgcattccaaatacaatagatcaatggacacaaatgtacgatatttgttaataagattagccaaaccctatacatctggcgtactaattatgtctacatctctcttaatatacgcacaactacaatataccaatgacccacaacaaactagtttcatcgatcgcttcctcgcctatgttacagcaaatgcggcggttatctcaggtggttctctttattttaaaaggggctaggatattagaatattagaagttaactctatttatatctttaatacctattacaactttaaaacctattgatagccaactttatatagtagatatatttaacataaacttaacaaagttcaccgttttgcaatgaaatttataaaatgtcaggtctatctcactgtaggaaaaacaagttcaccgcctctagccagaattttagaatttatttgaattcaacaaattaaaatgtttgaaatcagtgaaaacatgtttaaagtttaaaactcttcattcaaaaatttatgtccctttctcctgatttgtttttcgttcgcaatgtaaagccttgttgtctctgagcaccatttcaacaagtaacaagtcattaactggtaactacaagtacccttgacccagcaaatgagctaattagccggtctgttattttcttcctttagtccaaatcgccagcaggcaaattaaaccggttgaattcccagtcaaaatacgagacctgcatgatcgatgataggcaggaaaagactcgtgtaacgtactcctatcattctccgaagtttctatactccttaatctctcgcttgtctatcttatcaatcaaatgaacaccactctttaacatcgaatattcatttgaaaaataacaatccctgaaatggttccatcaggaactaacttattatttggcaaccatacattacatgttccttatgggaccaagaatagtatgtgttggactttggaatgttcttttttgttaattactccattgtggcaagaattgaaatagtttttagtgatattatattggttcatgtcttaaatggattctaatttgcttgtcatgttacgaaagtatggacatgaaatttgcaggaaaaaaactaaggatggcaacgggggtgagggcgggttgtaggcagagctgcaatggagttcagggcctgtctggtacagctccaactccaactccacccctcctagagttggagctcagccaaacagtttcagctccatcaaaactgggagtggagctggatggagctctctcataaaatgaactagagttgtgtagctgggtttaggcagctccacaactccactccagacccaactcctggagctaaatttaggagttagagctgtaccaaacaggcctagaatcttggtgtttgctagagctattgcagggcaaggataaacaaatatgggtgggaactcaccataaacaagcattggttcgaggtcaattggccaccttcactcgcaggagcaccttctccctatcgtgccatctatctcagctctgggacttctgtccgcccacgaatccatgatcaccatccacaggcacggtgagagtaggagttgatttggtgggagtcaaaatggaggtatactgtagcagaatggtctaaaaaaaatatttctactagcgtgaatggccgtatcaacacccgagctgcgtcatctacactttgaatcttgggtaatacaatagatcaaaattaagaactgtggagattatgggtaccccatacccacacggcatggttatccgactagttataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctatagggggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggttgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccagctggccttcgccgccgccgactggtgtttccgcctgcacggctggcctattatgccgccgctgttgggcgtctacgacttcaccaccggcctgcctccatcgccgccgactggtgtccccgcctatacggtcggttggtcacaccaccgttgatgggcatcgtcatctacactgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgttgttggatgtctacatcttcaccgttggctcaccttcgttgccgtcgactggtgtttccgcttacacggctggcctattctgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggttcgttggatggaccgagtaacgcaaggtgctaagtattattcggaataaatcaaaagcatagagatgagataaatttattttctgctcttaataattgcaaaagtacctgagtagtaaattctgatccgtgaaactgtgttccattaatgacgaactcatgtcactcatatgcatgtttgggaaatgcctaggccgactcccgatgcttgggggcaatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttatactccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcgtcaccgaccggccgccgcatccgccgctgactggtgtcaccgcctgcacggctggcctgttataacgccaactgatgctatcttcttcacggctagctacatcgctgtcactactaataggcatcagtatcttcaacacaagctgcctacgtttgccatggctgccgactggtgtttccgcctgcacgctggcctattatgccactgttgatgggcgtctacgtcttcaccgaccggcttgccttcgccgccgccgactggtgtctccgtctgcacggctggcctattatgccgtcgttgttgggcgtctacgactccaccaccggcctgcctccatcgtcgccgactggtgtttccgcctgcacgctggcctattatgccaccgttgatgggcgtctgcgtcttcaccgaccggcttgccttcgccgccaccgactggtgtctccgtctgcacggctggcctattatgctgtcgttgttgggcgtctacgactccaccaccggcctgcctccatcgccgccgactggtgtttccgtctgcacggctggcctattatgccgtcgttgttgggcgtctacgactccaccaccggcctgcctccatcgtcgccgactggtgtttccgcctgcacgctggcctattatgccaccgttgatgggcgtctgcgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcgaccggccgcctcgtccgccgccgactggtgtcaccgcctacacggctggcctattatgccgccgttgttgggcatctacatcttcatcgccggtcgtctcgtctgctgctgactagtgcccttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaggcaatgactattcgacgacaagaagctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgcttcagaacagacattctacttcaacaacatcaaatattttgatttagacgagttggacaacagcatcaactctcctccaagtgaagcatctacaacagctataacattaatttgatggattattgtcactgacatcatcaccagcacctttgcttcatcggccctgacatctccgctgttgctaatggatgattatgtcttcaccgacttattatttcaccttcacggttgacctactatgcaaatgctgatgagcgtctttggcattatcattggttgctacactgctattggcttgatcaccgacatcgtcatcttcatcatatcggttgcgtttgtcgtcgtcaagtatgaggctaggtcttcatgattggtggatttcgtcatcgcctttgatttgcctcgtctgtcaccgactgattatttcgctgccatagctacacaactttatcgctgagcgccttcatattcattgctggctgatctgactgctgccgactggtttcttcgcctccacggctgtgcaacttcatcacttttgattggtatcactatcttcactaccaccaatatttttgccacctctgctgggcaatattatctctgtattggtcgtcttgtctctatgccaattgcgtcagctaccatcaatgaacaattgtgactacgtgctcaggggcttactagctcaaacacaagtatcataccttcaatttggacttgctctggatacatgcaatatggattcatgatcatgggtctattttctatgtttaaagactggactatttattattccccgtaagggttatcaaccgaatacttgcgccagtcgggattcaatttttatatctattttggagtattccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttagcctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattattgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggtttgagagaagattatcttttcgactgtgaaggtctcaggggctactgtggagattatgggtaccccatacccacacggcatggttatccgactagttataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaagccctctaggggcatgagacaacctgatcgtcagatcaatacaccctcggcggattcaaatccccaaacaggagtagggtattacctctcattgaagggcctgaacctgtctaaatcctttgtctccacatccatccacttttaggtctcgtgcgctaccccgttttattattgccgaattcatgtttcgacaagaacataggtttgaactttacaagtgttcatgtgcctagatgaaaccaagttcaagtacgtatcatgtattttactttgattgtaaaaaaaaattacaattaacacagtggtgtgattggatcctaaattaaataagggttaatttgatatgtgccattgtaaatatgtcaattcagataaatgctattaccattcatctatccgtatcacgtcattcgaattcgcacaaaattataaccgtaccatcaccgtcacgttttccatcatcatcatagaccaaaatatcccttgacgtgggacccacatatcagttccatctttccaccattcttccatcttttttcctcatcttcttttttcctttttctctcgatctttgtctcgctcatctctcctcctccgttgctcacacgtggcatggcaccaccgtgcctcccagtcagcactggtgataccgctgctccacctcacgtcggccgctgctacctttctccacgcctcatctactgtctcagtgtccacttcgatcgtctccatgcctctgcactctcctttgcaccgtgcaccgctcaccgctgacttcgtggcctcgaaacctccttgcatcggcgctctgctcatccccaggctgtgccgtgccaggtccaccactgcttttggatctgccagaccatgtcggatgccatcacttcacggccgatgctgccatttgctccaccaccgtcgacgctacctcttgctcgagctccaccccatcgccactgcttgctgccgttgtttgaggatgacggtggtgatggaaaacgtgacggcgattgcatggatcatattttagaaagtttcagtggcatacaaccgatatcacaaatagtaatgatatttttctaatataaaatatttttaatggcatggatcaaattaacctattaaataaatagcttaagataaagtatttaaagatcatgcctttgaagctttttagttgttgttactagacacatgcaccatgcaaagcagagtcacagagagataaaagagaatggggaatggggatggaagtagtacatcgatacctcgctggtgagtcttcggaaggagtggtggcgtccacactctgacatctgacttgatgaattttagtactaataataactagatgaaactccacacgttgctaagagattttttttatgataatagtaaaaatatttataagatagctagacataataattttatataattttcatctttgatcgattactaaataaaaagatgtaaacaagatggtgtggtttataataatctaagttaatatataggttaatcactcaaaagaaaaattaagataatgtggctcaatgagagaagaaaaataaataagataatatagattaatcatctaaaaagaaaacttaggtgatatgacttcgtgagagaagagaaagaaaaaagataatttggatataaaccaataatccaagggttagaaaaaaataaggtgatgtcttactgagaagagagagaagtggcattaactgtatttagtgggaatgaacctataactattgattttttttatttccaattgctaagcaatggtaaatcacaaccggaaaggaaagcacccaaaacctataattaccctttccaaatttgagcaactttgctactataaaactgcaaagctgtagccatcagaatggacctacacgtcaatcaattaaatgtttatttattttattttggtatctaaatcaggttagtactgaaagatcagcaaaaatcagctagcgtatgaccgtatgagttgaaatacgagagagaaaaaaatataatttacaaacaaaataatgactacttgaaaaaaaatcttaaatactgaaactaaatattgatcaaattttgaaataaatattttacacaagcatttacaagcttgaaccatagaactaaaagttcaggaaatagccagatatgtactcatttcatcctaaatatagcaatcttgtaatagatatgacacatcctagtcttacgaatttttggaagaaacacggtacaaatacaaacgctcacaacgattacgatttttaaataagtgtaggattcctgtccggattccagtcctaattaagtactccctccatcctctaatataagggatttttgacattttgcttgtactgtttgaccattcgtcttattcaaaaaaatttgaaattattatttattttatttgtgacttactttataacccaaagtactttaagcaca

SEQ ID NO: 74834 - DNA, 1129 bp, Oryza sativa
  unsure (1)..(1129): unsure at all n locations
attggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggccttggttggaaagaaacgaagtatattgatttcttggatttctctctctttattacatggcccttgggggctatttatagccccgttacagattctcacttctagggtctagtttgtatgaggaatttacatagttgcccttatgaaaaggacgtttacagggttacataacgttaaagggggttaaggggccttga

SEQ ID NO: 74835 - DNA, 6382 bp, Oryza sativa
cagggttacataacgtcaagggggttcatgggcccttgatggccatcgggcgatcgccggccctatggcctctaagcttggtgggccgagaaggctacttcggccctcgcgggggcgaaccggtcctggcgaagtcgtccttctctgggctggatgccggggcgaaccggtcctggcgaagtcgtctttcttcggcatgcactcacccgacccttcgcctcgcatcatccttggctcgtggtcttcgccatgggtttcggcagattcggtcgaagggactcatgccatccgccaacagctatgaacccgtgttcaacaattcccacgttgagccgcttaaactcttgctgcaattcctcacacatgccctcgatgcatagagcagtgcagtaacttttcctgcttaatgcgtctgccaccacattggctttccccgggtggtagtgaatgctcatgtcatagtctttgattagttccaaccatcttcgttgtcggagatttagatccggttgggtgaagatgtatttcagactcttatgatccgtatatacttcacagcggttgccaatcagatagtgcctccagatcttcaaagcatgaaccactgctgccaattccagatcatgggttggataattcccttcgtgtggacgcgactatcgcgaggcatacgctaccactctgccttcctgcattagaacacacccaagcccgtggcgagatgcgtcgcaatagacctggaaatctttcatctggtcgggcagaatcagaactggggcggatactaatttctttttgagctcctcaaagctcttatcgcactcagctgtccatttaaacttttcatctttcttaagcaactgagtcatgggtcgagcgatcctggagaagttttcgatgaattggcggtaataacccgccagtctaagaaaacttcgaatctgcgacacggtcttcggtggggtccatttggtaactgactccacgttcgatggatcaactgccatgccctgagctataataacatggcctagaaatttgacttccgtcaaccagaagtctaacatggcccagaaatttgacttccgtcaaccagaagtcacacttgctgaacttggcgtataattggtgctccttcaacttctcgagtaccagacggagatgctgctcatgttcttcttcagactttgaatagataagtatgtcgtcgatgaaaaccaccacaaacttgtcgagaaattccatgaacactttgttcatcagattcatgaagaatgcgggtgcgttggtaagtccgaaagacataaccgtgcactcatgcagcccgtaccgggtggtgaaagccgtctttggaatatcttcttcccgaattcttaactggtgatagcctgatcgcaggtctatcttagagaacaccttagctcccttcagttggtcaaacaagtcatcgattcgtggtaaagggtatttattcttgattgtgacctcgttgagtgcgcgataatcgacgcacatcctcttcgtcttatcctttttctccacaaaaatgaccggagcaccccaaggtgaggtacttggtcgtatgtaccctttctgcagctgctcatcaacctgtttcttgacctcggctagttcattggctgccatcctatacggtctcttgtagattggggcggttcccggggccaaatcaatccggaattcaatctctctcttgggtggcatggtggtgaggtctttgggaaacacttctgggtactcgcagactatgggaatttcttccaatttcctcgaattcatcccctcggtgaccactggggtttccgcctcaatctgattcaaggagaccccttgctttggtgagactagtgatttatacactattgtttctcccttctcgttagtcaaggtgactgtgcgattcgcacaatcaatgactcccttaaacttggtcagccaatccatcccaagaatgacatctaggtctttggaatcaagaagaatgatgttggctagaaatggtgatctttgaatttctattgttatagaagggctgaattgtaccgaagtggagctattccctggggtatgaacccgcattggtgtgctaagttcctctcttattaacccatgcatcctgacaaacttctttgaaatgaacgaatgcgttgcaccagaatcaaaaagtactgttgcagggattgagttaacaggaaacgtacccagtacgacctctggtgctgcttgcgcctcctttgcagacgcgtggttgacacgagcctggacaaactttgacccggcacgcctaggcttcgggcatttgtcggcgaagtggccaagctcaccacagttgaagcaggaccctggctttgctccagtctccttggcttgcgcggacgggcctgactgtgctggtgccactggtgggtgtggagctgcaccgtggttaggctgacctccatggtggttctgactgccactggcgccctggtggaagttgctagacttgaacgtgcggtgctggcggacgatcatggtggtaggtccaccctgctgtccgagagtgaagcgcggtcgctgatggtttccttggttggaccggaactgtgccgcctttctcttcctgtccattttgttgcgctgatcctcctgacggattgccttgtcaaccaacctttcaaagtcggcatagtctccagatatcagctggttggttagctcatcatccaggcctgctaggaatttctcctgcttctcggcgtcggtgcagacatcctccggtgcatatcgcgcgaggcgattgaactcatggaggtactctgtcactgtcctgttgccctgatggagtgcccggaatcccctcttcttttgtgccacgaccccgtctggcacctgcgccttcctgaagctacgacagaactccgcccaagtgacttcagtgcctggcgggcgggtggccacgtgattgtcccaccaagctgacgcaggaccttgaagctggtgtgtggcgaaagcgaccttctcctgatcattgcactgcaggagattcagcttcttctctatggcatggagccagtcattcgcctccatggggttggtggtgctggagaaggtgggtggcctgacgcgtagaaactcgggcagcttggactgaggaggagggggaccaaactgctggtgctgctgttcggcgtgctgcagcatcctctggtgcatctgctggtgctgctgctgcatctgctgcatcatggctgccatcatctgagtctgatgtgccattacttgggccagcgtcagattctcgggaaatggtggcggaccattgccggaatcactgttggggtgcacaccatcagcgcgttcttcgccgttgctgccctcgcttgtcgtgcgggtgccattcctggtgtagaccatctggaggaagagcagacggggaaacggagaaaaacagttactcaggaactaagctttattatagaaatttaaactgcaattgttctgatctgaattaaaacactttaaacagcaagcaaaaatccttattaggacagccatatcataggcacatgatatcgactgtcgactgaccccaagcaagcaacctaaacacacaaactaacaagcagaagctaggcagtcgataagctaatggaaaaccagcctaatgctcggaacggctcctgcggtcggtggagtcgaaggcgtcctcctgctcgtcaccacgtccttctgagcgactcctggagcctggcagataagtctcgccgctgcccggctctgagccactggagctgctgctgctgtggtcgcggttgccactgggagtagctggcaaccaacctccatttccactggcggggcccctgacggctgatgcaggagcgaaggagagagcagatgcaggagctgacatgggaacaggagctggagctggcgctggagctgcaggaactgctggagctgcgggcggaactggaggtgctgcgggaactgctggagctgcgggagctgctgacggaggtgggttcctaggcgcaagctggacgcgcacgggtgccgttgtcgacttgcggggcgtagtgcggatccgaactcctcctggcgcgggaagacccttcaattgagcattctccctcttcagacgcgctatctcgtccttcagagcaatgatcctcacaagcttcccatcattcaaggccttggacgccttgtgcaggtccgagtgcatcctgtccatccccctcatcacagcgcacatgtgaccaaaggtggtgtcgttctcgccggctgtcggacggaaggaactgacatcactgccgctggctcgacgagggtggaaccggtacgccgtgtcgtggaagatgtagttgtggcgctcccgtagtctggccatcatcagatatgctgcctcctgacatgcgtgatctgctgtgcctccagacgcctcaaccaccattttagcgaggcaagtccccatgtagccatggacctccaagcggacacggtgaggaagctcgccactgagcggtggaacagtcgtgtactccggcgcgttggggtagcccaccaccagtgtcatgcgtgccaactctgccacgaaatcacccatgccttctccgcggtggttgggtgggtgctcggccatctagagaagacaaaggggtaggatcaatgcatgctcaaatccaatttaaataaaaataaaggactcaaataagagaatcgaataagagcgaaattttatgcatagattattttgcatgagagcgaataaataagacggacttacatagcgataaaataatggggaaattagatacatacttataataacaagaaaagcataaataccttacaacccatattcctgagctaagacctaatgcatttcgcccatcaaatcccaactaacggtcaaaaacatctcaaataattttactaaaaccctagacctacttgtcttaacaaatctcacttaaacgagcaacaagatttgtcccttgaaccacaagaacagatccccaaattttcccggaacaattccaattgcaaagaacatatgcaatgaaaaggattcagagggcccttaggtttccatttggcttgtcctacggtcaaggtcggctctgataccaacttgtcacgcccagaaattcccgaatagaattccaagcagaatgtgcattaaaacccccgtccaggaccggccggggcacacaaacgacaatgttgacatacagatccacgtcttacaaacattataaaagtcttacataaatgcagcggaaaaagaaagataacaggagctaatccttgactggaactgcagcgagaacaccactccacaggcatccttgacggcacggacgaagcctactcctcggagaacccgccatcagacacatactcacactctggggttgggggaaaataaagcaagactgagtactatccactgtactcagcaagtcataccggaatgggggtatgatgcagggattcaacaagggatagctatacaggttcatttgcataatactggcatttataaatagaagtcgaatgcgaaaatagttgtaataattaaacgatattaatcatccactatccaacgttacaccacgttgcaacaggcccaaccatccacctataccatccaatttcattagactaaactaagatgagtctaatcacggtgagtctggttgaccgcccataaccgcgggcacggctattcgaatagttttactctgatcagaggtgtacaactgtacccacaagacatagccccacgacacgtttccatgcgccgacatgccaccacgacatatcggaaagagactgtgacatgacccttcgcataacccctttctagccaagcacaccacaccccaggtttcacccctgtccccagcgggcgacgggcagtcccctctcgtgcctaggtgaatccggaagcgacagaggccgtcgcagggcccgcccctctccatcacgctcacccttgcctggatgcgtcagctagagaaaagctacactacaagcccagccgttgcccacgctggcttgtggtaagtacgaggagttcttccagggtttcccgcgaaccggtccttaattgccatgggcgcgacaagcaaaaccatgcacccacagcccaccatgtgattcattttaattaaccaacaccagagcggtgggactaatccaacattatcatataaacctacagtctatattttaaatgagttttccccattgtgtgctagttgaactatgcatggctaagcaattcctagtccaaagtctattcatgtcataacccaagctaacaaaggagcaaggtaccaaaatagcatgggtgcaccaataggtaaac

SEQ ID NO: 74836 - DNA, 6151 bp, Oryza sativa
aagacgagtggtcaaacagtgcaagcaaaatgtcaaaatcccttaaagctactatagtagaagatttttaaagtacctctgtaatttgaatttgaattttaaagttactatattgccagttgatgtaacagcttgctcgattttcagtcatatcgaatccccaaaaattttaaaattaaactacacgaaattaggttaggtttggttatagttcggtcaaatcggtgagccgaacacacccgaaaatcactgttaggttcaggttcggtccagttcggtatgtgggccccaccggtcagcctcagacaagaaactccccaaccccatcccgtcctccatcacttcgccttcgccttcgccgccgtctcccctcctcgccgcggccgccaccccgccctcgcgcctcgcgaaccctagcagccacgccaatcgccgcgcgcgcgcgtgggagggcggcgccgcacccgggagacggacgatgtccggcggccaagacgagggctcgggtgatttgggttcgccgaagctagcgcaaggtatcgtgggggattcaactgcaattccttcttgtttttttttcttttggaatgatagggagaagggcttggttgaatcgcgtgacctagtttagtttgttcagtgattgctcttaggtgatccatatgcagcattaggctaggaatttatttcattattatcgcgaattcgttatggcctgcggtgatatgacttagggattcgatggataaatctaggagcaaaatcgagtagtgagtagttcgattgaaagccgcagagtgcttattccaaacaatgtatgcgcgtattttgtgtgaggaaaaattcgacgcgttcttaacagaggaatcgtctctctggagacatctgatagaaaccattggaatatgttattttttgggtagagctgttattcactgttcaatgttaaatggtcaatttgtttgttgttcaacaccactagagctggcagatgagtgtcgcacatgtaagaagcaagttgatgcatggaaaagaatcaacatgccaaacagtagttggaaatgtatgtcctgataacactgctgctgaagccttgataagttaattggtcaacaaggatttcagatgcctgaacggatggaataccgaattcgctagtgtgaaaatgagagcacattcatgatcacaaggtgatgacaccagattgattttacttctagggtggcagtatttagccgattaaaggtatgcggattggcatagtacacggccatcatgtagttgttcagaatggtgaatatcattcaaagaagtatgaaggtgggagtcatcctggtgtgctcctctaataactgtgcaattacctactgccttgtatatatatttacatgaaaattgaatgagactttgaacttcaggatttctctagtccatacccaatgaccctccatttcgtgcggggctaaactgatgattgtaactcatgttctttaattacactggataatagttgcgtaaacaatgtcttgtatgatgtctgaagttgattatagtattttttagatcaggtagtggtggactgccaataggtagctagtttactaatagctctgtgacattggtttggggagaccaaaggtggttgaaacactccctatattaattagagtggttacagatcaagcagtgatgcattaccaataggtcttataattcgatgactctgcttcacggatttggagagaaaattgatgttgcatttgcattgtaatgctttacaatgcagagtgcaaatgttaattaatgcatacaccacttgctgccacaactattacttgtattgtgttcatacttttatttatcgttgatagtttctactgtttccgcagaatcttaagtactccctccactccagtaacaaaaacatgtcattttggacgccaacatagtatttgaaaagcagcattgatcactaatttctattacgatgcatttttgaaatctgacaatattattatattactaaagttctttcttcagtgaatctacccctatgattttcatgcatcctatgcaaatattaaaaaatatgtacatatttaaattttgaaagtttgacttaggatatatttgaaaatcaaaaagagtggggtttttgtgactggagggagtatgatttacctactatcaatgaggttactgcaattttacaccataatattcttaactcctgtcactcaatctacttcttgtagaccatcacatcatggacttgggtgacaactctaagatcaaaagggcaagagccacgaattggcctacagtcatgtcaaagtttgtgcttgattggtaccttcagaagaagaaggagatgccacccaagaccaagttcaagaagatgcaccaccattattgcacgaccgtactaaatgctagatttgagacaactttcactgttgatcaggtccaccgccactttaggcgcttcaaggaggtttggaatattgtggcccgttatatgaatatgagtgggagtaggtttgacaagaaacacaaaatgctaatactacctccttcaactttggctagtctacctgtaagtatttttatcgttggagatgattgcagtttcactattctccaagtgcactaatgattcttttcctccttgtacagatagcagagcgtgcaattcttgttaaaccaattccattcttcgatcatatacaagctctctttggtgagtggtcagtggatgctgcccctgtgacagacccaattgaagctgctgacattaacgatgatgacatggaaatcctcgatccgttgaacatgatggcaaattgtgcagatgcaagggaccctgatggggcagacttggacaagtttgttttggaggatgaagatgactgtcatgaggtggcagcaagtagtgatgcagtgccttgtgaagtgatgtctgacactagtgcaccatctgcccagccatctggatcctttgctgagagcacaatggctgctctcaagcctggattgaagaagtgcaaagtagtcagcagaacaaaaacaaccccaaacccaaaaccgcaggcacccgtgccacatgatggcaggaaggcggatatggtaaagagtaccttagctgggatccatgacacccctgcaaaaccaatacgagcagcaccgacatcatcggacccaaatgctcctctatggaacatgctgaaagaaatcccactgacacctgctgatagactctcagttggaatttgcctttgtaaaccagagtttgaagtgcatcgaagctttttcatgaacatgggtagggagtaccttgaagcttgggcccataagttcttatctggaggtgagcctggatccttatagtctgatagcgcagaaatctggctaatggttcttacttttaccccatcaatagcaacccatagtctctgctgatggattactgtttatagagccttggttcagctgctcaaatataattggtaaatatagtaggcaatgtgaaactcatcttatcttgacccatagctgacagttcagtaatgtcgtcttgtaatttgtggacaaaggtattaacatcgtaagttggtaagctgtccagagcttacactgcaagtctacatctgatgtcccatgatgctgaaaatgattggatgttatgtgtgccatgtctttgttcagattcgagatacctataccttctttttttttccttcatctgaatgtgtccttttgtttaactttcgtgtgtcaatctaactgtatgctgtccttccttgagcaagacagctctaacctatgctgattgccgctatatacttgcagtattgctttatgaattaactgtgcaagtgggtcgacctgtcaacctacttatctctactataaaaacgaagtcatcctctttgcaccctcccccactgtgtcactccgcttacgtaatcaccgggtccaatgttcctcaaccaccatcctagtctaaccctgatgatacggtccagttataatgtacgagtatgttaccagtagaccaaataaatgggtaacttaaggataaaccaatttaattagcttataagtagattcacgtgccgatccacttatatcctcttaaatataaaatagtgcaccgaaaaccttttgccgacaaatatcttgtcaaaagattcctcgcttttgttgatagatttgtcggcaatctagcgtcgcagtgcagtgaccatccctttctatgcatagtcaaatgatgttttatacagtactcccttcgttccaaaatatgcgcattttagaatagtaccaagtcaaatatcttttaattttgaacattagtaacaaaaaaaaatttaaaacatcaatcatgtaaaatttatgttaatagatttatcattcaacaaactatcataatatgcaactcctttttatttaaaatgttttactattttagatactgttggtcaaattagcatctcggaaactgtgtcgaagtctataaatgtttatagtttgagacggagggaatatttaggtacctttctttatacatgtacgaaacatacatataccataagataataaattagataaacggaacataaataaggctgcattcgtttcaggctgttcccaacctctctcccttgttttccgtgcgcacgcttttcaaactcataaacggtaagttttttgcaaaaacttcctatacaaaagttgctttaaaaaataaaaatccatttttgaaaaaaattagctaatactccctccgtattttaatgtatgacgtcgttgaatttttttactaacatttgaccatttgttttattcaaagtttttgtataaatacgaaaatattatttcatgcttaaataacatttgatgatgaattaagtcacaataaaataaatgatagttatataaattttttgaataagatgaatggtcaaatgttagacaaaaagtcaacggcatcatacattaaaatatggaggtagtacttaattaatcacgcgctaatagaccgctctgttttccgtgcagaggagatggttcccaaccctagctaacgaacacagctaagttgagaacaaaacgaacaccagtcattatcgtagcgggcgcgggattaccctgatgggcctaaactcgaaaattaatgggcctaacttgcttctcctaatgggccaagtggcccaatctccccacgatacatggaaaggtagtactagcgaccaatgtgcgcccaagattgatctgccaccgtccgtgaaccaatctgacggccaaaactgcgaaccggattatatccagttctttttccactggacggagtgcgtttcgtatccccttttctccagtgacctgcggtagtagtactcactactacacacggctagggtttgagcgctctgtgacactgacagtgggccccacccccgcctcctcttctctcacgccgcctccgcttcgtctcctcgccggagttgagccgcgggatccgtcggagatggcgaccggagaagcggcggcggcggcggcgtcgccgccggagctggcgtcgttcctggcgatcgggcttgaccagcgcacggcggagaacgccctcgccaaccgcaaggtcaccgccaacctcaccgccgtcatcgccgaggtaaccgcgccgccctcccgcttcggtctcgccgccttgcgtttgggggactagctaacccatgcttatgcctgcaggctggtgttagtgggtgtgacaaatctgtggggaatcttctctacactgtgagcatccgtcgctgctgagttattatatgatagtagtattgatctaattaaaatctgtgaattggtgatagttagtttgtgtgttaattggttgcgcattggagtaggtcgcgacgaagtatccggcgaatgccctggtgcatcgtcccgttgtcatccaatacattgtgtcgtcaaaggtgagttctgttgtgtgtgattgtgttgtaaacactgctgctgtgtggctgagttcgtaagtgttgtgaacttgacaaattgtggtttccagatcaagacccccgcgcaattagatgctgctctgtcgtttctttctactttgggtcctgatccattggacacagcaaagttt

SEQ ID NO: 74837 - DNA, 8927 bp, Oryza sativa
gagtttcttcgcgtgaggccacctgttttctctagcaccactaatcctgtcgaagctagtgattggttgcacgccatagagaagaagttggatctgctccagtgcagagaccaggagaaggtctcttttgcgtcacaccagctgcatggccctgcttcggaatggtgggatcactcctgccttaacaggactactgctgaacctatctcttggcttgagttcaccgctgctttgcgcaagacgcatataccatcgggagtggtgtccctcaagaagaaggagttcaggtcgctcacacagggttctcgcacagtcacggagtatctgcacgagtttaatcatctggctcgttatgctccagaggatgtgcgcaccgatgaggagcgccaggagaagttcttggaaggacttaatgatgagctttcttacccactcatgactggagattatcacgatttccagaagttagtggataaggctattcgtcaggaggacaattataatcgcatggagcagaagaaacaccggattgctcacttcaaggcacagcagggaaatagtcagaggccgcgtattgcttcgggacccctgtccatgccacagggaggttcttcgtctgttgttcgtccgcagcgacaattctttaacaacaacgcgggcaacaacaaccgcaagccagctccatgtccggtggcaactccgtcgcagcaatagcctgccaagagggagcaaggcagcaagcccggtgtgtgcttcaactgtggagacccaggacattatgctgacaagtgtccgaagccctgccgcgcgaaggtcgtccctgcccagaacaactcctccgcaccagcagccaaggctcgtgtcaaccatgttgctgctgcagaagctcaaggtgctccagatgtgattttgggtacgttccctgttaactcagttcctgcaacagtgcttttcgattctggtgctacacattcgtttttatctatgagttttgcggaaaatcatgggatggaggtagaggagcttagacgtcctttgatggttagtactccgagtaaccaagcactctcctcacaacgtagcccctctgtcagaatagagatccgaggtgtacctttcctggccaaccttattctgttagaatctaaagatcttgatgtcatcctagggatggactggctagccagatataaaggtgtgatagattgtgccaatagaaaagtaactctcaccagcaatgatggtcaagttgtaactgttcatgcattgccctctgaacctcgaaggtcaagtctaaaccaaataactttggaagagattcctatagaccgggagtaccctgatgtgttccctgatgatttacctggtatgccgcctaaaagggatatagagttcagaatagatctggtgccaggaacaactccgatccataagcgaccatatagaatggcagccaacgaattggcagaagtcaagaggcaagtagatgatttgcttcagaaaggatacatcagaccgagttcatctccatggggagctcctgttatctttgtagaaaagaaagaccatacccagaggatgtgtgtggactatcgtgcacttaacgatgtgactatcaagaataagtatccactgcctagtattgatgatttgtttgatcaacttaaaggtgccaccgttttctccaagatagatcttcgatcagggtatcaccagttaaggattaaggaggaagatatacctaagacagcttttactactcggtatgggctatttgaatgtacagttatgtcttttggacttaccaatgcccctgctttcttcatgaacttgatgaacaaggtgttcatggaatacctggataagttcgtggttgtctttattgatgacattctcatatattcctaaactaaagaagagcatgaagaacatcttcgtcttgcattagagaagctgcgagaacatcagttgtatgccaagtttagcaaatgtgaattctggttgtctgaagtaaagttccttggtcacgtcatctcagcaggaggagttgccgttgatcctagtaatatggaatctgtaaccaactcgaaacaaccgaagacagttacagagattcgcagtttcctaggtctcgcaggatattaccggaggttcatagagaatttttccaagattgccaagcccatgacacgactgcttcagaaggatgtgaagtacaagcggttagaagaatgtgagcagagttttcaagagttgaaaagtcacttaatatcagctcccattttgattttgcctgatccaaagaagggtttccaagtgtactacgatgcatccaagcttgggctaggttgtgttctgatgcaagatggaaaggtggttgcctatgcatctcgtcagttacgtccgcattagaagaactaccctactcatgatcttgagttagctgcagtggttcatgcgtcgaagatttggcgtcactatcttttcgggactcgaacagaggtgtatacggatcacaaaagtttgaagtatatctttacccagccggatctgaacatgaggcagcggagatggttggaattgattaaggattatgacctgggaattcattattgtcactcccagaaattcccgaatagaattccaagcagaatgtgcattaaaacccccgtccaggaccggccggggtacacaaacgacaatgttgacatacagatccacgtcttacaaacattataaaagtcttacataaatgcagcggaaaaagaaagataacaggagctaatccttgactggaactgcagcgggaacaccactccacaggcatccttgacggcacggacgaagcctactcctcggagaacccgccatcggacacatactcacactctggggttggtggaaaataaagtaagactgagtactatccactgtacttagcaagtcataccggaatgggggtatgatgcagggattcaacaagggatagctatacaggttcatttgcataatactggcatttataaatagaagtcaaatgcgaaaatagttgtaataattaagcaatattaatcatccactgtccaacgttacaccacgttgcaacaggcccaaccatccacctataccatccaatttcattagactaaactaagatgagtctaatcacggtgagtctggttgaccgcccataaccgcgggcacggctattcgaatagttttactctgatcagaggtgtacaactgtacccacaagacatagccccacgacacgtttccatgcgccgacatgccaccacgacatatcggaaagagactgtgacatgacccttcgcataacccctctctagccaagcacaccacaccccaggtttcacccccgtccccagcaggcgacgggcagtcgcctctcgtgcctaggtgaatccggaagcgacagaggccgtcgcagggcccgccccactccatcaagctcacccttgcctggatgcgtcagctagagaaaagctacactacaagcccagccgttgcccacgctggcttgtggtaagtacgaggagttcttccagggtttcccgcgaaccggtccttaattgccatgggcgcgactagcaaaaccatgcaaccatagcccaccatgtgattcattttaattaaccaacaccagagcggtgggattaatccaacattatcatataaacctacagtctatattttaaatgagttttccccattgtgtgctagttgaactaagcatggctaagcaattcctagtccaaagtctattcatgtcataacccaagctaacaaaggagcaaggtaccaaaatagcatggctgtaacaataggtaaacatcccatagtgttattgcaaaacaaatgcactatttgaaggaaaacaatagaacatttgcaatgtaggatcaacatgatcaagtgacaagcatgacttgccttgctctgctgctggaggaacctcggcgactatttcgaagtatgccggagcgtcggaagagccggaatctaacaacatacaaggcaaacaatgcaaacaagctataagtctactgaaacagagaacaaaaccatttttaatggattctacacatttttcttgatttactgagacttgaaggggcttaaacggagctcggatgaattagttatgaattttagaagattcactgtgtttattactataacaaaaagtccttaaataatttattgggcaataattcccagggctgacgtcaccaagggggggcggcgccgacaggtgggtcccaccggtcggtggctcgggagagagggggaagggcgccggcacacgggccccactcggcagtggctcaagggggggcggtccaccgtggaccgggaccacgcgggtggtccaccgccggtccacgggaccgacggcccagatcggccccgagccgatcgggcggtgccggtagaggcggccgccgagctcggctcggcatcaaagccggccggccagccatggctagtggcgacggcacgcggccgacggcgacggcgaacggcggcatgggaggtggcggcggcggccgaaggcgacggcgcatgacttgaagcggcggcacggcactaggtgggagaggaaggggaaaagaggggagggatgcctcaccgcgagtggccggcgcggagggagacgacggcgagctacgggaagacggcggcgacaggcggacgagcttcgggatgccctaaggaaggaagagagagagattagagggagggagttgaaccacggcggccggcatccatggccaaaggcagcggtagaggtagagctcaccggagcgcgaggggatgcggattccggcgacgaatctcgacggggaaggggcggacgaggtggagttcggcctcgcgaacccgacggcgatggcggcgcggtgcggcggcgaccctagcggcggcttgcggcggccggagtagcgggagcggcgacggcgagtggttgcacggcgcgagggcgatggagagctcgggagagaggggcggcaaaaggaaaaacgaggaggagggctcggggatggattttataggggcgggaagatcaggaacggcccgagcacgcccgatttcgccggcgacgtgggaggtgggaggtggagagagagagagagtggcgggattcaaaaaacgaatcccgcccatctcggtagagggcgcgggtgggagagagaggggtgggcgcggggaaggcgggggcacgcgcggcgtggccgaagtggcccggaggaggcggggcggcggtttcggcggcggcggtgacgtggaggggcggccggaggttggggaaggacccgacaggtgggccccacctgtcggcgaccctgggagaggagggaggcggggcggcctggctaggcctcggcctgcggccgacccagctgggaggggggaaaaggagagaatgggccggcggcccattcgaaaagggaaggggataaagaaaaagaaaaaggaagaaaaggattttccctggaattaaaatattgcttgctcaattttaattggttaaaattatttctagggctctgaaaattccactaaaaatcttgttagcgaatttagacatgtagaactcaagaaaaattccacatgccagattcgattattttttgtattacattcttagggttttctcttgctttgcacctgcattttcttagggtcatttataaataaaattttaggcttgggaggagaacttcagggtgtgacaaacctaccccccttaaacagaatctcggccccgagatttggaggagctggcgaagaggtgtggatgggcgacttttaactcgtcttccctttcccaggttgcttcctcctcagaatggtgactccactgaactcggcaaaacctggtgaccttgtttctggttcttctttcgctggtatcaagtatatgaaccggcttttccacatatgtcaggtcctcctggatatcaatatgctccgaatcagcctgttcttcgggtactcttaagcacttttttaattgggacacgtggaacacgtcatggatgccgatcatattggatggaagttctaactgataagcaacttccccccttcgttccaagattttgtagggtcccacgaaacgtggtgctaacttgcctttggtttgaaaacggtgcactccccggagcggagtaacccgaagatacacataatcccctgcttcaaaagtgagctcccttcggcggttatccgcgtagctcttctgtcgagactgggcaattctcaacctttccctgatggttctgactttctcttctgcttccgttaatacctctgtcccgaacaattgccgctcgcctgtctgatcccagaagagaggtgtgcggcacttccggccgtataaagcttcgaacggtgccatctgtagactagcttggtagctgttgttgtacgagaattccgcatatggcaaacttttgtcccaagctccaccaaagtcaagagcgcaagctctgaacatatcttccaaaatttgattgactcgctcagtctgaccatctgtctgcggatggtaggcggtgctgaaatttaaacgggtccccaattcttcctgcagtttctgccaaaattttgaggcgaactgactccctcggtcagattcttgggtaccccatgcaaacacatgatccttgccaggtacaactctgccaatctctttcccgtataggtggtatgcactggtataaagtgagctaccttggtgagtcgattcatgactacccagattgaatcgtgacccgatgatgtccggggcagtcctgttataaagtccattccaattttctcccatttccattccgggatttgaagaggtttatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaatacgacctttaccacaacggtgccgtccatggatcaaattatttcgtggattggatttcacttgcctatctatggttcccttgcgtgtgctcgggatagg

SEQ ID NO: 74838 - DNA, 3484 bp, Oryza sativa
aagcttttgaaaagttgatgaattcataccttgcagggctaaaacaactcttatgttgataagagtcaaccacaatttattttgcacatactatagttggctgataaatcaatagtccttcaaatgcccattttcagctcactgttgtttaagggcctgcgtttttttcccctgcaggggtggttgtttcaactgaagagattcagtcaatggtcactgatatcctgaaggaaaacatggaagccatagttgaacagcgatatcatataaatggtttgttttctgcttcattttcattttactttgttattgatggttttgttttatctttcgatttgtgatgtcgggaaagctgggcatcatttgctcctgactttcttgttttccagttggcagcttgtgcggacaggttaggaagtggcacccctggggcgatgctaagttcataaaggtttaatacatttcatggctgaaattatggagttttttgtttaattgctactatttattactagtaactttgtgatatggcttgtactaattacttctgttaatctacaggaggaaattgataaaaggcttacagagattcttggtccaaagacagaagctgacaatgtaaagcctgtgaaaaagaagaaggagaagcccgcaaaagttgaggtttgttacctgaaattcaatcaagttttatggcaggactgtttagttattagctctgcctcatccagttttgtttctgacaaaatataggagaaaaaaactgcggtagctgctcctgctccaccatctgaggaagaacttaatccctactccatatttcctcaaccggaggaaaacttaaaggtaagatgattgttatataggatatgcaatgatactccatattcctcaaaataaagaattctctaatggccttgaagctgaaaattgttctttacgagtaggtccatacagaaattttcttcagcgatggaaatatatggagagcacacaacagaaaggacattttagagaaacatcttaaagcaactggaggaaaagtgatgacccgctttcccccagagcctaatggctaccttcatattggtcatgctaaggttgtgactatccctttcacctgtgatgtcaattctgcaaatgctggtttctcaaaatctgaaatgatgcttacaagatttttgatgcacaggctatgtttattgattttggactggctaaagagcgcaacggacattgttaccttaggtacgaaggaatagttagatgttatggttccaaaggagccttcaagtccattgatttgcccttttcttccttatatggacatactgcattgcaaaacatgctgacatgattaatatctgaacaacaggtttgatgatacaaaccctgaggcggagaagaaagaatatatagatcacattcaagaaattgtccgatggatgggctgggagccttataaagttacctatacaagtgactatttccaagaattatatgaacttgctgtttgtttgataaagaagggactagcttatgtcgatcaccaggtttgttttccttggattgatagttgactgcattaatcatatagctttttaaattgttatcactgaacgcctcttgagaaagcaacagtatgtgtaaattgactattgtatgcttgccagacaccagaagagataaaggagtatagagaaaagcaaatgaatagtccatggagggataggcctatagaagagtcactaaaactgtttgaagatatgaggcatgggttggttgctgagggaaaggcaactcttaggatgaaacaagacatgcagaatgataacaagaacatggctgacttaatagcatatagaataaaggtaaacaattcgacattatggagttactgttttctgtgaagtgtagaatttaatatatttctatatatctacacagtttacacctcatccccatgctggcgacaagtggtttatctatccaagctatgactatgctcattgtttggttgactctcttgaaaacattacccattcggtaatagtttctctctaactacttttggttgtgtgagccttaacatgttatcagttgaaattatcagttgtacacactagaatttgacatatggctgttgcaatcaccagttgtgcacactagaatttgacatacgtcgtccttcatactactggctgctcgtatccctggaccagtaccagccatatgtttgggaatattcaaggttaaacatatcaaacaatgttatgtccaagcgaaaggtatagcgctgattcttgtggagaattatatcaatcttatgatccttgatatatggttctataatatggattggatttgcagctaaataaacttgtgacagagaagtgggtagatgggtgggatgatcctcgcctgttgacacttgcaggactacggcggagaggagtatcatcaacagcaattaactcctttattcgtggaatgggcataacaaggaggtaaggagaaatgttttacccaaagacatgcttccatctttcgatatcagcagaactttttctagttgtcaacataatatactgataccattattttatcctttcaatgcagtgacaacagtttgatacgcttagaacgccttgagtatcatattagagaagagctcaacaaagtagctcctcgtgctatggttgttttgcatcccctaaaggtttagcaattggcattctctttttttttttggcaaaagttttgttatttttctctttgttaattgacgcactgatagtattttcttttaatttggtaaattttaggttgttataaataatttagactatggaacaataatagaccttgatgcaaaaaagtggcccgatgctccaggagatgatgcttcggcctattacaaggtaattcttatgtctgaatgacttaatcattttgagaattaaaaatctggtttagtggttacagagtccctttggttctgcacttctgctcaaagattagacacattgagcaatataagttcatcacttctctgattctggaactgtggtcatccctaggttccattctcaagaactgtctacatcgagcagtctgattttcgtgtaaaggattcaaaagattattatgggcttgctcctggtaaaacagtactactaaggtactagtacattatacatctgtagactctgtacttaattagtttgcttactttgtatactttgtggtctcatctatgtttgccgtctgaaactgataggtatgcattcccaataaaatgtacggaagttatctatggtgataattcagataatatcattgaaatccgagctgagtatgacccttcgaaggctacaaaaccaaaggtaactaggcaattgaaattcttttagatcagatgagaatattattctgctatttgaatttatgagatcatgatgttgtgtacaatatgtagggtgtg

SEQ ID NO: 74839 - DNA, 8837 bp, Oryza sativa
actcttgagcccactagatggttgtaataattacttaaccagatatcaatttattaactaaaagaacaccatcctataaatacagagtgagggtgcatgggggaagagcaaacggggtaaatatgtgctaagtactaactactaacagggagtcagggatgtaagcgaggggcagggagtaaaacagagcagtagagggaggattatagtagatgagatgtagaggagagggaggaaaaccacaacatagcagcaaatgagggagcagagtagaggatgtagaagaggggggaggaaacaccaaaacaagcagcagaggaaggataagaacagggtagaggaaggagcaaagcaggatcatgtagagcagagaaagaaacagaggaaagaagagggtggaggaaagaggagaaagaagagcgtgcctgcttagtttttgtgtcaatggtgaggaccaggatgatggcgcaggtgcagaggaccaggacgatggcgcaggtgcagaggaccaggacaatggtgcaggcacaggatagccgcaggcaacaacttggatcgccgccagggatggagatgtcgcgagggatggatcgccacagcctcagactccagcgaccctctttctgttgttttctccttgatttggtgggatatggtgcgtggggaccttttcaccccaaaaattggcgcttctgttagttctgtttcacgcccagggcccatggcgccaattttttcgggctcttcaaccaatcgcggcaaaaaccacgccctcgacttcctgtggcgttgcctttagccattgtagcgcctaaggacgcaatatcgacgccgtagcggcgccttgggcataaggcggacgccataagcaatatggtaaggcgggccagacgccctgactcctggcagcgccttaccgctatagcgacgctatggcgatgccttgacaaccagcagaacattgaataaggtatcaaatatccaattgttgcaattatgctgttatgggcctcatcgcaggcagttaagagtatactagcaaatacgcagatccaattagtacttgtttgatttgatgactagctttgctctcgaatgtcataattgatgactagtataagtttacttgcatcaagatataaaggactttacagatatgcagtatatctgaagcttatttaatgcttcatacaatttatgtaaatacttaaaaagatcgacttcttttgctacttgtgtggaagcacttatgtaccttagaatagcatgatattgttgtatctccatttgttttactttcctaacattttccttttatcatgtacagtttatgctgatgggagcatatgcttagatatactacaaaaccagtggagccccatatatgatgtagctgctatactcacatccatccaggtagatgatgccttttttgggggtattagcatgtcatgatgtcctgtcatgtttgttgcaatattttgtatcatgtttataattcgtgcttctgattttggtcctgtctttaaaaatattgagcaaactcaccaatctagtataagtgaattgtcactaacttaattgttgtcgccttaaaatacacatggtgtttccttatagatagtctgcttttcctccccacatgctccattgttaagtagtaagctatattcacttgaataattatttttctttgttagaggcactatcacgcgatatacctgtggaagggtttcatcttgagagtagagatattaggcctctgtgactgattatcactattcagtattaagtgacattggcacgtggggtatatatacataaaaaagaataatatttccagcctctgcttagtttttgattctggtgacaactatatataggccacgaagagtagacggctaacttctatatgtaggcaaacttctataacagtaactttagtgtggtgaggccgcctgtcaataacaacatattatctttatatgtttttcatatacatggtgatatttattaatctatgctctatggaaaatagtatagaacacaataatttttatatcagttgggatacttgcatatcttgcttctgtgaataacaaatgcatatcacaacaatgcatatttcatggactcaagacattgacatattacaggcaatttcattgatttaactgttcagtacttctatttcctgctttgtattatttccagtcgctgctttgcgatccaaacccaaattcacctgccaactctgaagctgcccgcctattcagtgagaacaagcgggaatacaaccgaaaagttcgtgagatagtggagcagagctggaccgcggactgatccactccatctaaccatatgatgcctgatacttaaaacgctcatcttttcagtgtgtcgtgtaccaaactgcttgtaattaaaatgctaaaacagtaaaacgtgcttactgttatgtatgcccttcccgaatacgaggaaggctttggaccatgttgaggaccatatggacttcttatataacatctattgttgccagctactaagtgttaaatgctatattgagtacgaagccgtgcctaaaattcaatgagtaattcttttcgccattcaaggaattacctcgtgggctatatgtattttatgctctagttccaatatctatctttaccttgaggattaaccaatatcgagatggattcaaccggaatgcgctcagacgtgtgagtgtacttgtgtgtgagaaaaaaaaaagacagattttttcagtttgtcgtctggaatttcaatctggatgggtagggattaatgcaaaaatctgaagcagatataatttcactgatgcaattctttctgcggaaaaaaaaagctttctcccgttgagaaagcccaagatatttgtatctgctcagcccatctcagaaatatactggggccgatattttacacctgattttgggcccataactaggcctgagcccatgtagccttccgtgaactcttgcgatgtccccacctgtcagtctccgctcgctctcccgtccaaacgcctatattaacgcgccgcgcgcccccctctccctcccaaaaagccaaagccccacccaaagcggcgacgcccctctctctctctctctctctctcttctcttctcttctctcctccacgtcgcggctcgcgcctccaaatccccccccgcgaggcgagcagggcgaggcggcgaaagcgcgacgcgcgagcggatcgaggcggcggcgtcggtgccggcatccaccgcgtgcataggttgcgtcggcggcggcggaagcggggcgcgatgacggacggccaccacttcaacaacatatccctcggcggccgcggcggcaacgtgagtgctactcgtcgacttggtcgaaaaattcgcttccccctcgtcgaatcttcgcctccgggcttcgtttcgttaggattttgtggcggcgttgtctcgctcccgtggaggcggtttccgcggacgggcttgactaccggaatttgtggcggcgattgattttgtttttttttggtgtggcgggcggttgatttttctagggtttgcgcgctagggtttctgcttggaaggggggaagtcgaaatgaattaggaaaattttggtggatggactcgaatattgtaaggttggctaggcaaaacgaattattctgttgcaaatgcggcggtgaaaagcattgtatggaacaattttggaagttaaattaattgtaaatattcccaaaccctgggtttttgataatctcttcattcaatatcctttcactagtcgaatgtctcatgaaattgctcctaatatctagttggcttgcgtttggcgcacattttagcattcatcctgtggttatttcgtccatcactgcatcaatttatttaatcgcatcttatgtcctacataattatcagtattcttcaattttaaataccatttatcttcaatttgcttgctttgttaaatgatttattcctcttatgatttttttatcacatgcctgaaacaaatcactttttgcagaactaaaaatgttttcatctgttttgttcatgattttttttctggaaatagtggatgcttatgccatttcccattgcaaataggaatatgtatatcaagtttagtctgatatcaacgccaacttttccatcatcattatttgcttgcccactgttagtaacttcccttgtaccttgaggtgctgaaatcttctgctactgttattgtttgggctcttgtagaaccctggccagtttaaactttattcgggaggacttgcatggaagaggcaaggtggaggaaagaccattgaggttgaaaagtctgatatcacttctgtgacatggatggcaatccccagatcctatcagcttggtgtttcaacaaaggagggcctcttctacaggttctttggcttccgtgaacaggtaatacttcctcctgtttttcctaagaaaattaggtcttcccaaacgtgtatgtttctcatagataacttttattgagctaagatttttcttctaatttttaggatatcagttcattgactaacttcatggaaaagaacatgagaatcacaccagaggagaagcagctttctgttggtggacataattggggcggaattgaaatcaatggttagccaaattctctatattattccgttgctccattgcctttctgcaacgtttggtagtttgattgctttccatgttatttccatttcaggcaatatgcttagctttaatgttggttcaaaggaagcatttgaagtctctctagcagacgtagcacaaactcagatgcaaggaaaaacagatgttgttctggagtttcatgtggatgatactactggtggtaatgaggtatgtggtttatccagatatacatttctctgcatccaatttcgcccatattttattagatgctacttttctgtttgttaggtgcaattggttataagtaatcaatttatgtttatcaatctgaagaaatgtggatgtaacaattgtacaagctatctgttacatttcagtgtcatgtattattagctactcaactgtctgccttgtaattaaagagtgattttactgtcctgctttttcattctcatttgatggtattgcaagtaacacactcccattgttagagaaaaaccatttcataaaattttggggtctttatttgtgctgaagggcatattgatcattgttttccaccctactacatattttggagggtctttatttgtgctcagaatattattaaggtagctaagctaatcgttgacaaaaaaaaaggacagctaatttcaacttcctttccttcttttaaatgtagaaagattcattgatggatttaagctttcatgtaccaacttcaaatactcaattccctggagatgagaatcgtccttcagctcaggtgagtttgctcaacaagcatgcaagatggacaacatacacatgattttattgtgcaaatggtgaaatcctctcctttttttaggttttatggcaggctatcttgaataaggctgatgttggctcatcagaggaagctgttgttacatttgatggaattgctattcttactccaaggtgggtaaatcatataaccatagagactagactttttagaaataaggacatcattcaatgttattgtttcaattttctggaatagctaacttctccttttctattcagaggtcgatacagtgttgaacttcatctgtcattcttacgactccaaggacaagctaatgatttcaaaattcaatatagcagtattcttcgcctctttgttttaccaaaggttctgccccttttatatttttattatgctgtacttgttgttaactttgtatctgacaaaaaatcctatgacttttcaccttggcagtcaaataatcctcatacctttgtggttatcactcttgatccaccaattcgcaaaggacagacattatatcctcacattgttattcaggtgttgtattagaattcaatttgatactaacttggttacagtttacggtaaccttccaatatgcatttggtaaccattttctgtatttatgaatagtttgaaactgaagcagtcgttcaaagggatctgacattaagtgatgaggttttggctgaaaagtacaaggatagactggagaactcttaccaggtgatgtattttgtttgcgttcaatcaagtctgacattcttcatctaaaaagtggatcctaattcccggctcatgtagttttgcatttctttctacatctgagcatctgtagaacaaaaaaaaaagtagtttgggggtgtgaatcattttaaataactgcttccagcaatgttatttgttcttgtttgttttagtttcttgtttgtagtcatatgctctgagctgtatttattgtggtaatgtgctgctggatgcttgcaactccaggaatcatcagtgcactgattcccaaacttgtgattcatccgtttatcactgaattgcttgttttttttctatctactcatgactcctgtttgactgaattgcacaagctgctattgatgtgatgaactgcttctgtggcattactgccattgagtctatcattatgtattcctttgtgtttgcaactttgcatgagttatagggtcctatagcttttgctcatttgctatttttaactcctgatagactaataacaaactcacagaaagtatttgatttatctatagggtctgatacatgaagtgttctccaaggtccttcgtggcctatctggtgctaaagttacgaggccaagcacgttccgcagttgtcaagatggatatgcagtgaaatcatcactcaaagctgaagatggttgctctatccgctggagaagggcttcttctttctaccaaagcccccaacactcattctgcatgaggaggtctgttttctacactgctgagatgattgataattccatccatttgtcctgttttaagctgtagctctttatggcagattgagtatgttgaatttgagcgacatggtgctgggggtgctagtatctcatctcactattttgatctcctggtcaagctgaaaaatgatcaagaacatctattcagaaatatccaaagaaatgaataccataatctcttcaatttcatcaggtctgtgctttatttagctgattccaccatcattggtttacttgcctttttgaatagaagtatgaagctgataagtgcctttttgtaatccctttcaagtggcaagcatttgaaaatcttgaatcttggagaagctcaaggtagagctggtggcgttacagctgttcttcagagcactgatgatgatgctgttgatcctcatctggagcggatcagaaatcagactggcgatgatgagagtgatgaagaggtatttcctgcgtttaattgttgatcctacttatcatgattccatgatctgacttatcaatcctgtcatagcttggaattaatttgtttgtatcggataatcttcaacttcaggatgaagattttgtggcggacaaggacgacagtggatctcctactgatgattctggagaggagggttctgacgctagtttaagtggaggagaaaaggaggtaactcattttactcacgcaatatccctgatcagtgtctataatgaatacatcatgctaatcaacattactattccccccctccaaagaaatcttccaaaaaggaagctagtagctcaaaggcgcctttgaagaagaggaagccaaagggtggggatgcggcggaaggctcggagaaaagaaagccaaagaaaaagaaggatcctaatgcccctaaaagagcaattgcaccattcatgtacttctcaaaagctgagcgagctgtaagttcctttccaccctgcactactgtacagaaattccctgactaatcctatgtgaaacattgtgggaggatctctctctctctctctctctcacacacacaagcaaagaagggagcttacgatcgtttttcccaaatgcagaatctgaagaacagcaatccggagctggctaccacagagattgcgaagaagcttggggagaggtggcaaaagatgacaggtaacattctttgatctctatgctcgacaatgtccatgctggtcggtcaagtcctccgagacctccgtttgaaccatgtccgcttcgtgtaacttgcagccgaggagaagcagccatacgtcgagcagtctcaagttgacaagaagcgctacgcggaggagtcagccgcctaccgcggggcggctgccatggatgtggactccggccctgcttcggactgaagagaagagacctgaattgcattccagattacccttagtctaggagggcgacagacaggatacggctagtggcatctctatttccatgtaaataaaacttatgagttatctggatgtaaataaaactatcgtaggtatctttcgagtcccgttctatgagtgtcttatcgctttatcttagctatatatatagatagcagctatagtatagtagagttcttcccgccatttatgctggccggataacttaccttcacctatgtagcagcaataagcatgcttatctgcttagttaaattataaatgcgtgttctagctggagaatcacctctgttgtgttgagcttgtggagttgcctgtgcataacttgttcgggattaattcacatatacttgctaggtttaaaatcatgggtaaatacatttatgaaaacaagcgtatcagtagaaaatttgaagagttaacgagacttgtcct

SEQ ID NO: 74840 - DNA, 9615 bp, Oryza sativa
taagcaagcaaactaacacagcgaactacggcaacggtctaactagacaactactctcgccttgcgtcggaacgaagagatggatcttcctcctctggagtagctggctctctttcttttgggtcttcctcttcttcctcatcacttaagacatggatgacaggttcagcatgatcaggcacagcgtctcccaccacacgagtcttcgaagctaactggagacgaggtggtagactggttctcttccttgcggtgaggcgaagcttgggtgctggcggtggtgcttctcccttaagctcagctagttccttctgcagacggtacaccttgctctccaacttacaaatcctgccacggttccagttttccctatcatgagctgctttctctcgctccacgcctactgcatccatggcgctaagcatatacacggcgtgcatcacagtggcgctaccttcaccttcgggacagttgtaagttctatagtcttgaccatgtggcttgtgtgggtgatactggaaagctgatgactctaactcctcatcaaagcgatgacgtagctctccaatggccaccaaggctgtttcctgacaaacatggctgtacttttttccctcagcttcaaactttatcgacggaaggtcttcacgatcactagtcaacgtcacgcgaacacgacacttctcctcgttggggtcatggggaatctggcgatactcgggggcaacctcgtaacctacttcaaatgccatcattctcagctccctgacgaatcctagcacctcgatcaagtttttcggcggatgggcatctaaagcaacatggaaagaaggaattaatgcatatttttaagttagctgcacaaactagacttaattaaattggacccaaagaaaaagaaaataaaagaaaaggaacaaacatgactcaattttttttctttttggaacataaatcaaccttgaacagagacaaataactttacacaaatgaataaattaaaactaaaatatttaggatctaccaggagcacggtacagtgtcaccattaacagggatgagtagtactgatgccatcttgattgaatcgataccataatagatgtacagtgccgactaaccaatgaaattcagaaaattaaactatttaataccctgaacagtaaagttttttttctttcaaaataaaagaacaaatttctgttttggtaaagtagaatttaataaattttgtacataaccttgcatgtgctgccaacttaattaatttataagagaatagagaagggcagttctattttccaaaataattagaaggcaacttaaggtttaccatttggcttgtcctaaggtcaaggtggctctgataccaacttgtcacgtccggaatttctatccaaaattccaaacgcttacatgtgcgttaaaccctcgtctaggaatcagccgaggcacataataacaaattgataatagagtactatcaaataactaattaatatgcgcaaagtaaattattacagaggtggatagttcctctcaaagaataaagttctacgccgcggaaaaaaagcaaaagactaaacatctatggcgactccacttcacaagcaactcgacctgaacaaagcctaatcctcctgatcatcaccttcactgaagcactcctcctctaaagaatgaatattgcaagaatgagcatatgacatactcaacaagccacacagcaaatatgcaaatgcacaggataacaaaggatggcataattaagctcattcgcataaacaacatttaataaacatttgagagaatagcaaaacagttaagtaattaagcaatattaaataaacactatacaacacacccatgttgcataggcccaaccttatctgaacaaccaacccctggttgtacaaatcaaacctccaaaccaggaatataccattccaaaccaggagtcaatttagttatcatagtattttcatttatggtggtacgaaaaacattgttagacccacccataaccgcgggcacggctattcgaatagttttactctgatcagagatgtaccactgtacccacaagacacaactccacatgtcaccatgcgcctcagtaccaccacggtaccttggaaacgaactgtgacaatacctctcacacaacacaactcaccacagtgcaccgttcctggatcataatctccccctcataaccagaggcaatggactccccagcgacccccacggacttctcgccgcttcacagtctggcaccccataatgaatcatgctatacaaaaggtaaagccgttgcccacgctggcttgtggttggcacggtaaatgtttcacaacagtagctcgtgaaccggtccttaattgttgtaagcacgaccatcaaaaccatatactcacaacccacctttaatcaggtttatgtatcaattaattatcataacacaattaactatcgtgagctaccactaaatataaccataactaatatcgtaatatgattaaccccattaatgagctaatgtttctaagcatggctaagcaattatacctatatagcacttagctggagcaaaccaatatataaggtcaaagctattcaatttattacccataggaaaataaagtcattgtcggccattaattaactgggaaaggctcaccacccgacgacattcgaaaataatgcataagttgaaataaaatattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatacgagttacgatgatttagttatgaatttccgaagtttaatcgattttcaactaataaaaaggatttatgacgtcatcgatgacatcatcgccggccatggcacggctccacgcgaccaccggcgatagagagctcggttgggctatccgaggacacctacgtgaagaggacgacgacgcgaactcaccggtgcaagaaactatgacggacgacgacgtacggcgaccggcgacgaggaccaacggcggcgcggctcagctcgacgacggcggcggcgttccagcggcttgcgacgacggcgaaggggcggccaaggtactcctccaccgtgcgaacccggcggcggcgacggacagcgacggcgacgacgctagcagccgcgcgacgtcactggagagtcgccggcgacggcggcggcttgagctacgcagcggcggcgctacgagcaacggtgagacgcgggacttggggcaaacggaagaggacgactaggggatgctttatataggcttggattagagagatcggactccaaccgagaggaatcgagctgggaaaaactagggttagtttggagagataaactcaaaacgaattcgatttggtttattcgggcaaaattgacctccgaaactctaggggaaagggagaggataaggaggagatgatttccccttaagcaatcagactcggggacgaccggttgaggaggaatcggaggagaggcggcggcgctcgggctcggctcggcccggcccgaggtacgggatgaccccgacatgtgggccccacatgtcgacgactagaggagacgaggggcggctcggcttggattggcacggcgtgggctgcacggccacgtgcgagggagaaggatgttgggctggaaacggccaaacggcctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagttcaattttatgttgaaatttttcctagattataggagtttagcttgtaggtttttaaaataatttctaaaaatgcattaaaaactgaattattaaattaggcgattttcagggtgtgacattgatatagtttaaacatgtaggttacccaatctttaattttgggacccgacaaggtgtgtgggtgggggcccctgcgatttgggagcctagagcggctgtaccgctccccccccaagcttgccctgaatacatgggccttgaaaggccacatggcatcttatgacgatttctgggcttgatggcgacgaaaatggacgtcatagattagtaacaaaaagataagctttctttatagaatgccattagagatgcatgataggtaacgaatgatattcgtcacacgaatgtcacagagttcacaacatagtgaatcatctatatatgggcctatttgtcgtccaaatacctgcaaacaaccttggtgaatcatctctttgatcctaaattatattttcaaagagacaaagaaacagagagagggagttaaagtccaatttacacccaaacttcaccatacctctcatcttctcctaggaaacatcaacatggggccactagacagccactcatacttggttgagtgaagtacaagtgggatcacaggctcaaaccactgccaactcctttaaatcgtttctacccctcatgttgacaactagctctcactttccacctttactttcaccattcactactacaaccaagatttttgtgtgagggctaaaacgatttttgcgtgcgggtaggcggcctgcacgcacctaggggtctgggaacatgacgatttttgtgtgcgggtggcgcaacccacgggaacacaaaaatccgaaaaaacataattttttttaaaaaaacgaaaccctagaatccggcggtaggctttcgcccgccgcccgcctgccatagtgcagcctgcctcccgccggcctccgcgccacccgccgtcagatccgcactcccctccggccgcacagccgccgacgcccctcccctccgccagatctaggcacgaaaggaaggggaggggaggggagctggatctcgcgcggggacggccgccaccggatccgtgcgtggacggccgccaccgctggattcttgcgttgacggccgccactgctggatctgcgtagggacggccgccgcccgctaggtcccacgccctccaccgccgccacgtggaggaggccggcgcgcgcttactcccaccgccgccgcaccgctgctgtcaccgcgcgctgacggcgctgccgccgttggaaggagaggagaggaggggagagtggagagagaggagaggagatgcgtgagagagagaggactgaggagaagctctacgtggaaattttaaagtggaaaaagggatagaggggaggggagaggagagaaagaggaaaattttaaagttggtgagaggggaaagaggaattagtatttttgcatgcggctctctcaataggtccgcatgggaagatcggctcattttcgcatacagtccatttaagaggaccgcatggaaaaatagatttttccatgccgtcctcttaattgaaccgcacgcgaaaatgagccgattttcctagaagcaacgagttaccgcccgcacgaaatataaaagggtccctgtccaggaaaatcgtttctatattagtgattcgagaagttccttctctacctgatcgatccattttctttgtttccgttttggcatagattgaatacttggtggtgcactcgtcggcgttcccggtgtccagagcaccgccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccgttgagtcaccgtaagtgagcccgggtgtttagccacttcattaggcgctaaggactttaattagtagaaatttaaattttgtaaggttctttttttaaaattgctttgtatgccatgtgggcatatggttctaaacgcaattcacctaatacccagtgacctttttgtatatggtttagggtaagccctaaaccctactcagaaattactatttcatggatttattacttgatataatagcttgatgagtatatcgtactcacccttgctttaaccccctctttcagaatcaatttggagtttttgccgaagccaggagtttaatcatataaattggtttcattccaacttagttcccaagtatagattatatagatggtttaattctatagcaaaacattagagttggctcatcctatggcttctacggtaatagttagccacaatcttgtaaataccctattattttatgtaaagaaatctccattggagccttaatcaaatgtatgcgatgaagattcagattgttgaacatgtatcaatctactgatccaggggttcatatagtttaaacatttaggttaccgaatctttaattttgggacccgacaagctgtgtgggtgggggcccctgcgatttgggagcctagtgcggctgtaccgctcccccccccctaagctggccctgactacacgggccgtaaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttatgacgtaaatgagcgtcacctataataagatctattgtagtgatggcttgtttggctattagagagacagtttgagacatacaacacacagagctaattgatcggcgatccacttgggtttctggtgatcatatgcaacatggactaagctacttggatttgttcaaatgatctgcttcttggatgctgtccggccacgtcgacatgcatgcgaattttgtggatgagtcagaggctgcattcacggagctgatttaattaattaacttgttgccagctagtacctaattaattaagcatgtgtgaatttactattaactactttggtagtgttaatttatccttagttttttttattccaaactactagcatgcatgcctttgtcagagagagaaaccgatggaatatgccttgttacaaaagtattgtgcatgctgtgtggattcgtactgtctgcatgagtttttatattttccggggtagagaagataaaagaattcaacttgccaactaggttttttttagagtctggcacatcgtcgaccatgctgcttccctttatcggacctatatacgttaggatcaaatgtgctcaacgtggtctggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgtcggatttacatgaaaaatacgagactgacaaaaatgatatctttcggttctaaattaatactcccggccatttgagaggagcaatatgtacatatgcatgcatcacacctcagcgttttcgtcttttttttccttgcagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccacaggcaaatattcattttaatttgttgtgtatatatatatatatatacacgagcatacatgtgaagatggaaatatgtgaaaaatataatagtgctagtagatttgtctaaaacacttccacaatacaatgatcatgacactcgatcaggtctcaaagttaaattttagggattgtgtcaatatcaaaattatcaatgaataattggccagagggccgggattagcaagggtctactactgtcctgccatttcattaattaattagattaagtccccgattccttgcatccctaattggcctacgagaacggacaaaaatcgcaagatgagaggattgtggtaggtaatcttctccaactgtgcctctcaatcggccataacatattagccagaaggataaataaacatcaatctgccttcacagttttgatcatctcatgagacacatatatataaaccacccataagcaagagtctccaaggtgaattaattaactatgttgatacacatatacttaattggtataagagcattagtagcggtagttaattagtataaaagcatcaatcaaatggagactgttagctagctaggagaccgggcaagcaaagcaaagcattgatcttgatgaatcctccagagagattatttgcatattgtccagttccccctgacctattatacacatgcaagtgctctatgtacttgtgcggtgcaacgacgagcaagagtgcgtacatttatagtagaactgagggggtgcgccttatatacaccggacgagcatgagtgtgtacgtttgtagtgatgtctccaattttagtttctgtcgtagtgaaatattcgacgtttgacacctcgaaccatagaaaaactggagctgtgaaatgttttcttcttttttatgcgtggagcactgaaatattgacagttttgttttttctataaaaaaaagaagaagagttgacgacttgatgggcaggctctcctcgatggagggagatgagcttaaaaagtcgcaataaatggacccatgtagtggaaatgcggagtggagtggagcagtaataaaatttaaaacgccacgcgcagggcatctcgaccacgactggactctccttgagatcttcgaacagtgtgtgcttgctagctgaactgcagcagtggaacggtaataaaatttaaaacggatgtgcagtgttcacagaggatgagtgtgctatatatgtgttctctgcttgtgaatagatatggcgatctctgcatgtgaatagatatggcgagtactattactgggtatacatagttaggatagatgttagtttgttctgtttgtttggagatggatttgggagcaaatgtacatggttagggcgcaaatgttagtttgttttgctgtggaggggagtgggttttgatagaagtagacccatgaattttgctattccaaaattcctcaactagctatatgtctagctccacaaatctgtgatgcctatatctcactagtcttgctatgtgctatgtcatgtacccgtgggtaaatagctaatttatgatttttg

SEQ ID NO: 74841 - DNA, 2100 bp, Oryza sativa
gtgcgctctgctttcggtctctcccgtttcttgcttgattcccctccttcaagcttggtttggtggggatttgtgtttggtttcatggtggttaaggtaggagcggggatattcctgctccctgattttggtttcttgctgttcttgattagagcagcaaatgcttcaaatttttgggggtgccatggagctccttttcgttactgttcacttgttcagggacattgcacaaattaggagcattagattagatgcctatgattttggtcagtaatagctagttcttgcagctcctcgttttgttatggttgcaatgttactcgagccgtaggagcaggaagagaggaaaaacaaaaatacacgcaaaaatgtagcatctttgtttgcttttaatgttaattaagaacggaagcccttacgctacagcttccaattagtgcttatcaacgcaatgacaacgagaatctttcttatgttgcttctatttgttaagcaatgtcggtggaggtttcaccgaggggaagcaatacctcttggttaaatgctggttctgattgattattcattatactattgtttcaaataggattgtcaaatcccaatgggctaaatttgtgtcctgtgtttttttaccaggaacaccgagtgcgaaccagatatggctctgtatctgtttctgtatttggagatgaagacaagccggcgctcataacatacccggatgtagctctaaattgtgagttttctgatgacctttcaagtttgtaggtgaaagcttgctaatttttccatggcagggtagctgatgttgctatttttttttgtttggtagatatgtcttgctttcaaggattgttcttctgcccagaggccgcgtcgctgttgcttcacaatttttgtatttacacatcactcctcaagggcatgaaggcagtcatgaaggctttttcttacccaatattattgtagcattcactgtttgcccgtatttgctctgatacttacatgtgttattttgtcctacagttgggagcggcttcaatttcatccgatgtgcccgtgccatctgttgatgagcttgtggatcaagtcgcggatgttcttgatttcttcgggtactggattaccaccctggccaaattgcgccttattattcggtggtgcttgatccaacccttttatgcggggcttttggctttggttattccaattaagaattgggatgtggttgggtgtcactggccgggccttccttcttaccctttttggaagaagtattactcttaaccgttatttcaaagcttggcttggcttttctttttctttttcttaagaatggatggatacattggcacagaccaaataccgggatagagtgattggccttatgctagtttccgcgatatgcaaagccccttcttggagcgagtggttgtacaataaggtactaacatacatttaaatctgtcggtactgcagtattggtaatgtgttctgtgaattaacctcaaactcttatgtaccaggtattattaaacttgctttactattatgggagtcgtgggctagtcaaggaatgcttgcttcagcggtattttaacacggtatactttggtcttctggtagctgctttttatttgcatccttttatgtatatcagcttcgctcaacagttttctgatgctatgtgcaggaagttcgtgggaatggacaagaccctgaatcagagattgtgcaagcctgtagaagtgtaagtagttcatctcctcgtcagctttctgatatgattttgacaagattggtagctgtctacttatagaaagttagtctgaagcaataggtttccttttatgcagttacttcatgagcccagggatctaatgtatggcgattccttcaggcgataaacgagtaagtggacaaattatcttctgtgcattgcctgaacatgcaaagaaacaggatttgaacatactcaagtgaatttttccatccatcaggagacatgacctgacggaagcgttgaagaagcttcagtgtcggacactgatttttgtgggagagaactcacagttccacgacgacgcagtccatatgacc

SEQ ID NO: 74842 - DNA, 827 bp, Oryza sativa
aattttagcataacgtggaaataactgatacatgaactggaatgtaagtcacatgacatagatatgtcaatacttcgaacctaacagagcattaacaaacctgttttgtattagtctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaataccaaaatgatgc

SEQ ID NO: 74843 - DNA, 819 bp, Oryza sativa
  unsure (1)..(819): unsure at all n locations
gccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtggaaggggtataaataggcaaatgaagttatatatacctatgtgaaaaccactcatgatcatgtaattaagatgtcagagcgctgctcatagctgtatgcatatagaagggttcactgttaagagatgaccgacttttttagctttcaaaggattaaagaattggagctcgagcttgaccaacctatactaactactaagcttgatgattctttttgcccaatgattgattgctcactctctctctctttctccntgactgacctttcagtaaaggaggaagttagcaatacagacagtgtagcgtagtacagctgtaatcagaaattcagatcgtcgtctgcaaattaaggcagcttccgttgtcgccattctccggctgatcgaagaaattcaacagatgcagcagcagcagcagctcaagccgtcaagcccgtgcgatcgtgtctacaggtgttacgccttatcttctcctttaacccaaccctttgtttaatccaggctaatgcccacgtcgtcatcgtcctcttcatcgtcttaacaaaaccagctaagaaaaaaatttatgactatagctctgttaccatattaagttttaatttatcgtctgcaggtttgatggttatgaatgtcactc

SEQ ID NO: 74844 - DNA, 72784 bp, Oryza sativa
  unsure (1)..(72784): unsure at all n locations
gatccaggaaagtgtgttgtctaaaagctccagactgatgaagaacttcaaaaaacttgaaacagcatactttctcacaagatccaagttggcaaagcaagttgggaatcctgtaagcagttgccatcaagtcgtgaaaaggactactgggtcacctgttgtgactgagggaagttcaatagatgattttgctttggaagggcattatggtacaaggcaaagaggttggatgaactcttttcttgagggattgtgtagttacttatcgttcagtaagttgaaagttaaggcagaactgaagcaatgtgatctgctgaactcatcaaacttagtatgctctgtaggcttcgaccgggataaagagttctttgcaactgctggtgtaaataagaagataaaagtgtttgaatataatatgattgtaaatgaacattgtgatattcactatcctgtggttgagatgtctaatagatcaaaattaagttgtatttgctggaacagctacatgaagagccatatagcatctagcgactttgaaggtattgtacaggtatgctcacttctaaggaacatttttcagatttgcatttgatgaaatggccattattaaatatcccccttttttcaggtttgggatgttactaggagccaagtttttgttgaaatgagggaacatgagaggcgtgtgtggtcggtggacttctcacttgcggacccaacaaaattggttagcgggagtgatgatggttcagtgaagctgtggaatatgaatcaggcaattttattcttgcacctggtgtatgtcagcttttgaactaccgataacatggttatcgagcttatgtctgcaatagtagactaacttgcctctgctatggtaacactttttcatgaactttgcaggctgggagtgttggcactatcagaacaagagcaaatgtatgctctgtgcagtttcaacctgattctgctcgttccattgcaattggatcagcagatcacaaaatttactgctatgatcttcgaaacatacgagctccttattgtacgttagttggccacacaaaaacagttagctatgttaagtatgtggatgcatcaactatagtgtccgcatctactgacaactccttgaagctctgggacttgtccatgagtcaggcaaggataattgacagtccgcttcggacatttacaggtcatacaaacactaaggttagaatatcctgcataccttttttgttacggtgcataaacctttctcggggtattgttctggatatggttcttttttatctaatataacaatcatcctgtgtaaatgtagcttttgcacaaccctaaattgttattcattttgtcagttttctgtgcacctagttaccacctttttccctcagcatgttgttgttatatatgttcagtctttgaattacatgtcataaagcttcagtgtaatccctaattagttcttgtgcacctgcacaaaatttgctctccaacttcggtagtattaaaaatttcaacatgccttataggtggtagtaccccaagcaaaatgtgtttaccaaggtactaggtggtagttgagggagcagcagggcatcctctagtgcctaatcattgataagtggccaaatggttaggcgggcgggttcaccgagcacctaaacactgtctgggctggctagaaagatatgattaaggccacttgcctgcttttttgagaatgacacttgattttcgagattaagattctagtatagccctttcttcatattcctttagttgctttcaggcaaaagaatactttgttttatgcttaatttagttatttcttgaacctgttgaacagaattttgttggactttctatatctgatggttacattgctactggctcagagacaaatgaggtatgttttctaagtttccaccaaattctctgccgactatttgaaggttaatttcaatgtcatacagcgacaccagcttttgtgcaaagctaatcattggagttgccctaatgcagtaaactttgttgcaagcatgctgctgtttattattgatagatagtttggccatttctttgcatgcctttgtgcttaaatttcaatccatgcatctctcagaaaccaatattgagatgaaagaaatcaggtattaagatgagagcgtcatggaaaatgatttttttttttgttttgtaacctgcattttctatgtaacagttgaattaatgtttgccgaattcatgtgaaggaatattttggctcacttaccttagtgcgcaaggtattttgtgccgtaagatgaaatttggtattgaaaacataggcatagaaattattttttataccatacgtgcctgtatattcttgcttggggtttaatattaattcaaatatctaactttcctttccatctcgttttacttcaggtttttgtctaccacaaagcatttccaatgccagtcttggcatataaattcagtgtcacagacccaatatcaggccaggagattgacgatccatcacagttcatttcatgcgtgtgttggagagggcagtcctcaacgcttctttctgctaattccagcgggaacattaaaatcttagaaatggactgaccgtgcacaaatgggcagcttgtgcgcgtccagtttccaatagaaatgaactgacttgacacccaagggaatgcgcgtgcccggggctagcatagtgcattggaagtttgccttcaaatgcagagaggtctatagggcgcgatgtaactttattagagttggagttaggaggttgataggacagagtggtagctgtaccagagttagcataggattagatagaaaacgtagcataaatagggaaagtatttgtgacgcaggggatccaagaggggttttgtacatcattggtttgaggtatacttatataggcaatcaatccaagcttcagtcattgctattcttgttttgaaatatgaacttttagtgccctttcaattgatcgtttcccttatttctttttaagaaccacattggttattttcgtacacatttaatgttccctgcatatattgaaacatttgatacgatgaaatttttgaaagtttgaaaggaactaaacacaacacactaggtctggggctacgtccaacacttttttatcatcattatttgctggatgcggaaatgcacgtccacgtcgatccaccgggcacacgccacacacaaactgtgaccaagttgtagaattcgaagtgcacagccacaccacccccagccccaaagtcccaaacacgttaccgctaatcagaaagtcagcatttcttggggtctcgcgggccgaagacgaagttgccggcggagtagcgcccttgcagcccgtcggggagcgccacgaacctgcggaacttgagcggcgaacccgtcttccgcccaggctggagcgccacgccgcacgccgcacgcgacggcgaccgcggcacgtacaccctgcagtccttgctcgtgaacgccgccacctgcgtccccgtctggatcaggaagtagccgcgcgcgtcgtcgcgccccacaccgacagcgcccacttcccccgcctgcaccgcagcagcgccgccgcatctgcgcacgcacgcagcaaaaagcacacgttatttttcagcggccaaaacgaggccatcgagcgcaggtgggtggtggtggtggtggtggtacgagtactatacttgggaggggcgaggcgtccttggacttgacgtagccggcgtagcggcaggtcttgcaccagacagcgccctcgacgccgatggtgaagttcacgttgggtggcggccgggggagccccatggcagagcctcctccaagctgggtgaggatcacgagcaggacggagaggcagtacagctgaagggatcccgcgaacctagccattgttgtttgtcaaatgatgaagctctatacttatattaaattagtacgtcgcaatgataatggaaaggatgagcaaagatggcgcaatttataggctttgtaggtgggccgatcagctagctaggctagataccgttttgtacggatgatgatgatgatgatgatgatgcgtgtatcgcttatatgggggaaacggagctcatcacgtgcatgtacgtggccttttcggtgttgcaagctacctgcgcgcatccggattccgggtagcgccgcttgcactcgttaaaatggataatgttgatcgaattacttgttttgataggcacagagtacatccacttgttcaaaatgttagcataatctagaggccggcccaggttaatcatgttgtggactggttagtacgacctggtcgatcgattggccgatgcatcaagtggtgtggaacatgatgcattaaccattttcgacaaattaattaccaggcaaatttgcagcctgcaaattaaccatgcatgaacagaccaaacaaaagagttttttttttcttttgacaaaatgagaacagtttgagccccatacaagtaacagattatcgtaacattaagtgttgagtgaacgttcgttcgaaaaaataaaatgttgagtgaaccactgcaattaagcaagctaggagaagccatgcatgctatctatgtcaatgcaataaatctagactagcttctttaaaaaaaatctgggtgctccaaagaggttttctaattaagtcatttcttgaactccgcacggatttgtttgttcagaattcaagctgatgcttaaacatcagagaaccacctagagcacaaaatcggcaggcacggcatctagcaacgcagctacggttcatcatgcacgcatgatgaattcgcttccgcttttgctccagctagcataaaaggggcgcggatactttaatttgcatgcaaagggatgtctttcttcttcttgatttgtttgatggatggcgtcctcacggtacatctatcatcgatcgccgccccacgacacacgcacgcacgcaacgcaggtcaaaacccaaacaatttcagccgcgcgcgacatcgtatacacggaaacttcgtcatgtgtgcgcgcgtatccctgccggccaacagtttgtcatggatggaaaggattaaccaacaaaacaccggcatgttccattcctgaagattcacgttgcataaccgttctgccaaagttcgaaactgctttcttggttttcttgggctgtgatgggcgtttgcttgggccggtaatgacaagaccaaagcaaaccgtccgtccagtggcccagttcccacgcctcctgcccttgtccatggcccatcaaagccatggacaaggacatcagcaagttagcaactacttggccctaagtgctctgttatcacttatcagtgaaactcttttgtttaatggtgagagaatactaagacgatttaattattactccctccgtttcagattataagactttttagcatttatttatatttatatagatattaataaatctagacacggtactgttcatgggagggtggtagtacttattaactattcacgctactctcagtactctgtatctcaacatccaagggcggctctgactcttgtattctgaagagtgattagtggctatagtaaacaggccaaaatgcagacggagcataaaggtgctggaaaattccgaatatacttactagtcagtcgtcacaaaatgcatgcttaagtagagtattcgacctcatttggtatgtgttggaatttaattcaattaattaattgaatcttagcctaaacatgatcaccttctgctcatgtggaaattaattgatatagctgacctgagatgaagccattgcttttctttttttcttcttctgttacgaatcccttccagtgtctaatcgatcgggcgattgatttagggtttagggttggagagagttgagtcgtcacgcagcctccatccttctctttctttatatagcgacactggtggggctcgggggtttatctcaatctaaaattcgaatctattttgtaccgatcacacaaaacagatttatctcttagtttgtttcttgttaggatagaaaaaccggtgggattttaaccttatcctaactaaccggcattagccgataaaatcaaccaacattctccccttgattttgagactaactgacgagtttatcacataaactagctccccaaggcaatgtgtcttcaacaacattatgcgtcaccgagacaacaagacctatagtttactatagtacccaaataaactcaagcttaacttagtgggtgttgattgaaaaattaagtccccctcatccaggatcttagtgaggctattatttatgcatgtactggctagaacatatcttaattaatcttaactttatgagcctttagagtatggatccatgagcaaaagcttagtttagtaataattcgatcctgggacatatctttcacaactatatcaatgtgttaggcagaaaacacataacatgttgctactacaatagaaaactgtgtgtaatcagtgcacaacttataacacagtatattttgggtggtttacaccttttgagtggtttatgagcgctatttaccacttttagttctgggaaatattcttatgattaattataacatgctttaaaatctaaactgcatcgtcgattatgcagtaagagattatttttggagcttttccatggttattgctcccctatgtgtggacatagcttaatcttagttaacttaataatctttatatatatccacacatctcacaaaataagtgtccaaatgtctctaaacttctgagatcattggactttagaaatatgagcatgttacttaagattgctttgtaaataatacaaaacattcttaataccagtggtctagtctggatttaattaatactgtcaagattcccagtaaaatgtatgccaaatctgtatgcatccagatttgagctaatctcaagcttctatcagctgaatcataaatgattatctttataacttaacttcagcttgactaatctttaactgaattctctgaaattatttctttatgtcaatatatgacttactgatataagcccagtactccttcagaccaaaataattcatggaaaaatttcctttaatttctaacagcaatatgtattgcttgacaataaaatgtcattagtatggagtaccggtgtgaaatttccacctttaatttccatacagctatccacctcacttgaattattcgaaattttcatcagtcgggcttaatttcattaacccacttaaatggcccactattttgactcatttagaaacttctactaaattctttattttattcatcaatctcaattatccttacatggttcgaaaaccatttagatgaacactttaatgtcttattttgttcatccatatcaatttattcttacatggttcgaaaaccatttggataaatgcttatttttaatgtcttataaggtgaacaagctttatttagtgtttaccaccataatccgatctcataacttcatttgattttagcattagtgtcttaaatttcttaaaggaaatcggaggtcgcttatgggtaaacatagccataaaaaatcatttgttggctaatctcttaacttcgtgaaattttcacttaaagctaaacaacaccattaaaatctaagggaaataatatctctatctcatgagacgttccaaactcccctaggtatgtgacataagcgacaatgacacaatttcaatgacgtcttacttccatcattatagaataattattctcctcattcttatttaagcttagttcactaatgacgcagcggaatttaaaacatcatcaatgtttgattaagtccacaaatggatttcttaagtctgtaccctatatatgacttgtatttccataacaaaaccctcaagttatgttatgtatatttaattgtgtaagtcacaaattaagagatacaaatttctagcatccacataatggagctatgagtcataaatgaggtagaataatcttctcttattagagctcttgatgagctcccactgattgtattatttatttaatggaagcataatatcttatttttcataaacttaaatcacttaattttacttagtgaattatcatctaagtaataatagatgtcagaaatttctaagggtgaagtgtctcgaccttaatgagacgtccattctcccctagaaatgtggccgaataataaggccatagtttcgacaacgtctcataatgattcaacccaaaataatgcccttaatcttcttatttaactactttattgaatcaggacattaagcatgtccctatttcttgcaaagaacttacacaagaaaatttcaagagtagcatacatacgacatagaggcaactttatttccccttgcgaggaaagtgagctttattattattaaatttggagttgctacaaccccatagtatagcttcatcttttccatcaaatgacaagattaaaaggatcttacttagtttgcctcttagtcttctatatttcttattgatttgcggaatgatgaaccaagtcaattatggtccacttggtcttagtattacaactctgaaaatgaccgtagtctaatgggagaagaatcatatgaaatggacaagtggcgcatataaaatgtgcgatatccatctcacaaagtttgcacgccatgtgatttatttcttgtgctaccttttaaattatggcggcaaatgtgcataggcactaaaattgtactaagcatttgttttgacaaacttctaaagttcatctcaacgtttgctagatacagtttcacaatgtcatgctcaaaattctcccctaacactaacagggatgataatctcaatatttgtgagtgacatgcgaaacatagcattatattggccttctcccaggctaaagatgcctcttgagtttaggaaacattagtgacattagctgcgggagccacaagggatcctttgttaatgctaagtcatactcaaataggccttaggctccgttaagtcaatgaggaaaaataataataatttcatagactttaactgataataaaattaagtggcactattattgtggttgcttgtgcaaattacgtacaatagtacattaacttacacaataataacttaatctttatttcgctttgtatcaccgttgggcagagacaaaatgaaggaattacttataatccaaaatcaagtcaccgttgggcagaaatgattagggaataaacattaatgtcacatcaccaaaaggtagaagtgataaagtaaataatttaaaatcccaaatcaaatcaccatacggtagaaatgattaggaaatgacgccattagtgatgctatagaattaaaattaaaatccttagccatatcaccgttgggcagaaatggtaaaggaattaagattactgatagattatatcctcgatcacatcaccgtaaggtagaagtgataaaaggaattaatgcactaatggcataaataaaattctaagtcatatcaccattaaggccaaaatgacagagaaaattaaaataatgattgacaatacttagatttcttcccttaattacatcaccgttgggcataaaataattaaggaaataacaatcttaatgaaatcatctttctttgtagataaacttcccgttggttccatttatctagaaataatttactcattatttcaactgatcttaaataataagaattgttgattgcatataattagtttaccatagcttaatcaatcgtatgcaaaataaacttagaatttcatagtcaaagcaccattggtcataaataattatgaataatcttaaaattaattccttaattatatcaccatttggtagaaaataaataaggaataaaaattataattgtcatgcaattataataacgtgggttaaatataacttcagatcttaatactttctagtcgaatttctcgttggttccattcgactataaataattaagttactaaggcaatgaccatcataatgatgttgacatgaaatcataaatattttctagttaaatttccatttaactagggataaattaaatggcttaaggaaataataaccttaataaatattgacatgaaatcatattaacgttggtcaaatataatatcatatcattaatttctttatgagtgaccaaataattgatcataatttccagaaattttaaatggctaagaaagcacataaatgaatttctgaaaataaataagacattaaattcgcgggcttaagattaaaattaataagagcccactcttattggtgaggccggcccaaaacggaccggctcacttatgcgcgcgcggcgctgaggtggccgcagcccagatcggctcggcccattaacggcgatggcccgacgcgggagcgaggacggccgtccgatcaaacagacggccaagatttcgcccgcgccgaagaaatcgcgtgccacggggaatgggtgtaaaccctaaccctagctcattcttgtccccttctcttcctgattcggcgtccggcgagcgagcgagcgaatcggcagcgatgttgtgacggcggtccggcgaggcagcgcgcgcgtgcggcagcgagcgccgtagcggctccacctcggctggctggggggcgcacccaagggcggcgccaagccgtgtgctacggcgtcggcggtccggcgaggcggcgcactagcgacggcaagcgtctatgcggccggacctcgtcagcgggggtgcggagcccgaaggcagccgccaagccgacgcttcccgtccccggtgagggacggtggagagacaagctccaaggcggcgcgcgcacggcggtcaaccggcgcggccccgaggagaccggagagctccggcaagcttagggggtctaaatccggtaattaacccgaactcaaacctaattttgacttgaatttggatttaattctggtatttgtgacttagggttcttccccccaaaaattagggttcctcatttggggattttaggccgattggatccggcttattggggattccgggaaatttcaatcttgtttattcccttttgcttaacagtggggaatttcaatctagtttatcccctgttttccccaatttacttcttaatccactgttcttatatgataagaacctagggtttatgagttgggaacaatgagagtttcaatctggtttatctcattcgttctccgcttagtaaaattcgagagaaaaaaaaatctctctctgattgaatttctccttcccttactgatttctagccgaagctatgatttacttaagcatgaaccctaattcgatctaattaacttaaatatgacataatgctcaacacaaagcaactttaagaactaataaacagaataaggggcttaacagattaatcatggcatcatgccgggcttaacagattagggttcatcacttcattggcacagtgccttcaatcagggatgatgggatcaagtggctaagattagtatctgataccacaatgttggaatttaatccaattaattaattgaatcttagcctaaacatgatcaccttctgctcatgcagaaattaattgatctaactgacctgagatgaagccattgcttttcttttttcttcttctgttgtgagatacctcacgaaccccttccagtgtctaatcgatcgggcgattgatttagagtttagggttggagagaattgagtcgtcacgcagcctccatccttctctttctttatatagcgacactggtggggctcggggtttatctcaatctaaaattcgaatctattttttaccgatcacacaaaacagatttatctcttagtttgtttcttgttaggttagaaaaatcggtcgaattttaaccttatcctaactaaccggcattagccgataaaatcaaccaacaggatgcaagactattttccaattcttgcaagaactgaattggtcaatgtgaacatactataatgctctctttgctgtgaattactcgttctttttgcttttttttttgcacagcacccaatatttagcgtcaaagccggacgtaaaactggacatctatactgcagcgttccaaagtgtactctgttttggttttgttactgaacctggcgttgccacctctctctgttctaaataaacagtgacgaaataattacattcacataggatattactgatacattccggaaggtgtatagtagtagtactatctgcaactgtgattaagatcaagtggtcagaggctgcattatatagtccatttggcagagtaaccatttccctccaggctctagcaatgtgtgcaatcagaggcttacagatccatggacgacgacttgtaagattcctactttccagagttccagtggccagtgtttggaactttggatcgagtgaaccagatggcctagatttcaacgtcttaaaaaatttgcaaaatttgcaagcggacaaatcatacaagtttgaacagagaaccaatggagaaaccaccaatgctacactgacaacaagcgatcgaaacatcacagccgcgctacctctcaaactagaactgaacgtacacacacagtctcgctacctagtcgctactgcaagtggaacaccatgacacacgttgacaatacgtatgtctagttgcctactttaattattccttccttgatcgatcgatcgatcccgcgcagtcacgcacctcggcgcgcgtgccgcatgcccggtcgccggcgtaacggccggccatgagctgccggagtagctagagccagctggttagccggaggggcactggccggcgttggcggggccgtagaagaggacgctggtggggcagtagatggcctgcaggccgacgggcgggacggtcctggtctccttgaggagcgagaggccgatccacttgtttggcgggtagacgggcttgtcgcacagcgacgtcggcgacgagcccaggaacaccttgcaggtgcgcgggttgaagttgcgcaggtcgtagaacatcaccaggaagtagccgttcgcgtccgtcaccgtccccgtcacgttcaccaccttcttcccgtagcacaccagctgcgccgtcgcgcctgcaccgcaccacgacacggtcagaaaaaaagaaaagaaatgtgtagcaatgggggacagagggagaagaggatcctggatgcgcacctgggagaggtgacgcgtccatgtcgctgctgtagcccctcgacttgcacgttttgcagtagaccacgccctccacgatgatgaacggcagcggcggcggggccaccggctctacggccgtgtcgttggaggacgacggggccggcgccatggccgtgtcggtgtagggcgacggtgccggcgccgtggccgtagcagcggacggcgaagatgacggcgccctggccgtgttgtctctgctcgagacgacgtcctcggccatcgcatggtgcgctgggagcagcaatgcagcggcaagcacgagcagtgccgagcagactacggctgtgtggctcctcatctttgctgaactccttgactttcttttgcttggcgctaattttagttaagttgcagtgtgtgatcagcgttgctccggcaccggctaatttatagggcgatctgggtctcgacttggccttttactaatttgcagtttgaccaaacaaacagcccggctaaatcagattccgttcacagttaatgcgtttcccgtctacgagagtagcctggggagcccggtgatgtattacaggggacgagtgcattgggaaagttacagtcctgccttcttggcagctgtacaacaacatactaggaccgtaaaaaagtttccgttcaattggaggcctcagcgtgtgatccaaagttccaaatgaaacgcccaaagagctccaaattgcatcaggtaatataaacgttcttctctgttcacttcatcacttcccttcctagatttgggaagcgtgtcaagatgagttttctgaacaagtgtcgcgttctcggtgaagcgagatcgacccgttcgtgaggatgcgcgcggttacgtggttttgagcggggggcgcgacctggtttgacttcacgggtaatgatgactgcgccttacaccggcggcagcctcgcgtcccggccgattgtttagtcgcgggcgataaatgcaccattagtccaggtaatatgaaatcctgcctgtatggggagctggggttaatctgccgcaacttgctgcatcagattccggtttactgcgtcaggtgatatgtgctattgctaccgatcggatctgcggcggacgagaggcctcaccatcgatcgcggcgctgaccgtttcacggcgcgtactgagatgccctctgcttgtcacttgtcagtctgagtctgacgccggagaactgagcgatagaaggtcttccgcggcagagagccagagatgttccagctgcgtgcagccactctgtatgcagcgtgggaaaatacatttgacaactctcaaactctgcagcttcgcgttttgcctccaccgacaaaggagcgcaacgggattttgcatccagtgcggtgcaggtgcagccgtgcaggtagcgatcatgcgttgcctgccttgtccacatgtagcgcacaccaggaaaggagaccaaattacagaccgaccgtgattaccactcgaccgggagattacggactgataatgcacttcactcttatctcccttccactttcgtactaaacttttccccctcacgtggttaaagaaaaaaagtataattgacaatgcatataacaatatcagagtgcattaacgtctgatggtgcatataaataaatgtacgtttgtacgcacgctatgaaaatgcatgccaataataaaatctaggggttatctattccttggtacaaattcattctttttagagactttttacgatcagattacaccatgagtcatgatcatacaataacattttatcctcttcttccctgtgacacccgctcgcactgtcacactctaacccgatcaccgacttatgctagcggcaccaccaagacctgctcaaactggccttcgccatgcccattttctccccgtcccctgtcacgagtgctcatattccctccggtttgataatactagtcgttttggacaagaacacggttttcaaaaaacaactttgactactatttttcattataatacgtataaaactgttaacaaatatatgattttattaaagtactttttgagactaatctatacatgtagtcaccatatttgaaagataaatattttaaaaatgatcaacccgaagggagtacttgtctaaatggcaacaagatgctcttgctctcatagttatttgcgtacgtcttcaccaatgacgccatcattatccccgcctcctaacccctcacagtaatgcatctctaccagtgacgccgcttactggctttctccaaccccatagctttagtggtgccgcaaccgcctttccagttgccacccttccatgtttgctgccccaccgttggtttgtcatctctcagtcatccatctaagctcaaaccctcggtactagtgttcaaccctagtgtctaatgctcacagcgaaatcctaactattagccctagggcccaaacactagtattgtttggtctcaacttgttgcattgaacaagttgaaaacaaccgccaatcagaaatagcccaaaataaccccaaaacatcaacttggtatgcaacctcagcctatctggaatcaggagagtactggttttcggcccgtcaaagatttaaagtttttcagaggaataagttcatcggaggtccctcaacttaacagtgagattttgagccgtgcactcaaggtcctattgtagtatatatgggtggtttcgctgacatggcatcctagtcagaattttttttaaaaaagtatgtggggcccacatgtcagctacaaattttttttcttctcttttctctcttttctattctcttcttcagtgagagagccgtcgctcgcccgccgtggcgtccttgctatcgccgccgccgccgtagtcaaagtggtggctcaggtagagcgtcactggagagacggagacgatggtgcgagcaaggcggtggtcgggccgcgtcttccgctccgcgtggtgctggcgttaatggtgagcaccggcaaatccgggccgtcggcaccgacagtgctcctgacctccacgatccgtcccccatctccctctgcccagggatctcgagcgcggcggcgtacgacgcctgccccctcagccgccaccgctcccgagggcagggaagccacctccacctccagattgcccgatgcgaagggcgggcggtgcctgccccttcagccgccgccgctcccgagagcggaggagccgcctccacctctgaggcacctccgtacgcctcagccacctccgccccgtcgccacggtgaagggaggtaaagggagcagcgcccgcgagccgtcggtcggtatccacggtgggtctgcatcgtggcgcgcttgtcaccgccgtcgctgccgcacggtgagtcccacctccatgatgcgcatcctcccagccagggacacggacccgaatgcgacgagccataccgcggccgccgtcaacgctttagatggctgcagaagttgggctgcggcgccgtggaaggagcatcctcgtggtagtcggacgagctgtcggaggaagccgatagggacggcgacgtggaggacgcaggcgccggtgtgatcctcttctcacccccaccaccggctatggccgcggcaatgttgttgttgttgttgtgatccccctcgtcggacggagcataggcagcggctccgggcacgggaggagcagaggggcggggtagtgtggcgggcgagcaccggctccctcacttaagaagagaagaaagaaaagagaagagaaggagaagaaaagagaagaaaaaaagaagaccagggtgtcacgtcaacgaaaccacccatatatactgtcatagaaccttaagtgtatggtttgtgtgagtttagggatacacatttattttttggttaagggacctaaaaaagctcgctgttaaattgagggacctctggtgaacttattcctttttcagaggaagccactgaggcctagatttggctattgaagatgggcttggcccagttaaggcttggtgcaaggatacgaaatcttgtccatcaacggttgatcagacggtcatcgattcagcggcctagggttttcgccccgccgtttgtaggattgcggctcttaaaagcccgggggcgactagtgaatccggaagggcattgcgcagcctccccattctctcccgtcgttgtggcgttttttttgtttcctccttttgctttgggatggctctattgcttagcgtgattttacctctcttgccgttttttcagattgatttgcaacgatttggagcaatgatgagatttgagtatgatctctgtgatgtgatttataatctctatatcgctacgttcttgctgagctcctcgttgctgttatcgttttgtttgtcgttgcttctttgagtctgtggagacgagcaattttctgctgagatctctcactgattttccttcggtctggattttttttgttctttttccttttctttttgtctaaagtgaaaacaagattgacgaaggtaatattcagtagtttccgatgtgatgctaatattcgcctaatacatgacgccgtgcagagagttcccatgagatcaggaaacaaaagatgagctcttgccgcaaacacttctagatattgcttaaccccggaaaagttcagcataatctttcataatagaacactggctctaagcagcaataaaggaaatctgaacgtcaagcgtccatctgtttctagttgaaccctgcataataccgaggtttgtaaggtacaaatacaatcggatcacccaattcatacataaggtacatgattcagtcgtatgactaacccagtttaaggtccaagccattgcttagtgaggtggatccacattccacatccttcagagtctgtgcatgagcaatctgtgcaggaaaattacagagcaacatctaaaatactgaagcatttcaaaatctcagaaagaaacaaaaaggagggtttgagaaatcaaacaaaaagttttggtcactttctctacccacgtaacccaatagtaagctactagcggccactgtaggtaggcttcatgagctaccctgcatagtttcatgtaggttgatgcagttgctttcacgaactgaaagctattccacttccatggtaaaggggttccatgaaagggtctatatgttctaggttagtatactttgtgtctctttatgccttgtaatggagcattgctcttgtctagcatcggtctactgtgcctgtgtatgtagtaccatgagtagggcatgcacgcttcctctgaatggtgcttctatagtcctatacttgcgtctatctttatactgtatcctatagtctgaaaaaaagaaccaaatatccaggcacagcaacaaaaggggaataaatttaaaacaaatctaccatggtttttcgatctattttctgtcttatttttatttttggagggaaagctatgtatcttgatccgtcaactaaaataaaccaatgatttctcagctaaccattcttataggctagtatttgcttatttatctctaatttagagatgaattaagatctgaaggcaaaactacaggaccaagaacaccaaagaacttagctacctgtttggatcaatgtctttctttgcacttgtgggttcaatacttatatgaaattgctgccaagtgctatgtttctcacgagtgtttgcctatcatctgtcaacatttgcctatgaagaacatttacacaagatttctttttgaccatttgaaagggaaaattgatgatgacgatgataatgaactgactaacaaacgaagatagtacaacttgataaatagccagaatgattatattctttaccttgtcgcacagcccgtaccgctcctcttgtcgccccctaatctgcacgcagataatcgaaaaacacatgtatattactagtgatgtttggtctcggttcacaacgcaatctgtaaatctgtacaagtgtcctgacggcacaggtatgaatcgtatcagaagtgggccgtgtttacgaaagacgtacaatgttctggaggtagcagatctcgcctccgatcttgcggtccttctcggagcgcaccttgcgcatggcggcctccagattgtgctccagcgcctccagcgacggcaccgtgtactcctcgccgtcgtccaccgtcatgaacctgccaaaaacacaaaagcacacacgatatcatgacgagtgacatcgatcagctcgcatcgagttgcttacctcagctgtttctccaggaggtcgcacatgctgcccaccttctccagctcggcgcgcctctcctacatgcatgcgcggtgccaaggaagagaaaaaaaaaacggcgcacgtttatttactggtgagaaaacgctcaaacaactgattactacgcgcgttgcgttgtactacgtgctacgtacctgcctgatatctgcccaaaccttggtgtgcgtggtggcctcgtacctctcgacaaactccctcacgctgcgccaagaaagaagcagcaacgaaacgtggattaaccaacaatgtcaggagacagcgcgcgcgcatatacatacgtgacggatcgacaagcggatgtgtggcagggcagcttacgaggggacggtgggggagaggaagtggtagagcttgccggaggcggagaagaggaggaggaggaggtcggcgtcgcagaggacggcgagctccctggccttcttgaacaggccgtccctgcgcttgtagaaggtggactgccgctgcgtggggttctctatcctctttatctcgctgcgccccctccccattctggccgatcgaatcctccctctcctccccgcgactccggccgccttcccgaactcgcaaccgcggcgcggagcaggcgctgcccgttaccgaggcgttgcgagaataaggaaaggttcgccgctgtagtgtatgtatgggagagattttgcccaggggatgcacggttatttttactgttttaaagaggcagatggaggaagaggagaggagggggtgcgggaaatgaacaagatggtctagtcctgttacatgtcaggcgccgcgtgcgtggcttttgcttcgctgcaggggtggtagggagcatggctgagagcctgagacggtaatatgtacgtgacatttgccaaagcgacggagacgcgtcgagggcacaggcacagtgggttgcagggggggagtctgttgctcccgcttacgttgtactactactgtactcctgcggggcagcacgtcgcgactatagctcgagagtacttctactgcattttgttggtttcgaaactatctatcggctcaaagcccctcaagcgcgctgaagagccatcccagtatggccttgtttaggcaccgtttagttttcaaaaacttttcacaaaaacatcacatcgaatttttggatacatgtatgaagcattaaaaatagataaaaaaaaactaaatgcacggtttgcatgtaaatcgtgagacgaatcttttgagcataattagtccatgattagccataagtgctacagtaacccatatgtgctaatgacagcttaattaggctcaaaagattcgtctcgcggtttccaggcgagttatgaaattactttttttattcgtgtccgaaaacccctttcaacatccgatcaaacgtctgatgtgacatccaaaagttttaattgaggaaaattttaagtttgtttgtcacatcaaacatacggacacacatttaaaatattaaatttagtctaataataaaataaattacggatttcgccagattacggatttcgccagaaaactgcgagatgaatttattaagcctaattaatccatcattaacaaatatttactgtagtaccacattttcaaatcatggcgcaagtaagcgtaaaaaattcatcttgcaattttacacgcaatctatgtaattggtttttttttctaaatttaatactatatgcatgtgtccaaacattcgatgtgacaacgtgaaaatttttattttggtaactaaacagagctatgccactgtacgtgtagaccgttacattttcacatagaacataaatacgtttttcagttcctaagcacactcagtattaagtatagtcgtatactatttgctatactccgtttcggtaggtctgagggggtgaataattgagcacacctgggtgcaaaattgataagagcatcctcaacagctcatctaaattccatcttctatactcttatttagatagtcatccaaaaagattcctactctatattacttttcactccaacagatcatccatattacatactatattttactaatttttacaactaccacatatgtatcaccactctaacaaaatttcccacctttatctcttcactccccacctttctctcttctccaccgctgatctccccgcctttctctcttctctaccgccggcgccgagaggacggggaggacgagggccgaccggaggggcggccggcgggtccatctccctcctcctcccgccgatggcccgtcgccaccaccacccagtctctgtgaaggggcggcgcgagcggcggaggggtggcggccggcggggcagaggggcggcagggtcagaggagtggtgcgggcagcggaggggcaacagaggagcggtggggcagaggggcagtggggtcagaagagcggcagcgccggcggagaccctgagcgacggggacggcggcgacctcactaccagatctgctgcctctccacctctactctggtgatctccacctccaaatccggtatgcacctcctctctcctacggtatgcagtccatatggtggcgcgaggtcggcagttgaggatggcgtgaggggagagaacctccatatttagcttgggaaggacgcggtttggaggtcctctaaaaatggcgtgtgtgatggaaggtctgctggagcgttgtttttcacctccatgcgccaaaaaggggatggaggaccggatagaggagctgctggggatgctctaaaggacagatatccgcgcgcactgcccccacgcggctcagccgcatgacacgcgtggaaaggggacggcggaagggcgcggggaaagagggcacgtggcggtttttcctcttttttctccttttttttagtatttttcgtttttacacattaaaaggtatagacacacacgtataaaaaaacatatttttgtctactgttagtattataataccaatattattaagtgtaaattagtaatttactaatacaatgattagaagttaatttgttatttatgtttttttctaactaaatcgatctacgatcatccattacattgggatctctcaatattcatcgaaaaagcaaaaaaaaaagagaaaagaagatttagttactgttaaatgatgattatactctctgcacctattttgacagtaatatccctccacatttctattaccgttaatagtgtgataatataaactagctgggtgacccgcgcaattgcgcggctagtagccaaacaaaatcatataattttcagtatgattttacttaagatttattaaatagctatcctcgtatttctaattatataatttttaaaagtcacaccagctgctaccccttacttctctcatatccttctttatttatttgctcggtctatcactatttctattcattctcctttaaacctctaaaaattggatcttatatatagttttttgagtttattatctcgttgagtttcgtttttataatttctagaagtcccgtcaaacgctgccattatactcctttacatcctgtctactctcttttctctttattgtcattgggattttataaattgaacataattattgttcgggtaccatcagcggctttaccattgtaatcctttatggctcgtccgttgcctcccttctttattatcattgagattttaaagtcgatcatgattatcattgtcttttttactttttagaagttccgaacctttaaaaattggaccttgtagtttttagagtttattgtattgttgggtttcatttttttataatttttagaagacccatcaaacaatgccactatacacctctacggcccatccaccacctatttttcattgggattctaaaaatcgaacataactatcgttgtaatttattttgtattttatacaagtcccgtcaaccgtcggtgcctctgcaactgtactcctatacaccccacacgctgcttcttctttttattctcattgagattttaaaaatcaaatatgattatcaatgggttttttttttactttctaggagtcccggcaaccgtcttgctatttggtgttttaatcatcattaggattctatttggtgttttactaacagtttttatatgtcgtatcaattgctaccactctaatcttttataggcctgttacttaatttatctcgtcacgtgttttagatggtctttttttaatagtctttattttttatcatcattttttttatttataaattatattcctaattgaaatcttttttcctttttctaatttcagaatttatttttttttcaaattttaattaataccgtatagtgttcttttaatattttgtttttttttattttttgaattttagttgtttcaaaattatattcctactttaacttttcttttctttttgctaatttcggtttttttatttttattccgaacattaactaatcttgtattgggttcttatatggactcttctctcaatattccttatttttaattccgaatttcagctatttgtaaattgtattcctacttgaactcttcttttattttctaatttcagattttattttatttttattttgaatttgtattaatctcgtattgggttcttatatggaaacttctttcaatatagcttatttttaattccgaattttagctatttttagattgtatttctacttggactcaccttttctttttttttctttttctccgattaatgtgggaatttctagcccccacagcgaacgtggtgcctcctttcaaagctgttttaatactataactagctgggtggcccgcgcaattgcgcggctagcacccaaacaaaatcatatcttttagtacgattttacttaaaatttatcattgttttttttttactttttagaagttctaaacctttaaaaattggacttatagtttcatttttttataatttttagaagtgccatcaaatgatgccactatgcccctctacaacccatctgtcacctactctttattgtcattgtgattctaaaaatcgaacataactatcgttggaattcattttttattttcaagaagtcccgtcaaccgccggcggctctacaactatactcttatacaccccgcccgctgcttctcctttttattgtcattgagattttaaaaatcgaatatgattatcaatgggtttttttttttactttgtagaagtcccagtaactgtcttacttgtttgcttcacggtctgcctgaagtccccccttttaatcgtcattaggattctatttggtgttttattaacaacttttatatgttgtatcaaccgccaccactctacttctttataggcatgttacttaatttatctcgttatgcattttagatggtcttttctttcaatagtctttatttttattataaattttagttatttataaattgtattcctaattgaaatattatttttctttttctattttcagaatttattttttaaaaaaaatagttaataccgtattgtgttcttttaatgttttaattttttattttcaatttcagttgtttcaaaattgtatttctacttgaactctctttttatttttctaattttcgatattactttatttttttgatttttctaatttttgatattattttattttatttatctcgtattgggttcttatatggattcttctttccatattgcttatttttaattccgaatttcaggtaattttaaattgtattcctacttgagctcttcttttattttcttttgctaattttggatttatttttatttttattccgaattttaattaatctcgtattgggtttttatatggactcttcttttaatattcctttttttttaattccgaatttcaggtatttttaaattgtattcctacttggactctcctttccttttctaattttggattttattttatttttatttcgaattttgattaatctcgtattgagttcttatatggaaacttctttcaatattgcttatttttaattctgaatttcagctatttttaaattgtattacgctctaatgtgggaatttctaacccccacaacaaacgtgatgcctccttttggcccgcgcaattgcgcggctagcacccaaacaaaatcatatatttttcagtatgattttacttaagatttattaaatagctatcctcgtatgtctaattatatagttttgaaaagtcacaccagctgctaccccttacttctgtcatatccttcttttgtttcctcggtctaccactatttctattcattctccttgaaacctcttaaaattagatcttatagctttttgagtttattatctcgttgggtttcgtttttataatttctagaagtcccgtcaaacgctgccattatactcctctaaggcccgtccactctcttttctctttattgtcattgggattttacaaatcgaacataattatcgtccgggttcattttttttactttctataagtcccgccaaaccgttagcggctttgccattgtacttctttatggctcgcccgctgcctcctttgagattttaaaatgcatcatgattatcattgttttatttttactttttagaagttccgaacctttaaaaattggaccttgtagtttttagagtttattgtcttgttgggtttcattttttatagtttcagaagtcccgtcaaacgatgccactatacacctctatgacccttccgccgcctattctttattttcattgggattctaaaatcaaacataactatcgttggaatttattttttattttctaaaagtccgctaaccgtcggcggctctgcaactatactcctatacaccccgcacgctgcttctcctttttattctcattgagattttaaaaatcgaatatgtttatcaattggggttttttttactttttagaagccccggcaaccgtcttgctcatccctccttttaatcatcattaggattttatttggtgttttactaacaatttttatatatcgtattaactgccaccactattcctacttgaaatattttatttctttttctaatttattttttaattaataccgtatagtgttttttaatacttttattttttttattttttgaatttcagttgaactctcttttatttttttactaattttgaatattttttattctgaattttaattaatctcatattggtttcttatatggattcttctttcactattacttaattttaatttcgtatttcagttgattttaaattgtattcctattttaacttttttttctttttgctaatttcgatttttttcctatttttattccgaatattaactaatctcgtattgggttcttatatggactcttctctcaatatttcttatttttaattccgaatttcagctattttaaattgtattcttacttggactctccttttattttataatttcggattttattttatttttatttcgaattggtattaatctcgtattgggttgttatatggaaacttctttcaatattacttatttttaattccgtatttcagctatttttagattgtatttatacttggactcttctttttttttctttttctccaattaatgtgggaatttctagcccccacagcgaacgtggtgtctcttttcaaagttgttttaataatataatagatagatagatagatcgatccaaactttacaattaaatgagatgaacggtttaaataagagcacaaaggaggctgatgagagaggagagactagaggaccgaaaactgatggtgcgaccttccgctgatcaacgccccccacgggtgtctttccatgggattttgtaggattcggccgggttacccgggcatgggtggtgagtactgagtagtaccggtgagaagccagccagaagcggcgtcatggtgggctggtggctcctttcctcacaggctagctacctactgtagcttcctgccgtggcccttgctagcactagctttacaggggaaagaccggaagacgacgacgagtcgagctctctcagctgtgcaggtgcagcactggttctggctagctcctagctcccggccactactgtgactgatggcgacgcgaggactgcacctgacacgacctatcctccctgcatcttgtggacggacggctccggctcatctctatcccaggctctcagcccataacgtcggactaggataactagctactcaaggatcatggttctggtccggggggcactgtagagcgtagagttgtagacatcgtcacctacgtggaataattgagttgttttctgatagcggtgtagcggagtagtagtagtgttcatctgtctcaaaatattattatcaggataggatgtcacttattctaagacaactagtctgcagggtggatccggtaaaatatagtagtggaggcggaacaaaatacgcagcaatccaacataaatcaaaacatgtatcacgtgtaaattggctaaatacctagtttaaagatcacatacattgaattaatgatacgtcgataattttgtccataccaaaccaatgtcgattagatgacatgtcatgcccaatcgcctattattcttcatgagtagtaatctatacaaagaaaaaggcaaattaatgaatgattgaaacagacttattttcaattcaaataatttagactaaactctgcccgaggtctctttggttgaattaaacactcgttactaggtgcaggatcactgacttttttgttgcttgaactagaattagaataactagctgggtggcccgtgcaattgcgcggctagcacccatacaaaattatctatttttaatatgattttacttataatttattcaatagatatttcattgtcttaagactttgaaagaccaaaccatatcatccccgtatttctaatgttgtaacttttataaaagtcacatcagttgttaccccttactttttttttgtcaccctttctttatttgtttgttcgatctaccatggcttatattcattatccttttaacctttaaaaattggatcttatagtttttttagtttattgtctcattgggtttcatttttttatttttagaagtcccgttaaaagctgccaatatacttctctatggctcatccgctgcttcctctctttattgtcattgggattttaataatcgaacataattattgtttgagtttaatttttactttctagagtcccaccaaaccgtttgtactcttctacggctcgcccgcttcttcccactatttattatatttgagattttaaaatcgaatgtgattatcattgaggtttattttttaattttttggaaatcccgccaaccgtcgtgaccattctgcttaacggcatgtccgtcgtcactccttttaattgtcattgggattctatatgggattttgttaatagtttttagatgtctcatcaactgtcaccactctactcctttacaaccctttacaaccatgttacttcttcgatatttattatcatttatcatcgttgtgttctagatgatttttttttgaaatttccatatttttcgttccgatagattttatttataaattatattcctagttgttttactctattttcagaatttattctattaattatttggaattttaattaatctcgttatgtattctagatggtgtattctttaaatagtctttattttttattacgaatttcagttccttttaaattgcattccaagttgaactcttctttttattttcttatttctaatttcggattttattttattttttattttaaattttaattaatctcgtattgggttcttatatatggacttgtatgaaatgagggcactgtattttttttctactgctgcagcctaagcgtgctggcctggtatttccaccctatatatgtgcgggaatgtatgttggtttagaactctataatgtatagttctgcaattgatttttctaaacggacaaggactcctagtacggatggtatgatccataattagattaatatgattatcttttgtacagtaaatctatttagtaattttaaatttgtattcctactcgaactctctttttttcttttcttctaatttcagaaatttatttatttattattctgaattttaattaatcacgtattgggttcttatatggactcctctttcaatattgcttatttttaattccgaatttcagttattttttagattgtatttctacttggactctttttttttctccgattaatgtgggaatttctagcctccacagcgaacgtggtgccttcttttcgagctgtcttaataatataatagatacgcgagtaatgttctttttgacatgttagacaatctaaagatgtatagatatagaaaacaattataagtatcaatcacaacctcattgaacttgaactattgagacacaatcttatacttgtcttttagtattagagtttcaatcacaatcacaaccagtttttggcttgctgcctgcctgccttgccaccttgcgccctcgcagcgcctcgttggagagcggcacgccacctccccggcagcgtggcagcgcaggcgctggaccaccgcgtctcaaggcccccccgggcgccctccaatccgcccctgctagtctggatgcactgtccagatttattatttagtatgaacaaaatcctatcctaaacaacaaaattttgggaggtagtactacgaagccactgccagcaatttctccaaataaaactagctgggtgccattgacacggctagtgtgtgaatgacaaatgggtcccataaatatttattttaattctaatattatataagcgccacgtgggatgaagactaggtcaacgccaccacgtcatccaaacagtcctccaaaatctccgagggagttaaattgtactggtttcaatagttcagggagtcatcctttccaattttgtggttgagagtcatggattagattcccgtcactttaagggagttgaagtggacttatttctatattctatagtactccaatatcgcatttgggctacttggttgggctcgttgctacgttgcatttgggccgtgggagtacgttttgcattgggccggtgagttccttcttctcggcgtgtgtattcgatttgggcgatatgattcgtttcgtggacaggtttggcgctctttttggttgtggatattagggcatgtataatggtgtttaatagtaggccctctttgttatcacgtaagtaaatttggtgacgtgaaagaaaaagagagaagaaaggagaaacatcgttgctacgcatgacaacggctcagaatcgactcttagcatttattaacggaaaatttattgcatgaaggtggagaaaagaaaagaaatataataaaaaatatttatgcattaatggtttagaaatcttattgtctctactattgtaggaggatactccctccggttttattttaattgacgctttggacaatgacacgctctacaagatatatctttgaccttatttttctattacaatatatacaataaataaatgcatgtttacttttattatagtgttttgaaagacaaatatatatatatatatatatatatatatatatatatatatatatatatatatatatatgtttttctagtttctttaaactaaatatttttaaagttattgatgggcaaagttataaaagtttaatctcaaccttgttcaaaacgtcaattaatatagaatcagagggagtagtctctagtggcattaattaatatagagagctcatattaggttctacctttttgtacgtgcgtttaaccggcatgattgtgtttaccattgatgactatagtagtctcatttattaacctgttcaagactgtctaatcgtggttcttgaacaatcgctatgtgagacatgacgagtatttgaggactgtaagcaacagcgtactgctgaaactgaaagtatgaaagagcggtgcagtttgaagcacaattctttgtacaggactggatttaaccatcgtcagtactgttttgtattttacagtgtggtaattctacatcttttcacctggtatatcggttcttgtatcctgaagtttcggggtatattaaatttctttcgtgtgatcaatctggatagagtattgacaatgccgactaactgacacatgttaatatagcgaccaagctagtagcaaaaatacaatcaggtcagtaggtcagcaagtatttcagggaaaaaaaactttgttacccaatgaaataccaactggcctgagagcatcaccaacagattatctataatctttcctcaaaaaattgtttttggtttcctaaactgaaaaaaggaagggaaaaaactcctccctccaatagatagcctaaattcattccctaaaacttaaaagtttttttcttccacgcgcagaaagatcgctatcttccacgcgcaggaacgggaggagagagaggcgggagtgcgagattgggagcgactttcgcgagaatgcacgcccgcatataaacggagtgaggaatcgagagaagggaactccaaaactcgggtagaagattaggggatttgttagagcagttttttagactaaaatcccttaaaatcagttttaggaatcagatatgtagactgttggtgatgctctcaagtcaagtagcggacgatatgcgattttttttaaaaggaaaattggaaactctaccaatcagttaagaaggaaattaagtgaagtacatgtccacaagatcggtccaccggccaggtcgagcaaatatatactatataatatatacactacatattatggggtacaagaatggatactttcgggaaacaacctctgcgcaacgatcataaatttctaccacaacttgaaatcttgaataatggccagtagccaagtacattgtcggtgtctgccgtctgcgtggcatggcactgctgaacgacgcgtggtcgatccaggtacatgccattcctatgtatgcgaattatgagagcagaccaatggtaggtgaaacaaagaatgcatgaactatagcagatatgaactcagcagatatgaactcacgagccatgacccatgagtgtgttgaagacgagagcctgtacatgtatcggagaagaccaaagcaatgttgctgttcatttaagggaggaagcaggtgaggaaacaacattaacaccactgagcacacactgcgcgtagcaaaaatgagcccatcaccacgtcccagcgtcccgctccgctcttcgcggcgatgggcagcgccgtgccgacacgacgccccgagatggctacctagctgacacgcaacgccggcctccggatcgatcagtaaagagagtgcagtgcagtgcagcctcgtgtcgtcatgcacctggaaggaaaaggttactgtatttctgcttgtgtgcgcgattttcgctgctagctggcaatcgtgggatttgcagcgtactgtgcaggcccagtgtaactcgacgccacgccggcccatcgtatttaatgagctgagtgtaagcaggtacacaggccgcccaactaacctccttcacggcgcatttacgcttgggcatggccggtgtaaccgtgcaagcatcgtagtgccatcgatcgctgctgtaagtttgtaacatgtgcgtgtcctgcggagagttgtgtgccgttgtgcatggaatggaaggcaaagcataacatgggagcttttcatataaaggccaccagcacgcgggctgccacttcaagcttcagctcgtgatcccatcagatcagcaagcagtcgcgaaatggtgccgatggctaaggctctcgcggtcgtgtccgctttctgccttcttgtggcgccggccgccgcggcgcgtagcctcgtcgacgtcatcggcggggcgttcggtggccggaaggactactacacgcccggtcctactggccagcaccactcttctagtcccagtcgttcgtacattacccagtctcttccatatcttatcttgctactgctcggttacgtcaactggtcaaacgtacgacgtaatgttcgtgcgtgtacgtgtttcccatgcagattcgcacaaggctccgccctgcgcgccgacgccgccacagggaggtggtggaggctacaacccaccctcgccgtccattggaacctctccgacaacgccgggaggaggtggaggctacacgccgacgccgagcgacacgccaccctctccgtccagtgacacctcgccgagcactccgggtggcggctgctcgtcctcacccacgccgtgcgacgcaccgccctcaccgtccagtgacacgtccccgacaacgccggggggaggtggaggctactcgccgacaccgagtgacactccgccctcgccgtccagtgacacctctccgacaacgccgggtggaggtggaggctacacgccgacgccgagcgacgcgccgccctcgccttctagtgacacctctccgacaacgccaggtggaggtggaggctacacgccgacgccgagcgacgcgccgccttcgccgtccagtgacacctctccgacaacgccgggtggaggtggaggctacacgccgacgccgagcgacacgccgccctcgccgtccagtggcagctccccgacaacgccgggtggaggtggaggctacacgccgacaccgagcgacacgccgccctcgccgtccagtggcagctctcgcactacaccgggtggatgctccactcccacgccgtgcggcacgccgcccgcgccgtcgagtggcacctctccgaccacaccgggtggaagctactacccgcccacgccgtccattggcgacgtgccaccctcgccgtccagcgacacctctccgaccacaccgggcggaggctccccgtccacgccatgcgacacgccgccctcgccgtccagtggcacgtccccgaccacgccaggtggaggctactacccgcccacgccatccgtcggcgacgtgcctccctcgccggccagtggcacctccccatccacgccaggtagtggaggctactctccgtccacgccatgcagtgcgccgccgtcgccttcaagtggcacctccccaaccacgccgggtggaggctattctccttccacgccgtgcaatgcgccgccctccccttcaagtgacacctccccgacaacacctggtggcggcaactacccgcccgcgcccaccattggcaacgtcccgccatcgccatccagcggcacctccccgagcacaccgggtggtggctgctcatcctcacccacgccatgcgacgcgccgccctcgccatccagtgacacttccccgacaacaccgggtggagggtactacccgcccacgccgtccatcggcacctcgccatccacaccgggcaccggcggaggctactaccctccctccccttccaccggcggctacacgccgactccggacgttccgatcagcaccccgtcgagcccctactccccgctggtgcccacgccgccgtcgagcaccaccccgatgcccttcgaccccaacacggcacccttcccgtgctcgtacgttacttcgtcaaccttagcgccgcgcatatccacacgtacgtcgtgcataatatggagtatatcaggtgcatttactaatctaacgcacgtgtcgtgtgcgttctgtctgattgcagatactggctgtcgcacccgggcgtgatatggggcctgttcgggttctggtgcccgatggcgcggctgttcgggccgaccgccgcggcgccgttcggacacgacctgaccgtgccggaggcgctggcgaacacgcgcgccgacggcgtgggcgagctctaccgcgagggcacggcgtcgcttctcaactccatggtgaacagcaggttccccttcaccacgcagcaggtgaaggacgcgttcagcgccgcgctcagctcaggaggcgaccacgccgccgcggctcaggcgcagctcttcaagaaggccaacgaaggccacgtcatgcgttaggctaggcggcctctcgatcctctgtacttgaacgtactcgccacgtgaggcggattcgatgcgatgtacacgcgagcatgcgtgcaggttcatgtcggggtggggtttggagtaatccggcgtgtttgcaactttgcattatgtttgatctagagcggatggcctctggaataactataggagagttaagtacgtatgttttgttatccttttagagtccatggccgcacggaatgactacaggagtgttctctgtggccttttaattcagtatgtacttgtggcgttaagcatcagacgtgttctagtatttctagttctatgaactactggcatctttcaatttactcagctcttccataggattcaatactcgaaaccatatgcattgagatttgaatactcgaaactatgtagagaatgttgagaatgagcagttatgtgcatttgagcaactcctaaccacatgatcacaatctaacggtttagattacatcgctacactaccaaaagagtttggttgtttagggtgtgtttagattcagaggtgaaaatttttggcgtgtcacatcggatacaccaacacacatttaaagtattaaacgtaggctaataataaaataaattacataatccgcatgtaaactgcgagacgaatttattaagcctcattaattcgtcattagcaaatgtttactgtagcaccatattgtcaaatcatggcgtaattagacttaaaagattcgtctcgtaatttacacgtaaactatgtaattggttttttccgtccacatttaatactacatgcatacgtctaaacgttcgatgtggcagggtaaaaattttttggtgggatttaaaccgggcctagttcccaacttttcctttaaacttccaacttttccatcacatcaaaactttcttacacacacaaacttccaacttttccatcacatcgtttcaattttaatcaaacttttaattttgacgtgaactaaacacacacaaaatctctgtattgacaggaattgtactactgtgccatgcagtagttactgtagcagactcataatgccgttcacacaggatcagctctgtcctgtgctgcaaatgatcaacatccgagaggagacggtgaaaagtgagaacttgtaacggcgatgtcttctgcaagcctcggtaggcttccttcatattaggattgaggtttcaaggctagagacggtgaaaagactaccatagaacacggaacgagatcctacgtcagagggacgtccaatacgggatcactgttcgtagcgcatctgacggcaccaatcgttcgtagcgccagttcgttctccatcttcgacccagaagaccattcagtcgtcgtcgccgccgccgcctccgcctgcttggtcttatcgccgaggacgccgcctgccaagtccaacaaccacaccatgctagtcactcttcaacatggtcggcaagaaagtgtagtttccaccattgatgttggtgagctacacacctatgcagggaacgaatcgacggcagcttcatgcctggtgcagaagccagacgcacgcacaagtgttgatgaacctgcaatttgtagagcagccaggagtggccatggccgggcacgatggcggactgcggtgcccaaacagcagcggcaagctagagagacgctgtagccgacagcgtgatgaatggcaacgagagaggagtagtagtcggcgacgcggtggacggtgacgagcgagtagtggctccgcgacacccatttttcccttcgcgagcgaacaaagccagtgacgtggtggacgatggcgagcaagtagcggcacccggcgtcgccgatatttccccctcacgagcaaacgagagcagttgcaaatgaggaccacattgcgctattcatcaggagcgttggatgcttgggggcctgtggatcgaagagctactgccctctggcctctgacgtagttttcccaacgtcaaagatccggttccgtagaacacctaatacatgtcggctctataggtatcggaagtggtgaaatcaacacctacagtgcccttgccaccgacacgagtgcatgttagcacgaaccggcacctttctaaagaaataagtgccgttctaaagaaaaaccatcatcaatactataaataccagtttttataaaaaaaaacccgacatctttagtttagtttattgtaggtgctggttataaaacaccaacacctataataaattatatgtccagggttttttagaaagccaacatccgaaaaaatcgagccgagccaactgcgtcttatccagtcacacctgtccttatctcctcacccgtgactctctctccccctctcttgcgactctctctctttcttcctctcctccccacccgcgagccggtagcggtgtcctccacacccgcggtagcgcccttccctaacaccctcttccgcggtagcaacaggatggaggtggcagcagcgtgcggcagctagactggaggcggtagcacgaatatggcagttgtgggtggatctggtagtggcgacggctccctccaacccctctcgccaccctcccacggcggattaagcgctggtggtagccgcgagtggatctggtggctgttgcggtggtggtagccgccatgggtggatccgtcagcggtgacggcggccgagggcagatccaacgccggcgggagtgaagttcttggaagttctttgatgttgtgattccatgattccttttgtgattatgtgatgatgattgtggtttattttaggggtgcaaagtgtgattgattcgattccaagtggaatcggtatgtgactattgacttagtgttcttgaatgtttttggatttcttggattgatcggggtgaagggaagctactcggctcggtgcatcagctcgcgtcgagccgatgcatcgaaccagcttttttttattcgtggaacctcaaaggtgtcggttctaaactaacaccagatccggcacctatttgattttcacatcagtaccgccctcgtgatgccggttgggaaaaccgacacctaaggggatttctgtagtagtgaaaggggtagaggcctgttaaatatgtgatctgaattttagacttgcaatatattcaaataagtttcctaatagaacttgactattatgattagttccctagtatgacttttaagtctttcctcactaggacttctagatttctcctatatatatcctgagaaattgtaattattgaatttaaaaaataaattagaagctagctttctccgttttttagatttatagaaacttgttatcaaaccactggttcttaggctgcgttcaacaaatgcagtcagagattagttttcgtagcacgtgaaaagagacagaccattagcagataattaatcaataattattattataaacttaaaaaatgatttatttttatttttttaaagcaacttctataaaaaaatttcttgcaaaaaaacaacccctttggtagtttgggaagtctactaacgaaaaacgtggaagttataatttaaagttgaaagatagaatggggcttagaattttaagctattctaaaaagggcatgaagtcttttcctgctgaagcggaaggaataggtagcagcgctagcgaagatagagatgctaggccaggcctagctatagatggccaaatgggccgcccgacccggcacagcccaggcatgactgtgcctggccgaggccatttgggccggcacggcccaacatacacgtcgggtcatgccgcgctagcccacgggctgcacatacgatttaggcatggcccaataagactttggtcgtgccgggccaacccaaaggcacgacagcccatcgtgcttctccacagaataggtatattgttcatccctcaactatttgggctttgtctatattgctggaaaattagtctattttgtattcctcttctctttgggccttgccttatatggttgattaagtatattttgggtccctctattatttttcttccatcgtgccgggctatgccggcctatcgtgccgagggaacaggcccaggcacggcacgattgtcgggctaggccggcacgggcacaaccctagtcgggccgtgccgtgcttggaccagaccaaattaccgtgccttgggccgggccgtcgggcctcgggccatatggacatctgtaggcccagctagacgcctcggctagactacttatggcttgctttgcttcttgacaagacataaatactcaggacactaatgattttttgctaattacactacttaatatgcttagaactaataaatcactcttagaattaagcatttgcaccatggtatgtgaagagtggcccaatgatattttttttctagctccgcccacaactcgtatctatatactctatagatggccataaggcccgaggcccgaaggcccggcccatggcatgactttttggcccggcccaagcacagcatggcccgacttgggtcgggcccgtgccagcccggcccgatcgctgggccgtgtctgggcctccccgccggcacgctgtcgggccggcccggcacaatgggccggcaggccaggcccggcacacaaagtatagggactaaaaatagacatataaatgtaactgtccaaagaatagggatcttaaatagacttattagctatttatataccacagcccaaagaagagggaggtaaaatagacttttttagctatatatatatgtcacaacccaataggagggagggaaattagacttattccgaggcgtgttgggccctgcctgtgtcgtgagtgcggcacgtgggctggcacggcacggcccagtgtgtcggttgggccgtgccggcccgacaagcctcagcccaggccgtgcagtgccgggcggccccacatggccatctatatactccctccattccatccctccattccattttaagtgcaaccataaattttcgttcccaattttgataatccgtcttatttgaaaatttttttagtatttttattattatgagatgataaaacataaagtaggacttaatacgaaacttatgttttaatttttttaaaaaaaaattttcaaattagacagacggtcaaagttgtgcacggaaaattatagctgcacctaaattggaacggagagtgtatttgatatttcttggagcccagaagccagatatatcagtctcctaccaaacaattttttcgccggtttcctggcaaacagtatcaaaattttttggctgagggaaaaactagcgcgttgtttaccgtatcaaaatacaacaatcaatagcatagtgcacgtactgcaagtttgcaacagccaatggttcgataacaggctgatagcactgcggaaatcaaaatgacaagcataaaggccacaacagccaacagcgatcaactcaaatgctcaattagattgtactagatttgttttgaaaaaaaaatgtgcatactacacagtcccaccactcgcgtggtaagttcgaagaatctgtagcaacaaataaccaaaagtaacgagcgccggccgaggcaatggatagagctgggaatgaaccagagcagatcccaaaaccatataacgttgcaaacacaaaactgagacatttctttgcagggaacaaacaaggtatcaacgtaactataaaaaaactagctggacataacaccttatgcataaacatagcactattctagcgaagggtaacaattacagtgcaagctgacactagagaggaatctagtctattctattctattctattctattatatactaaaagtccattaaacttcctacaaacgctcctaagccgccacatggcgctcctacaaacactcctaaaccgccacgtggcactatctaatctcattgttgattttcacttagattggtgcaccgttaatttagaccattagattagatctattattaaaaaggtgatagtttttctaaaaaaatatgcaactggtggctgggaaaaggaaagaaaactaaatgtccatacgcaagtataattgagaaaaaaacaaataaagcttcctactgttaggcggaagaaaaagaaataaacatctacgtacgataaaaaatgataaagccaaaaaaatgtgtagttagtaccggtggaaaaaaccacggtctaatgtacgattttgtataatataaaatataatattacataatatacagaagtacatgcatgtaaactagatctataatataaatatcaaatatcaaatcaacggtctctaaatattatcttttaatttatttttaattgtatatccaatttatgatccattgtattcatttaattatataaagtaatgatgtataaaagtaatattatggtcttaaatacatcatgacacattgggtcgacatacaatatgtaactttagacactaaaaatctattaaacttcctacaaacgcttctaaatagccatttggcgcttctatgaacggttctacgccaccacgtggtgctctaataaattatagaaaaccttacaaattgtgagaaaaaaaaaatcatgcaatcatttttattggttgacctactattttaaaatattagattagatttatttaaaatacatctaatctgctcaaataataaaaaacacgtgaatagttatacgtatatatatacatacttccgtactttgctagcttaaaaaaaagaggaaaaaatgtaattaggattgaaaaaagaaggattagccatgccacggtcccacctaattgttacgagttacacgtacataggtacctttcacccaaaaaagtgaaaaaaaatctcaaatgtacaatgcatactactattcaccagattgagaaaaaaaattctcctgggtatgtacaaaccctgtcatcggctttcacttaaatcatttagaaaaattagaaaaataaaatctccatctcctcctcactctcacatctacgcaacactgtcgtcccctccctattgttttatctattaaattaaaagagaaacaataaataaagtttgatattttttaatacaaagtagaaacgtgggcactcacaacgcgcgtacactcacatctatgaacgcgcacatgcacatactcctatgagtactttcgagagactaggctgatatatattgagattgacaaagtcactatatatgtctcgctgtcgacgggtacgtcacctactactgaaagaatttgtcaagtctgggatatgaacctgagtgggtaaattccatcactacgaacctaaccggttgagctacgttcacttcacaataatgttggatattaaatcgaccataatttgtaagctacatttctagaatacttatatgccttttaaaccagtggaatcattatttctaacagttagatctatcttatataagaaaaaccagatgtgtatatatggtacatcacatttcaaaaatattattgtgcaattatatttcgatttcacattagcttgcatggaacttctgacccactctacatgaaatgttcatacatggatcggctctcaaattacattaatcatattagcctatataaatccatatatttaatggagcatcatgtcccacccaattaatcgttgaataaactatgataatatatatgcaattaaaaatgaaaaatagcttagttttactttacacttacttttcgttgacatgttttctaaagaaaataagtctaccttcttttcaagtgatgtagaagattataaataattgcttatagatattacttaaatatgatataatataaaactaataggttagaaaattataaaagaaattaatgtcgacaaaaacaatttatggaaaaatcgtggtagatgttcaccggttaatattttgctcttataagtgtctcaaacttagcatatgacacatgcccgcgcattcgcgcgggctaccttcctagttctttatagaactcaaacttctattatggcgcactactaaaaagccataatataggacttgtaggactagtcgggcaccttaatagagaaggtgccctttctactgtacagtgccccttgtttgatggatttacacatttccagattgtagattgctgccatctctaccagctgcagggtgcgatgcaaacctttccatggagacgtctcttaaatatggtattgtctttagcatcagtatgtaggaaggcgtgataaagatggttgttccaacagctgcccagaccgacgacatacccttgaaacaaatgattacaagaacaatatacactgccaatattatcaccatgctaattttctgcaaaaacaaatatcaaccagaaaaaggttagtaagtggaaataagtttcagcgggtgaaaaaaatgatattatggtgtaatggctggattcaatagctgtttgtagtggataaacaaaaaaaaccaatacatttgatttgttttgtagaaataaggctgagtagttgagtgacatgaaagtaaagttctatgtatacctaggaatttgctgcattggtggtgaaaattttcagcatggtgagcaataagacatcggtaactaagactcaaaattgggttgatttatacaaaataggtttctgaaacaaacctagacagaatcagtggttccgttatggtaatactgattgacttctgtcagatacgaatacaaatattatatactatagaagcacgacactggcacactgctaaaacaaaatagctatttggtttgatgtccaaacgagaccaaatttggcttgtttctctatttgaaatggccaaaacttagcagatcttgccgcatggatttggcaatgcaaagttcagcttgaattttatgtgattattagtttggaaaataagaaaggtccaaattttaaccgactgttggaaagattgctcggtgccaaactgcccgcagtcagtttgtattgaatcgaacagttttaccagatagggacaccaaaaaattcgtgctgggtgagacacatcagacagggattgaaataaaaagcgggccgtagccttcgatccaaaaacatcagtcagggaggcaggattacagctagaaattaggaagggggatctgaagcttgacttacactgagcacgttcgccaatatttgattcttggtgtcagtttccccctgcttcgtctcgcatccatcaatatcctggcctttctcaagatcgacgaattcggttggttttgtttctccccctttctcaaaatcgacgggcttgggaagctccatctaatccttgtgagattgcctagagattccctgtcttgctctcctaggtaaggcggcgagagcttcttgcagatcttacaaatgcgcgctacggcggcttcgttggggaatatgtgagatggagaactctccgattccgaacactaacgaagaattacgcgcacgcctctccgattccaagtctgtctccaacaccttcacggattcacttacgaagcgcgggttcaaggtgaccgcgtagaatcacattccctcctctgctcccgtcgccgctgctcccggagtagctgaccatggagtggctggcgtctcgctggcgtacgccgacgtcagctcctcggactcctcccctcccatcgccgctgctcccgccgtagcggaccatggattggccgcgcgccgtcgtgctgtcggacgccggagggtcccagcaatgctctggtctccatcgattcgcgcctgagatgctaaaaatgctgtgataaaccctagtgtccgacagtccgaggtacggtggcggcggcggcggaggagctaataagctctatcagccttcccccgttccccgtcgtccggtggacaggttagtgaacaatggatgtcggatcaatgcaaatgtcacataatcctcttgataagggctcttttggaataaaagatttttaaaggattgaattcctataaaaaaaactttaaagctttcttgaaaaatcattaggattgtaccaaatagagattttagagaaaacttagcaagagttccaacctcttaaaaaaatttatgaatctatctcttgaaaaaaaatattatgcaatactctaatatttgtttgaatcaaataaataccatgtatttaaacaagtaaacaaacaaacaatactaataagaaatatttttctatctatgacaaatcgttatatattttcttttacctatagcagagcatgggtattttactgtgtagtagtaggtagtgtgatataattaacggcaaacatagctagcatgtcgactattccaattttctaaaaaagatttcaagtaaaaaaatatagataattttatatcatacttcctccgtttaatattacaagatgttttgcctttttttatagtcaaatttctttatattcgatcaaatctatagaaaacatagtaacatttcaaacacaaaataaacatactatagaaacatatttaatggaactagttttttgtggatgttgttttttttctatagatttgattgagtaaacttgtccaatttaatagtgggatcaatatatttttataaatgatacgaattagattacacctacatttcgagggaataaaagtggacttattatgcatgagtttacgcgggcctgtgtagcccaaacccaattccactcttgggctggttagctttctagcccaatattacacgatgcagcaaagtgccgcgcgtgcagccagtaagaatgtactccatccattcacttcagctagatttcttgacagccactttggttgacgccttgacggtaccaaactgttgaaccggccaggcgcactactagagttctcatacaggtcatatccatctttgatctttattgaagcccaacggccagagatgtaaatctccttcctgccaaacattgtttttcctccgggcctcctgccaaacaattaggccattcgtgcatgcgtgcgacttaaggggaaaactagcacgtagtttagtgtttaccatatcaaaatgcatccgtcagtagtgaaagtttacaagttgcaacagccaatggttcgattgaagactatacgtagtccccattcagcttacaggcgtcgtagttgggttgcggtggcaattcaatacggctatacggccggccggtgcgagagccctcgcgcaacaaccgtataaatcgtctgcatttattcgtcagaagctcaagctcagctcagatatggatcgcacgcatttgtgtccccctggtttgacattcggttgattcacgacctcgaatgaaagagcccacttgctggactggatgtacgacgcactgaaaatctgaggcatccttgtttctcatcgatctgttggcaattcgttcccattagctttgacaaaagcttctcctttcgcagctcaggacagttcagagagcgggaccatagacgtactgtacctcctatagtccatagatcgacacttccgagttcagactttggaggaaggctagagattgaggtacggctaatgagctaagataatgaaacaaccaaaaaaattataggtaattttttatatgtatttgaattgtttgtggcttaataactaaatatagctagtaatgaaaaatacactaatactctcaaggttccagaataattttatttttggtcctcctatttatcctaaaacaagttgacttttaaataatcctagattattatattctgaaatggagagagtaatactaatgtaggcatagattagacttttactagtactacaaatctaaatatggagttgattcattgaactatggctgtgtttagtttcaaagtttggggagaagtttggtagtttggaaaaaaagttaggagtttatgtgaataggaaagttttggatgtgatgtgatctgatggaaagtttagagattgggggaagtttggtgtgaactaaacagggcatatggcatgtctaatactccatccgtcccataatatgataagggtttggaggaatgtgacacagtactatgaatcgatatgttatatttgggacagagggcgtatgtgactagattattatattttaggacggagagggtaatttcatcgggattgataaagtggtgatattctagtttttttaatgtgtaggatatgtgaaaaataaattatttaagacaaagagaatataactctaaacttaaatttaaaaaattatttttttctacggctacaagcaggcgataattcaaaaatcaagtgttacagatgcaactgacctgcagacagaaccagctgaggttcaaaagaaaagacaagtgtcaaccgacgagctgcatcctgtattgggttttccctgttcgaaagaactgaagaatgtactactagcgtcattacaaaccagtcgtccccttgtagtttgttgctcacgcaatcatcaatgcgcgcaagcgcaaccatcgaaaagctccggtgccgaatcagatcagtggatgattttttacttggatttccttttggcaaattgacccccatcagaatgtcaaaccgtggttgttatcttttgatgtactccacctgtattgcgcgcatgcatgcgttgtcaccgccggcccatttcatgggcgcgccacgacaacatctgctgcaggtttgtggagctctggcctcactctcgtacaagtgcggtgaggtaacagatcaccaagtaatgtgcacgccaaagtcatcgtttgaggtgtcgaaaaaggagcgattcatgaattcaatacagtactactgtactagtatcaatttattacaggaacagactctgtttgtgagctacgtgtactcatcatcttaaattacgggagtacagactacagagctccgcacttccgctacaaaaaagccacagatatcctttacatctgctccatcctttccttcatcacggcataagtttgcggatgctgtcaaggagtatatggtactcctaggtactcctactaacacaactacacaagcgaggatgtttaggtgttaggacattaggtgcactgttaaaagtggagaaaagtaccgagtcctgcttgaagtactagcaagctgaaacgacatgactactagagcaaagtcaataatgcagctaacaacggacggtaaaacggcccatgtcagatagtgcagctaatactaaaagctcagtttttactagatcagtccatcatgtgattgggtggtgttaggttggccccacaaaatgtgtgaaaagctacgctgtaaccggacagtaaaataagcgttggcttatttctctctcctaagttctctctcctccatatagaaattaaatgatgtgtcatattttgaagcctgactagtcagcttattgtacctgctctactgatcttcccatcagctgttattcactgttgacgctggccccggctagtgatgtccacactccacagatcgtcaccgttatccattgatatcggtgggggcagtttggtaacaggctaggctagatgcacgggtacgcttggcagcattttgcccacattggtccctggtacggtaaaaatccaagttcagtctccattaaatcctacaggaccagcaacggagcctatagttacatacacacgaaccacactcttagctactatctctatcttaaaataagtttatttttagcttctttcaaaaaaaaaaaaactaaatatcacctactgtatcataataagtttattttttagcttattttatttgttccaaaatatgtttttaaaataactattgtatcaatgttcgtgaaagtaaaaaaacagtagtattaagagtagataaagcaaaaaatatttgcattagtatttgataaagtaggtggattatagttttttttttgtttttattgttatgtgtgagataggtgaaatttttttaagggaaaacaacactagaatagtttactgaaaataaatttgtactccctccgtttcaaaatgtttgacaccgttgactttttaacacatgtttgatcgttcgtcttattaaaaaaaattgtgaaatatgtaaaactatatgtgtacataaaagtatatttaataatgaatcaagttatatgaaaagaataaataattacttaaattttatgaataagacgaatggtcaaacacgtactaaaaagtcaacggtgtcaaacattttgaaacggagggagtagtattttagaacggaggtaacgtagcaaacattttaggacaggtgaagtaagttacatcatgtagtggcattagacaatttaatagtttactgacactagcaatacggtagggaggggacaaaaattgagttgctgctgcgaggtgcaaagagcagcgatgtgcggcgccatttcgcgttgaatcttcagtactattattcactaatccgattaagcagacgaccctagtacagtacaggtatgggtaggagtttacgcgcggttacgccgtgcaagtgcgaaagctcagcggtgggcgatcgctgccaagtcggttgataccagcagaagtgctcgtcccaggagccaatgataagagccaaaaccgacgggctcattctccagcttaactctcacaggtggtactaactgctggcctctggcataactccgactggccgcctgccaccacccccacgcttagtagcattcaaacaagatgcacgccatgcctgggtcagccagcatccaaatccaactcactcgagcgcgagctagcccagccgtcacatgggagatatcgtgcgtacgcttaactaacgagacaaagggccacataattatgcgggggctcatgaccaattaattaacggtgttttgcatgcgagtgcgacgccgcagcgctgcactgcactccactccactccacggcagtctgcagacgcggataagcgtttcgaccgatcgggccgcggcgcgagggaggggatcggtgcgcgcgtcgcagtcacgcccgtgtcggtggtctccctccccctcgcgagcgattcaggtcgctttccgtggtcgaacccggcaaatcccatcgtcccattcattcgctcactcatcgacccgccctccccctccgccgctgccagattcgccgcgccccctaccaggctaccacctttgccacaccctcccagacctcgcatcgcacactgatgcggtgatgcccgcaccgtgccatctctctctcttttttacttctcgggctttccttagtttccttcgttttcccacacgcccacgcgcggacgccgcgtacttagctagcaaggctagctagaagctcccatacttgcacgtacgctttcccattctcttttgcttaaaccgagctagagctttgctagctcagttcgtccatgagagcagcagcggcgggtcggcagcctcgcttgtagctagcgataatgaaggtctacatcacgtcggcggcgccgctggctggcgaggcaacgaaggcgatggcgtcgccgccgtcgccgccgccgcaccagcaccagcaagcggcaacaaggcgcgggtgccggtcggctgtcgtgacggggctcctcgccggcgtgctcctcttccgcgccgcgctcctcaccatcgaggccggcgcatccctctgcccttccaccaccggtaagttttcacttcgcacgcaccgaggccaccggcggctgcttggtgaattgcccattttcgtttgcgatatgatcatctctgacgcgattggccaatgctccaggatgcttggactggagggccggtctcggggactggctgtacggcggcagcggcgacgcgatggaggtgagtctttactggtcactggtggtgtgctagtgttaggccggcgcgtgcactgactgcaccttcgatcgtgcgactaacacagtcagagtgcgttaggaaacaggggtgacttttatgcgccggggttttgacatttgttttactacttttgcgcgcggcggggcaaagctgtagtacgggacgaaacacgccgttgggcacggagctcctcacgcggttggggcgatttttttttccgcatggttcggctcgctagcagtaagcgccattcacgggaaggggaatggaatgtcagggccgcgtcggcaacacgtcgcggcgttcctaccacgtgccccgcggccgcccacgctgacaggtggggccagtcgatccgatccagagtgctgcatgctctggattctcaattttttgttaaccactgtcacagtcggccgttgtcagctctcgcctctcggtcattggtcaatccattccgcccccagctacggctcaccggctgaattcaaatgcagaccagtaagccaagtaccacccactagtgttgttttgctcttggagaagtaccccaagttgaattacacaaaaaaatcgtgaaattagtagtactccagtacctttctcagtcaacttgtaccagaaaaacggcctaatccgacgaggagttatctatgcactggttggcgatttgcgcgacccttgccattggcatcattcctcgagggccctaccatagttggtggcggcttgggatattgtgttgccagccgctacggtgcccggcacttgtgacgtgctcgtgaggattctctcgcgctggtggcctgcgctccagctaggacatgctcgtaaagatggcgcccttgcgtttggagctacgtggccttttcagttccgactatacagcggcccttttggcccgtgaccgtgagcctgagccactagctattcatgaacgcgtacggtaggcataacccctgtggtttttagtgctctcgtgtcacattgtacatggactggacgcctaatgtacgggatccaatcaacgatgagctaatcagtactctagtactaatgaccattttaagcaagaccatgtactgtgacagtttgtgtttttcttcactgggtgtgactagttatatactatatccatgtttttctttttctttttttgagaacatactatatccatcttgattgagtttatgaatataagaatgctgattttcgatcgatgcgtggaatggtcaggaattcatgaaggagtggaggagaggtcgcagggaggccagcctgttggatcccgtggtggtggaggcggcaccggattcgctggacggcctcatggcggagatggacaccatgctggcgtcctacgatcggctggacatggaagccgtggtgctcaagattatggccatggtataaaacttatcagcccatattccgacgcgctttctctattacgaactttgctaatctttactgaactttttattagtcttgtatcatgcttgcatgttactggcacctttgctgaaacgagtgctttccacgcctaaagaccacacatcatatggtccatgtgtcttgcatcctgccttgaaattagagaagcggaacgtatggtcatgcatgctctccactaaatctccggttaaacatgcaaacgtcacttttttaggcgtgtccagttgaaatgactgcaacttgaagcgttctttggctgtgtttacttcctgaaattagaaagaagtttggggaaaattgttagtttggaaaaaaagttaagagtttatatgtgtaggaaagttttggatgtgatgtgatataatggaaagttgggggttggggggaagtttggtgtgaactaaacagggtctcatttgtaggagtaggattagattcttttgtagctagggttaggattagaccgtgttgacacttgacactacaatccaaaaatgaattatcgagctttgatccattaatagtactcctatattgcaagttgcaacaactatattcgtcgattttttattggggataatcttgaagcagctgctgaaaatggatcggaaggttaagtcgtccaggatcagagccctgttcaaccggcacctggcctcgctgggcatcccaaagagcatgcactgcctcacactgcggcttgccgaggagttcgcggtgaactccgcggcccgctcgccggtgccgctgccggagcacgcgcctcgcctggccgacgcctcgtacctccacgtcaccatcgtgacagacaacgtgctcgccgccgccgtcgccgtggcttccgccgtcaggagctcggccgagccagcgaggctggtgttccacgtcgtcaccgacaagaagagctacgtgccgatgcactcgtggttcgcgctgcacccggtttccccggcggtggtcgaggtcaagggcctccaccagttcgactggcgcgacggcggtgccatcgcctctgtcatgaggacgatcgaagaggttcagaggagctcaatggagtatcaccagtgtgacgcgtcagttgtcagggaatacaggaggctcgaagcctccaagccaagcacgttctctcttctcaactacctcaagatccacctcccagaggtataaatcaaggcaacaattggacaaagatcacgcctacatgcctacatttgcctgacattaatttgacgtctggagatatatctgatgcgttttgcttgagcagttcttcccggagctcgggagggtgatacttcttgacgacgacgtcgtggtgcgaaaggacctgaccgggctgtgggagcagcacctcggcgagaacatcataggcgccgtcggcgggcacaaccccggcgaagacggggtcgtctgcatcgagaagacgctcggtgatcacctgaatttcactgaccccgaagtgtcaaacgtactcgaaagtgcgagatgcgcgtggtcgtggggtgtcaacgtcgtcaacctcgacgcatggcgaagaacaaatgtcaccgacacgtaccagctctggctagagaaggcaattagctctctgattctcttgaacatggatgccgttttcttggttacagtactaatgacaaaacatttttttcccctgtgactgtcgcgtgcaatgcagaaccgggagtcgggattcaggctgtggaagatgggctcgctgccgccggcgctgatagcgttcgacggccgggtgcaggcggtggagccgcggtggcatctgcggggcctcggctggcacacgccggacggcgagcagctgcagcgctcagccgtgctgcatttcagcgggccgaggaagccctggctggaggtcgcgttcccggagctccgggaactatggctcggccacctcaacagatcagacagctttctacaaggatgcggcgtagtcgagtaacacagtaaacgacacagcagcaattgagctgggaaagagtatataagtatagacgatttggttcgagatctccatgtggcgcagagctgggttcatgtcttcatgaggagagggaagtaggtgctgccttcagtctctcctcgctctggctctacgtgcaacatgttcagtgacacagtgtagaattgtatagtgacgatgtatataagggctgttatctatttcttggttatagaactaaatgaaaaactagatgcaaccacacgcatttatagaataactatgtcactgaatgaaaaactaaatgaaaaatgatgctagacatggtagaataactatgctaaacatattagaacaatactaaaattgaatatcaagcacagtgtagtgctggtgcatttgtttggtaacttagcagatgtacaatatgaatgtgctagtatatgattagtgattacactgtaatataaaactacttttctgagaacaaaacacaatcaattaatcacgctctctcagaaagactccacttgagtagtagaatagatcattcttaatattttccgatacggtcagacatatataattatggggaaaaaaggcttgaaatttacagccaaatgttaagaactgacagaaaaaatggtagctttggaaccttgatcgattgctactccatccgcttgagattataagtcgttgtgactttgatcaaagtcaaactacgcaaagtttgacttacacaaagtttatagacaaatatagtaatatttacaacaccaaattagtttcgtcaaatcaataatctattatattattaaaggaatagaaaaagaagcctccacgttcactctaatggcctagaaattctcacattaatcgcagaaaaagaaacaaacagagtccatataggaatacaatttaataatagctgaaattcggaattaagaataagaaataggaaggtaagactagagtccatatcggtatacaatagaactaatagaaattcggaattaaaaaataagaaaaaataaatgtagaggttagagtccatctagaaatataatttagaaattaaaaaattcaaaatttaaaaaatattggatgaagactatagagttcagatagaaatagaatttaaaaataattaaaattcggaatttaaaaatattgaaagataagtttagaatccatatatagaaatataatttagaaataataaaaattaggaattaaaataaggaatattggaagaagagtatagaatccatacaagaatttaaaattcagaataaaactaataaaattaaagtagaatttggagtactaaaattagaaatttaaaaaaggaatattggaagttcgctctcatgagacacgcaaaattatgttgtcattttaatatatttgaataatacattgagaaaacatatatattattataagacagaaaatataatatgatgtgtcggtgacatgggaccgggagtatcatgacttagagacttgaggcagacacgatcacccacgtggcctaaccccctcggggggtcgggcccgagggtgatacggccgcccttctctttgtctccccgaggggtcggaccgctcccgtctcggccccgagggccgaggcgccccgaccccttgtggattttgcgcngngnatatggnnangnnagnnnancngcgctcacctaaccgcatttattgcggtttggacgagcgcgtcacgccgcatgtaacgcagtgcagcgcgctcgttcgtccggtctgtgatcagtcacagaccggtcagatcgtgggctaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagagcgaacatgcagattgttaaactgacacgtggtggacaagaatgaccgatttgtgactggtctgacaatggtcatgtcgtcagcagacagccatgttcccacgtcgcgcctgcttccggcggaagtggaggtaggtatgtgccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaaagggaggagaggagaaacgatcccagaacgatcgggggctggctcgcactttgtagcttcttcatacacagatccaccaaaacacaggagtagggttttacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatgatgctagccacgcaatctgcgcgggccaccatgctaattaaatatattttaacaatatagttgtcttggattaaaaatgttactacctttttttacaagctcaattaaacttagagcagtttgactttgattaaagttaaaatgacttataatctgaaatggagggagtacttcttagaatcagtagcacaagtaaggttgatgtagcaggaaaaaaaatgactgtttgagttgctgaataatgccacatgattcttgtattttacctgttaagataaattgttttaacaggtaaaatacaaataagttcctgatgttagctccaacggccgagatagcaaaatattagagaatatactttctgcattctagtatcacatggcaaaccaaatgttggcatgttgccaaataattgaagtgatggtggtaatactgaaaaagaagttgtatcatctgattcaacgtattagctcatcgcaggatattttttagataaaatttgctataagacattcaaagattatggtctttgctatgagacacccgaagaacgtgaatcttttcatggacactgtaaaaatgtggtaattagctgctggacactccttttattattttattatttctagttgaaacggagagggaaatatttgtaaaaggcaactttgcccttgggtcaatagtgtttagcccgctgtagttggtttgaacagacccattccccattcagtctgatgatcccctatcctccaaaccctagggttaggtgcggcggcgatctgcggcaacggcggcgagctccggtgactacggtggcagattgaggtggccggcgagctgggccgctagcagattcgagcagagaagtacgatggaggggagcagcggtggaagcggtggaatcgagcggttgattcgagcagcaggggaagaatcaagaagcgagatggatcaatcattgtacatgggctcatcgtcaacgcgtaacccagtcacaggcgaggccgcggaggcagatgcagcaacgtgaggatgggcggcggcggtggaggccgcgggctgtgcctacgtctgctcaggctccggtggctccgccgcgctgtggcgctgtgtggcggctcgcggagctctgcgtcgtggcgctgtctggcccgctcgtggccggggcggcggcggcgcccgacgcgccagtaccgtgcgccgtcgtcgccgttgactcctacgccttcgccgcgccgttcgtcccggccgtgctgctgaagcgcgcgagaaaaggctactaattacacaacgcctaagtacatatacgtgacagtttattaacaccaattatatgaaagctatgaacgctataaattctgtccaattctgtacttctgtgtgtatacaagccagccgattgttgatccatcattgaaccgatttggtgcctgaaagttgtgacgttaaatcatgtcgaccagcgtttacaagcaaatcggcgcagggggcattttggtactttcatcattctttctctctccgcttcagccaaaaataataaaataatgagaggagtgtccagcagctaattatcacatttttatagtgtcaacggaaagattcacgttcttcgggtgtctcacagcaaagaccacaatctttaagtgtcctgtagcaaattttgcctatttcttatactgaggctaagccaaaacttgaagttttttttaatagctactcctctcctctctcccaccgccgcaccgcgtgctgctcctctcggccactgagcttgcgcgctccatggccgacaacagccttggtgcgactatcattgccggatccgacagagaactcgatagctcttcttctttgcacgtggagagggaaaaaggtggcggggggcagtggccaacccttctcgccatcgaggggagtgggaagggaggaggcagggaggctggcgagcgggcggaaaagaaatgaggccagcgagtggggcatggagggcgggagacgaggagaccggactaccccgcgaccgtcgccttcagacatcgatcttggcgagcaggcatcagggaagcccggaagggcacggggatcgtcgtcgggccaaaggtggtcgtcgcagcagcaggggaggttgggctcgttgtacttcggcgggagcggctcggacgactgtggcaacaacggggatgactccgatgactctcctggcctcgccgcctccttcctctccacacgctcgtctagttttgactcaccgaccattgcccttctccctctccgtttctccgtgtgctctcgcacgtggagatagagaggagagtgggacccactaacatgtgggtcctatttttatttttccttttgtctggctggcatgtgggcccatattttaaaaataatttatactcctactttatattttgcttacaatgccacatcacagccaccacgtaggataatgaccaagtcaaaccagctatgtagatgccacgtcagtcagaaccgccatccaaaccgccgagattgctcatccacaccggtttatctgtattgcagttaagggatgaaaattgaactcgcgtcaagtaaagggcccacggggatttcggcccgcccgaaatgaacaagccctcggcgtcggcgctctcctcctcctcgtgagttcgcccgccgcctgcgccgatccccatccatcccgtgagctagcagaggcgccgtcgtggtcgccgtcgttcgtcctgctgcttccgccgcatcccggtgagcatccatcagttacgcgcatcctcttgctcatctctccctacccacgcgctttttcctccaatttgaacaccctttgtttctcttctagacctggaagctcttctcttaatttgccttaaacctcaatactaatagcagtttgtttgttcccccagatccgccactgctgaacggggtgctttcgccatgtcgaggctgcgggcgctgtggcaagcctccgttaacgccaccaggcgaggtagctgcctgccgcaaacctaattttgccgcgctagtcgtatgctgggtttatttcctcaaacgaaactcctttacctgcgtttgctcatttttaaggccatttgaaatgtttactggaaaggccatatgagatcctcaaatgatgaataactatggcataaggattttagacacgggatgggaattcaagtgtgtaacagctcagtactagttatgttgatgtttattcagacagttggaggtttcttctagcattttgatttatttaaaatggatgctgctggatcgcaagttggcttcagttgttagctatgacattctaagatgcttttaatcttcatttagagtaataactcattatgtttgtctatgtcataattctttcatcctacatacgaaatttgcagccattgtgtggaattcagaagacctaatcccaccaagtgaaaagtacatcttcaattttaattcaaaagatgagctgaaaaggtggcacttgtattcagattccgagtatggaggtaatgcctcactttcaagtttttctttgcacgaatattagttttcgtgattgtcctgaataactgaacggtagaatagactaacttatattgtatatgttgtgattgtgaggtactcatggaatattcatgttctaagactttgcctggcactggaaatgttcctttgtttttattctcagaatacatgggaaaaatatgcaaattcccaagggctcaatttttatatgtatatgttacgattcaaagtttcattgtgattctaattctatgcatagaacaaaaatgaataaagctaggaaagttctctttcagagaacatcagaaaaaaaagttttctcttgaattcttgtagctcttgcagctttctaacatagttcctggatattctgacatagttactggattagtcgatcacttttagctccattcttgtcaagaggcttcactgtatacttctctcagacgatacatttcactatttcagtgtaaatattgcatgccaataactcattgatttaatgagttttcccttcgtttttcacctacatttggtcttttactttgtattaccaagaatgttccacaaagggctatatctaatacaaatatatgtggcttactatctgctatagtgatccaaatgggaatctgcctgctccttgtgctttcattccctggatgttctacaacggatacatcagtgtagtatcaattggtagttgctaaaccagtggattagatagtctgggatgtaaacctccttcaatatgatgggtagatcgttaatgcttcagtgtgttgtgatatgctggtgccttagcctcacaatagtacctggaataaacaaatgtttatttctttgtgtcttttgggtgggtgacctttctggcatgttcattaaacttcactaatatttgttggcacattttgtaactgataggcaagctctttattcacatctatggaatgatttgattgaaaggaattgttatccaggtttatcatctgcatcattggagataactgatggtggtgctggtggggatacttcatcaactggtactctgatgttttgacgtcccctttttcagggtttccttagagtgcattttcagtacaaagagggaaaactggaaaatagtttatttatctgctgttatatatagcttatgagtacaaattaacctgttgaactatggagtgtcttctagtgttgttattctcatgaatctcatatgtccttgccaacttaccagataataccagcttgctgtcttggcttttgtaattggaaagaaagcggcctttttttcatggttttgttagatttcatgcctgattcacttaatttaatttttataagctttgacagttttgcaactatttttccaacatatgcattctggaaggtctcttttctggcaatctctctttggatatgtctgagggatcaacatggaagataaggcgtagtggtttctgtggaatgagatcaaagaaggtaaagtgatattgacttggtcattgctcaatatctgtagatgctattatgctgataaacccttatttctttctccgtttcagtttaatggtttcattgatcttgatgcatatgatactatagcgatgaaactcagaggggatggaagatgctacatatctactgtatgtatcctcatcctgagacagtattgaatgtgcgatatcaagttaatacgttgctatataatctgaatcttaattaaacagatatacacagagaactgggtgaattcacctggacaacaggaagataattcgtggcaagcctttgtgtacttaccccaggacagatggcaaatcatgaaggtaatttcaattcgaagttgaaagatatggtttttgatgatacgacagcacttgtcctttctttcagatccctcttgattcgtatctacccacatggagaggaaatgtgatcgaagcaaagatggaaatgaaccctgctcgtgttgtgggaatgtctctatccgtaaatgctgagggcggtgtacctggtgcaaagactggaccaggtgattttaggctagaggttgattggatcaaggcattgaggacactctgaatttgtggtttccacaaatcggtctttttgtaggatttctcagggctggaaatttcttaccggcactttttcatgtgataattgctgaatatcacgaggcatggagatgcgtcatgcagtttgtattactcctagtcaatacaatgggacatcgaaaggaggcaactgttcagcgcagatgaataatgaggtctcttttgcttttgggggaaatgaatatacaaatgtatcacctgtttcttatggctgtctgaacatacgttacttccttgctactgtgtccgatgaatttttatccattccgcatcaactgatacctgcaggagacggtttgtacttggcttcccattttgcggtggaactggcgagctcgtgcttggtggcggctttgcccgcctgctaaatttgcacgttttggtcaaacaacacatgcattcattttcaggtttccgtagcagcaaaaacaccatgataaattggcagtgcacagccgcaacggaaacttctcagtgcaatcgtgcgtggataaacaaacaacggtggatatttcaaaaacgatctttcaaacaaaaaggtcgatatttcaaaatgcattttcaggaactgtacacaagacacacttgaattagtccataatcagaatcctaactcaggcacacatggcgaagcttcctttcctacaagagcaatatttgctcatggaccacacgtccacaccatgacaccgcaactaattaaggggaacgaacaaaaatgggagcacccagtgcaagccgagaggacgacggacgggtgtttggcgaccagtcgtcgtccactcctctgcatgcatgtgtgcacaaacgacgggtcagccgtgccgggtcatccttcaatgaacccggtcatccgcagcacggagttgcgcaggtggctgaggtcgcggcgcgcccgcccggtccccgtccgcagcgagaacgcctgatccccctcctccgtcgaccgcctccgcgacaccatcacgtggggcggcaccatcgtccccccgccgcagtcgtcgccctggtcgccgccgctccaccgctgcgcggccctgggaatgtccaccggccgagagctcgccgtggagcagtggcgcgtgatctgctgctggccccgccgagccggcgtcggcgcggtcgccgtcgccgtcgccgtcggcgggacgacgtcgtgtggcgactggtgatccggccacagcacgtcggactcgtacagctcctctcccatcgtcgccatgcgcgcgcacgcacgcacaaaccaagctacctgtgaagcgtcgatgcgtttggggtttggacgtttgggccttggtagtttggtttagcttttctctctgtgcgacgacgagcgcccgcggggcgtatatataggcgtggtgcggctggcgccacctacgtgtcgagtagcttgcgacgtacgactagccgcccgccgagccgcgcgaggaaggaagagatgcgcccacggaaagggatccgggttctatcgggtccggtcgttcggatcggatcagatgacgaattcaattacggagtcaacaaaaggctcgtgtcggtcaatacaaccaaaataaacgtggctcgtctctttgccagagcggccgcctccttcttttactgcccgacatgatgatgaaacggaaattggtcgtacgtgcatgcgaggtaaggaaggtgcatgcttgccacctgcactgtacagctagtacataacacagcgggcacgggcaatgtgcttattactcgtgtgggtaagttctgacgggattaaagatttcatttgtgattacagacttgaacccaggttaaatcgaagactaacctcgggtgcctcagggtcatcatcgcggagcgtccacgcgtcctctgccacgcatgtactcctactcgcgtaatctcttgcatgccttccgctgggaagcaagaggaatctaggggttagcattcttaattccagctttacctttctcttaagcatctatatcaccgctaaatattgcaaatttattcgtggttccttgctagcaacgcacgatcgcgatctctgtttcgtcgtttgcgtgcggccaccgagtccgcacgcaccacacgcggatatgcgtacgcggcgcccggacggaagaagcatcaggctacaggctgggaaggcttccacgtacgctgcactcaacgcgtcctgtgccgaattttttatttataatactaagtaatatttaaattaaataattagtaattctctaggaggattaaccaaaataggatggacgatcattcaaacagcgtccagacatggatgctactataaacaacgtccacctttctggtgcagtcagaccatcactacgccaccaatacgctaagagaagtatctatctatctatcttctattatatactaaaagtccattaaactttctacaaaagctctcaagccgccacgtggcgctcctacaaacgctcctagatcagcacgaggagcttaaacatccaaccatcggttttcatttaatctggtggacccattatttttaaccactagatttttattttaagaaaaaaacaaatcaatctatctaaaaaaaatcccacgttactcggccgtgtcccggatctgtacgtccgtatgtccgatgtacgtacatatcccctctatgtccttttctttttctttcttatatacttagattagatgaaaaaataaaaagttcatgttaaccatatattttaagttgtaaaaatatatgttattttaagttttattctaaataacgcatctcattgaaacatccataaaaaatattaataattaacattatagactatatgattgtatatcacaattaaattggacttataattaaaaaacaatttaaattttgagtagcattttaaaaatttactcactccctattgtgtaatactgatatatccaaataacattattaaatttatcaagaatgtattttcatatattctatgtttctgtattcatattttttttggaaaattaacaaccatatatattttttacaccatgtggatgcccttttatctcttaagcttcattcggtctatctcattggataagcttatttaggacacgcgaaacaaagcatgccatcagcgtaagattaattaagtatcaaatattgcatatcctgtgcttatctaagaaaaaatatatagaaaaatggttctatacacccaggagtacgtactgtatatatataagggtcatcctatatataaaaaataaaatctagctacttatttatacataacccgtggatatattattttcaaccattattttatatctatatctacgcaagagatgtcataaaggaaaaaaaagaagaatgtgtacaagatcagctccatcgagtagttttttctttctttctttgtggctctgagattttcctcaaattgtgcatatgagtagcaaccacccttggcgagtttgtcaaagaattcacgcggccgcagcaccgcttcacgccatctcgctaaattttttggaagtatttttttactaatgatttataaggcaatcacgtttccttaaaaaaagcaatcacgagcgcatatataaacgtgtgctcacccatcatataaatacacatacacacacctaccctaagagaaaaaatatttgtctccaaaaaagggaaaaagtatgtgcttagtatttgctagaaaaaaacatatacacatatcatcgaaaatgctgcatagaaccacattatatctttttaattatgtcattctcatctatataatgttaataattaggacaaataattttgacaatatagattattccatcgtatattacccatgaacatacataggtaaatcagatgtataataaaagaaaaaacaaaacaaaaaatatattagtttatatgtttgcgaatgatggtgagagatcagattatatataaccgggacaattcgtaccgttcttattatttaagggtgtaatttagactttttccttaaaagtcttccacataaggatttataataaaaaaaattaatcaacactaaacttcctacaaacgcttttaagcctccacgtggcatcctataaatattcctaagccgccacgtggcatcctataaattagagaaattcttaaaaggacacaacgtataaccgttgatttttattaaattttgtagaccattatttgtaaccattagatttattagaaaaaacatacttatccctaggcccacctcggccttggcaattgcatgtacgtacttacgtacgtctgctcaaccccccccccccccctaattctttcaccccttttttcacctattttttctcctatttttaatcttttagaaaagaaaaaattgtatgccaaataattaagcaaatgcagcatctaaattataatgctaatatttgatctgcttatgtctttagatattttatattttaaaactcatgtcctctttaattcaactgtaaagagataaatgtcatattaattggggctacattttctgacttttgcgtgtcatttaagcaattttaaaactaaaaaaattaatgatatatatttttgtcatcgtatataacttgataataattaaattatatctaataaaagtaaaatgaacagatctatgagtaatattaaaaaaatagcccccgccccaacgttgtaacacagtaaaaagtacacatcttataattacttctaagatattatgtctttctcttaaatcagagaaaatacactcttaagatattacgtcgttcttttaaataagagaaaatcgtaaaaattctgacaagaaaacaaaacattcgaccatcagcttcgacttaaacatctgacacataattttagtttgttagattaatcatttagaaaaagaacatccgaaatctcccttcctccctgctcgcgtacaacgtgcgccattcttttctctctattttttatctccttatcaactgaaattaaaattatctatatgtaaaaaagacacaaatagacctccatctattacttgtatcttgtcaggcgtctaacgactttctactaacttaattaatttctcttaacatgcctatgagggctatgtacctatacaaattgaccttgatacttttaaaacgatcttattaggagataaataaatatttataagaaagatgatcatagcatcccaattacacatatgatctatgaagtcactaatcataataggtattcatctagcaatatagacaataggttaaaaataaatgtgtggccagttgaacatcataccaataagtatgtgggttacacctaggaatcttaacagtgaaacaaccttgaggcggcctttacaattggaaattgagcaaatgttgctagatttaaaacccactgtaaatagaaaaattcaaacattttctgagttctgtttgaatgaaaaaatatataaaataaaatacaatcaatcaaaaaattgatattattggatttttttgggttgtaagatatcctactggggagttaaatgtcctgaattttcttataggaaccacctcctttgtttcgacacaatattttctcatcaattgaaaaccgcatgttctcaagtaattttattttagaatttaaatgttacaagggtaattataagaaaataatcagcgctcaaatcacacaaaatacatttaactttataatataataaaaaatattttaataaaaaacacccacacttaaatattcataataaaatttcactcatcatataagaaggtgcccgcgcatgtgtgcgggctatctttctagttgaaacaaaagttgttcaacctagctagggtcagggatcaccggtgtcgtcgtattcgccttcgatcggggggccgtattccgtacgcttcaccctgcaaaccacgtcgccactgttactgtccttgttgacgccggcgccttggatttgtccattactcagcgccatcaatccagccacggcgtcttgagcggcaagttcgttggctgctcgccggcaacaggtgaactgcaagacatgcatgtatttcacattgatctacttatgtctttcggtgggaggcaacaggtgcccatgcatacgttagctaattaccattgatcagctgctgtatacattgtgttcatatgtactttatcaggataatggaattcaacggtctcccaggagtcgagcagatagcagcagcagcctccggggaggacaacaaccttcggcctccccaattgaaagccgccaatggcagcctcctctggaatcgatgcgggcggtcgtgagggcctcccgggggcgggcgtctgctacagcctctcgatgttgaggcaaacggtggaaggaggcaacggcggcggcggcaacctaccctagcgccgctgtaatttttcttccttttttttctttcgcttggttcgctgcatttgaagtggctacaccggtctggacgtcgtttggattagcgtccatccgcggacgctgtttacaggagcgtcctgatgcggaagctgtttagaatagcgtccttcttattttggtaaatactcacaaggaattactaattatttaatttaaatattattaattattataaataaaaaattcggcgtcctgtgacaaggaaaggggaaaaagggggacaaaaactaaacgagaagaaagcaaaagctattagctgtgcgagacatggccaaatgggagggtttaacttagcgtacgtgaggcttggagagtagccagatgtccagatagacgctctctatcaggcattttaattctccagtttccgtttcccttgaagcaatggttttgctctgcacttcggtagtggagtagtactttcagtttcagattctaaagatgatgaattgatgaattacgatatatgatggatggtgttcaatgctgatgcaggtcaagttatgaagttaatgttttacatttatctttaagctagacatgcgccagagtctgatggagcaaagcatttcagattttcagtaacaacttgggttttcttcagtcgcatttccaagccgaaaatggagatggttgacagtgacaccataaaagaaaaagaggtacttcatccgttttttaataaataataacactgttgacattttaacacatgtttgaccattcatcttattcaaaattttttatataaatatacaaggtataaatcatacttaaagtattttaaatgataaaataactcataaaaataaattataatatattatatactaaaagtccattaaacttactgtaaacgctctcaaaccgccacgtggtactactacaaatgctcctgggttgccatgtggctatctaataaattggtggatccactattttaaactattagatttatcttaataaacttttaaaacctcacgatccatctctctcctttccctaatcggccgatgtctacgtacgtaggtttttctccggttctatgccggtggacccaaaaggaaaagggccgggaaaaaaaaacggaaagaacagatttgtacgtacatacccggggagccaaaaacaagcaccactattcgatgggaaaaaaaaacgtgcataggcaccaacgatcgagtaaaacaaacgatcaataatttcaataaatcagtgaacccactatttttaccccaacaaaacaagtacactattcgttatttgacaaaaacaacacgaagaagaattgtacgtacacatgcgtatactatctggaataacaacgatcaatccaactatatgactatttaaaacatggcatatttattttatctataataaagaaaaatatatattacatcacttctacaaacacacctaaactatcacgtgacactctaataaattagataaaccttacaaattctgagaaaaaaatccaatcatcgatttttatttaagaaaaaaggaaataaaacgtaattatgatttagagaaggattagccctgccacagtcccacctaattgctacgagagaaacgtactgttcaccaaaaaaaaatgaaaaatacgtacatactacgcactgtctttccctacttgaatctttatgcatgcaagtaacatccaattgtccctaataaacttatctaaattagatgtgtatagtgaaaaatattatgactatatttgatattaactatatttcaatttaaaaattatcacatggaagcatatttagctctttgtccattaaacatcctataaacgctctcaagccgccacgtaatacttctacaaacgctcgtacaccactacttggcattttaataaattagaaaaataaaaaattatgagaataaacaaaacatctcgcagtcaattttcactaatatacggtggacccattgtgcttacgtacctccccacgtatttcctttctctcctattttcctctcttaattagatggaaaaaatattttacgataaagaattttaaacaactatattatctaaatcatatatagctaactttttaattagtgtacaccattatattatctactataaaacttaaaattgaagatccaagttaactatattattataaaaaaattcattacttcgagtcatatatattctgtggactagctattgttcaccgatccatacatttttaagaaaaaatcaaataaatttttaaaccttctgattaataacatacacttaaattagaacaatttaaaacattttaagtagtttaattaaaatacaatacccaaagtattttctaatagatctaagataaatgtatttataaaaatagaaagctcaaaactatgacatattcaatctatcttaaaaacaataatctcctcccatcctcctgctttacttacacctctaccctccccctatgactctcacatcctctcctctccaattccattatctctatttctattttttttaactaacataatgcagaaatagtcataactattgttttatttataactaaataataaatcaagatcacactagctatattttactatataaaagttaaaatacatcatttgagggtagaccctaccatttaccttacaaataaataacaacaaaaattaattgaacatatgtattatgttatactaaatcactgtacataataaaaatcaattaaatgcccccaaagcgctcataaaacacaatatattatgtcttaagattctaagaaaaaccaaataaattgacgtatccattattttaactattagatctatttttaaaagaagtcttaagtcgccatgtgtcacgtcatataaaaaacagaaaaaccttagaaattcttagaaaaaaatgaaacaccctttcatcggctttcacttaaatcatttaggaaaattagaaaaataaaatctcctacaccccctccttgccttcgcacgcacacaacattgtccgtcccctccctattttttatctattaaattaaaagagaaacgatca

SEQ ID NO: 74845 - DNA, 576 bp, Oryza sativa
  unsure (1)..(576): unsure at all n locations
catctcnatactngaataaacaaaatacgagaaaggaacnancaaaaatcacccccccccncaaaataacacatgtanntnccnnnnnnnnttnnnnaannnncgggnngggggggggggggggggnnnnnnnnnnnnnnnnnnnnnnnnnnnnnnnnnnngnnnngnnnngngggggggggggggggannnncnnnngnnnggggcnnnnnannggngngaannngnngggcgggggngggggggggcccggggggggagaaggggggggagaaaaaaaaaaaaaaaaagaaaaaaaaaaaaaaagaaaaaaagagaaaagaaaaaaaaaggaaaaagaaaaaaaaaaaaaaaaagcagagaaaaggagaaaaaaaaaagacaaaaaaaaaacaaaaaaaaaaaaaaaaaaaagaaaaaaagaaaaaggaaaaacacaagaaagaaaaaacaaaaacaaaagaaagaaagaaaaagcggaaaaaaaaaaaaaaaaacaaaaagaaaaaaaaagaaaaaaaaaaaaaaaaaaaaaaaaaaaaaaaaaaaaaaaaaaagaaaaaaaaaaaagaaaag

SEQ ID NO: 74846 - DNA, 675 bp, Oryza sativa
cttgctgtaagtcttactgttacaagtttctttcctagttcatcacgaagcattgctttttcacttgtctgtgagagtatggagtgtatactaataatctatgccaggacgagtttaatgcatcctaattcatctgcatctaacgtccacattttcatcttaaaaacaatccctgtatacattttcatcatatagaacatcacagaattcggttgtatgtcactgttgagatgtttggtagtttgttgtacaatttctgagatcctcaattgtgaaacaattttcttgattgtcatgcaggctgctaaaaggcatttgactcagcgtattgaaaggttggatgataaattggatcagcaaaaggcgctttctggacaaataagagatgatgtactttctccttaacattcatatcaatccatgtttggcattaacatgtcttcattttcacgcgcatgggttgaataattaagaaatgtctagtagcatatgcctatatgcaattattagcccaattatattttaagatgcactttttatttctttttagggaagtgaactgtgagaacttacagctaagtacattcttgttgtatcattttcacttttcaaatatctacttttttatccaggttactgatgcacgactgaagcttgagaatattggttcagaaa

SEQ ID NO: 74847 - DNA, 753 bp, Oryza sativa
tcctgcagcccacaaacctttgtactaaagcatgtaactgatccaacatgaacttggaaggtgatgacatcaaatttgtgttttatctttgttactgcattggctgtgatatgctgcagctccgccgacgtataagaaacaggacggctgaaagccaaacatgggaatcatgctttgcttaaagcattacagtggaaatctgacagccacagtgaaagctaaatacccaaaggctatcaaagaataccaggatcaacatattagccaccaaataacagcacacgccgaggattaaaaaacggacgcctatgataagagtggatctagaaacatctcatcacatcactgttttgatgcaacgtaaaaaaccattagcattcatttctccaagaaagtatctgaatcccggtggttcaaatgctcgccatcaatattaacatgactaacattaatgaaaaaaagcaacacctatcttcccgggggtgcagaaggcagcggcaatattagtttgcttccgttaatgagaggaacgtcggtacgtgagtctgatctcccttttcttttcacctcaaacatgaaggatcaaaatggaaagtctgcacaacaaaatatgctgtcaggcaacgcaatgcaacatttgacataccaaggttacacaaacaccagtctttcagcaactttagaagccagaagatactaaaatgtttgcatgcaagccaaatttcttcatatgaaaatttgaacatacatctc

SEQ ID NO: 74848 - DNA, 4458 bp, Oryza sativa
cgctgctgaagtcaagcttcccggtttagctcgctgttatcttttccgctgatatatacatacaacggaggtagccatttgcaccatatccataatatacaagtaggtagccattcgcaccttatccataccaggacgatccatttgcaccttatccatatcatcacataatgcttctgcctataaatagcagcagcaccttacattcaagaatcacctctcaacacaaaactaagaaacatagcaagataaccagggaaggtagcatcagcaacaggaggcaatggagggaaagaggactaccacttcgatggtgatcatgtgcctggtcatcttgagcctcactgtcgactccgccaccgcggcacagtgcggctgctgcatatcctcttaggcaaaagcatgttgtttcggttgtactgctgctggtggctccgactcagtctacaagaacacttgttgtttcccatgtattctggccgattctggtaaattcactaatgtcactctatttaatgcatttcttacatgtagatacagactttgtagcatatcgtggactaatacatatgtgtggccttccatgcattttcctcaatgtgctttgttgatttcacttccaatctcacgacttcaggcatgtatcttgcaacacgaagacatcttatgctctacttccactacaaaattaactaatgcgctaatgggattttcatattttaatttcatagttgttgctaagatggacgaaatgggagttcttgctaagatggacgaaatgggagttcttgctaagatggaaggacaagcctaaaacaacatgcttgcattgctaccagtcttaatgcctatcataagaatatgttgttttgcttcaagttatggccaagttatgttaatgttatcttcaataaattgttgaccatatggggcgatctatagtggatccatctgttggtctcaactctatgtatgtcgtgcatgtgtgcgctcacaagcatatttaatttctcttgctgcttttaataaggccatagcactgtccattgtgtcatccgatggtctctgaccttagcaatttattacgacatgattaatattatttgtgtatgcatgttctttacttaatttattcttagcggatttctgatgtttttgtgagttttagactatgggacataattaagattgtcatgccaaaaattattgcaaaacctagtaggaaagcaaaagaggcgggggggggggaggaaacatgatcaatttctcggctactatcacattcctcgttttctcaggtttgggagacatatagccacactaaaggcagtaaacctgaggaatgacaaccttactcacaaggacaaatagtcgttaaaaaacaatgacatcactaaccatatctatttcagttcaccaaacatacatttaaatttaggcagtattacggagaactaaattaacaaacaacaaaccatacttcattgtcaaaacaaattgccttctatgtacttcacaaattctcacaagatcatatttgcaatttttcctaaactaattaaccaagagcaaatatgcagtggagcattccacatatatttcacattataagtacataatacagtatggtataatacacatatgcatactaggggcctacggcaaaagaggcaaagatcaatgtgcatgctaacttgtgtataatacacatatgcacagtactttgaaataagcataccaggacatatgcattagttcacaccattcattcttgcattcttgcactttcaacaacaaccagatctaccaagcattcttgcacattaaaccacaagtagatctaccaatgaatcaccaacttaggtagcaatgggggtaatcgggggggaaaaccttacctcgtcagacgacggaaggacaggagatggcggaagattcatcggctgctcaccatggcgcgcggatccctgaggtgtgggcatcacatctatcagcaccaacgacatcggcgggtgggggggggaggaactggggctctttcatagaccgatgtaaactagacttattggcttctatttagggagaggaaggaaaagagatagactttacctggcatggcttgggcctgcacggagagggatagtagttggcttggtttcagccaaaagatatgaagagaattttaaattgttttttcaatttaaataatgaccgaaattatgttagtattattaaaattatttctttagctcggaaaatttcaagaaaatttaagagagcataattaattattgagaagttaataaaactattccaagtcatattttacaaggtaaaattttatttcacatatcaacttgtaacatacaaggaatttcaccatggaaaaattttgtggaaaatttaaaacattttgaattcaaaagtttttggtgaacatagaagcatactagagcatataactccctaaaataaaataaaacacataatttttctggccaaatcaaaactaagtccaaaagtaaaagtttacaaatcttgtggtaaaaaattttgaaacaaaaattttgctttgaccataaactagaaacctaatcttctcggttttgcattttcaacctaactaaaaaaatatatttaagttaaatatcaaacaaattgaaaggtaggtatcaaaatacgcaaacctaaattgagataaaaagaacttgcttgtatctgcatattattcttttaagattgtttttggatattcttggtacatctcataataggttgcatatgcatgctttgtctaaagagaaaattcctaaaaataaatgaggcaacaataaatcccaccaaaattctcataaatactaaacaataccctaagctcccagaaattttagttataataatttatcacatcaattggtaacccaaataaatccttgaactcagctaaaaaatctggaaacagcataccaattagcctactttgcaccttcaccaaaattaaaccataactcatcttgcaaaatctctaggtcaaaatgttaagcatactttactctatcatctggtgcaatggcttagtctaattcgaaatgtaacctcataaaatgagagccataagttaggtaaacagtattctggactgtggtcaatagattaactagtcaactttactaaattaccatggtaaaagcaaaagtaattaaactttggaacttggcaccttgaaccatcaaatccttgtctaccttgctgtctccctgtcaccccccctcccccggccttaattctaaattaaatggatgagagaaagagagtaatatagtttagtgtgatagtgccaacacatggaaaatttagagcttctagttctctccttctacatctctcttaaatgtgggaccaagtccttatggggcccactcatcatacaaccctagccaacacatcatctgctcttctctcatttaaatcttcttttatttctcaaaaggtgagagaagggtttaaattgaatttccacccaaaatgccactctaccactccaagccttctaggaaacatctatatatgggcctatttgttttccaaatacctacaaacaaccttggtgaatcatctctttgatcctaaattatattttcaaagagacaatgaaagagagagagagggagttaaagtccaatttacacccaaacttcaccatacctctcatcttctcctaggaaacatctacatgaggccactagacagccactcatacttggttgagtgaagtacaagtaggatcacagcctcaaaccactgccaactcctttaaatcgtttctacccctcatgttgacaactagctctcactttgcaccttcacttttaccattcactactacaaccaagatttttgtgtgagggctaaaatgatttttgggcgcgggtaggcggcccacacgcacctaggggtctgggaaaatgatgatttttgcgtgcgggtggcgcatccccacgggaaaacaaaaatccgaaataacataattttttttaaaaaaacgaaacccaagaatccggcagtgggcttccgcccgacggccatagtgccgcctgcctcccgccggcctccgcgccacccgccggcagatccgcgcttccctcccgccgcaatgccgccgacgcccctcccctctgccggatctagggagggaaggaaggggagaggaggggagctggatcccgcgtggggagatggcggccggctgccggatccgtgcggggacggccgccaccgctggattcttgcattgacggccaccaccgttggatccgtgtagggactgccgccgcccgccggatccaacgccctccaccgccgccacgtggagcaggcctgcgcgctcctactcccaccgccgtcgcaccgctgctgtcgccacacgccaccaccgctaccgccgtcgggaggagagga

SEQ ID NO: 74849 - DNA, 9686 bp, Oryza sativa
tgctgaattaactaattgatggtgggcatctgctttttatgtatcttgtcgccctactaaactattattcatgcatgcacaattaaactttttcttcttataaacgcattacaaatgtaggcgctcacaacacacgtgcactcacctctatgaacatatacgtacaccctatctctataagcatttcttgaagactggaccggtaaatcttgagattaacgaagtcaccacgaccgtctcgctgtcgacggatacgtcacctaccattaaaataataattagttctaaatatgaacaattaagctaaacaggcacgtggtgaacaaattgatcgaccagtgtataataaaaggttacaacacataagatgccgaaaaatggacgaactaataaaaaataatttataagtttttgtatttgtgttattagtattttaaaagtaaatgctagaaaatagctagaatacagcgaaaagactctaaaattaaattaagttttaaaatttaaatttgtgtctgatatgctaataagtacagtaagggacttaatttgtatattcaaaatgcagtctcattttctttttcttgttccttcttcgaaatttcagcaattttctcgtatcaagaaaggaaaatttcagcgtgtttctgctgatgaagcgttgcatgtgactaagcaaattaaagcatctgtagtttctgaagccggaacctcagagcgggtggatcggcgatccaaatggggtccgaaccccatttgacctctatattttctcacacacgctctgcatatgtggctatatattttcttcttctcctggttcagtggttgagtacgtactttaagggattgatttttcttaaccctatttgattaattccttgtgatcaggcacagagactaattaattaagtaattaaagcctttaaaggaacgagaaagtaagaaacgtcctaatggcagattcagttcatattatattagcaaaagaaaagcagcagtatctgggtgggttagtggggattattatcgccgccaattaaaagaagagctagctagcgagctaagctaatcgtaggagcacccaatgggcaatgcagcaagtgatcgaatgggtaattaattgactaattaagcaagctttgcgattgacttgtggtgtgcagagcagatgacacacactttaatttggcttgcttaatggctaaggccaagccatgcatgcaaatgcatgtatctcaaggggtaaaaaaaaggtggcatttgcatacgcacttacacgtaggattgaaacatgcacgagagcaacccaatgtcatatatggctatatactcaggcatgtgcttatgtgcattggttgcatggggccatatatccatgcatcaaatccgaaggtgaattaagcagccaagaggcatattggttggttgcatggagcattcggatacatggcatgttcactttattatcatttttaactctattaaattggacactatcacaattcctagtaagtctgtaggctgttattttttttcccgtaaatgatctaaaaaaatttcgtcggtaatttttatcggttcacccatggtaaaataattttcgacagtacaatgtgttataatgtattttttttcgacagttttgggcttataggatagttctggtaactaataaactaaagataaccttaacattattatcctattaaatttggtattttcgaaagtatcttatcaagaaacactatacttagtctataaacgaaaacacataacactgccaaaaatatgctaaagctaaaatgtgtcaaaaatttaacattatcaaattttagtaagttgactttttaggacaaagtgaacgtgccaatatatccatttgaccaccctcatcatccatctattcattcgagatcgatcgattcgtttatttcgattcatcaagagcatctgcaagagacacatatcgcagcgaggaaatgacaaggaaaattaattatggagagattaactcgatatatccattccctgcaggatgcagctaacagtacactgaatatataaaaccttcgtcagaaccagctggtaaaacgccaccatagcggcatgcttatgagctgctttagctgacatcaactcttaattaggatgattaacaaaacagtaaatcgttttggaggttaaatatatgcttagtttgatcataatgtgttatttttttgaaccagaggggttcggtgagtaaaattccgaacccctggacctcctttttcccttctctctctgtcttttctttgttcgagatgcctcgtttttttttccttaggaaaacaaactgaacaaagcaagccatgggcccatatggcccaataaaaaagtgttttccccttaaagaaaggacccaagaaaaatgctgggccgtacgaaataatatctggcccatcgttgggcctacagatggtcacggggccagagtaattaaatgggcccttgagtatatggaaacttatctgctggtctcgtacaagcagacaggggcaaccaatttaattacactatctgattgttacatctgttcttttttttttaaaaaaaaagtcttgctactatcatgtaataagaacaataatagtctatctaggtactggaaataaaagtaattattgatttattggaacacataaagaaatgaatgcaaaataattagtactatagtaatatcgagtagcaaataaacagacgatgccccgcaaaaatgaaataaaataaacagacgatgagttgtgctacgtagctagcagatcaatcccctttgccactcacattgttggcgatagcatcataattaagcatatatgcatccacgagtttgaggaataatcgaattaacagtggcgtggttatcgacttatcgtcctttggtgtctgcgtcgacgttgacttcatcgctgtgtacgtatacgaatgcgcgtaattgtgcatattgctgtttacgttgaatttaaatataaaactatcaaaattttagccgaatttgattctaaatattaaatatttatgacccaaggagatactaggttgctgggcaatcacaatacacacacacacacacacacacacacacacacacacacacacacacacatatatatatatatatatatataaaacatcaagacaatgattcgtgcccatcctgtaaagtgagtcatacatatcgtgaaaattagctttagcttaccgtgctataccacaaccaaaaataaagcaattctctctcatatatttgatggacaagagctaatgcggacgtttttctatccattatagaaattgctttaacaataattaactattttagacccacttctataaaatcacaaatacaccagatacatcccgcttgcggtcaaagacacgtgactttgtcactgacatgtggaccctgacaaaaacatcgtgcattttactgcagaggatctcaattttaagatcatgcgtgtactgttcattcatgtttctctgcccaaagagcatgcatgttactgttcattcatgtttccctcacatgcgtaggtgcagatgccaactcgatggaacgatcaccttgggcgttcctggacctcaaatcatgcatatgtgtgacgtgtggtccgatccagaccaaccgtgcatatgcatatgctactgctagcttctcccataagaaaagccgagcgatcggtcggcaacccggcatccttttccctaggtggacatacaccgtgcagtcgtgcacgtacgctgcatgcagcataaaccgaccaagagacgaccttagaacatcttcaacagagttactatttttactatccaaatatctatttgatcaatttaccaaaagaattagagccggatttttctttcactacaataattctccgttacattctccaatctgacagtgcttttcatatgttggcatcctactctttttctttcctcacgtcttctcaaccaagtaaactcttaggctgtgttactcaactttccgtagtttcccatgcctcagttacttgtgatccgccgctccttgattccgccggtcttggtcgcttaattgcatttctgaaactagtcgagaaggcattaacaattatctaattaaatactatggacggtgtaaatatatatacatgatcaaggaaaaaaaagcaataaacatacatataatatatagtggtctccctatcatgagagtacgatgatactgtgcgagttttctaaacaacagtttagtccaaaccaggtcgccgtcgttagcgcgacagaaagtctagattagggatctccaacatcaactctcccgtgcatgcttgctgctttcttgctccacctaacaattatttatttggtacaacccaatcagtgactataaccaataaactgccaatgcacctagcactttattactactacctccatcccataatcacaattttacactatctactatcaatgtttaactatccgtctaattaaaaaaattataattaatatttttattattattagatgaatggtcaaacgttagacacataaatccacaactgcacttaaaataggatgggtagtactatattcatgatatattatggagtatataatgtgagcctcccagtgataatttttttaattatattatgtgtagtggcaccatctcaattgctttaagattctcttgattatatttagtgataatttattgttcttgatttatgcaagcactacacagacagtactgcattattgctactacatgtacatgcagtggtccatatacaaactgcattttttgacagtaggtggaaataaggacaggagaagaaaaaaattaatactactatactccactagcatctccatataaaaagccagcggaaacaacaatctgacaacagtttctgatcctgtgtgtacaacagtccagcatggcccacaagcagtcaggcccctgcacggggtggcccaccagtcagcaatggaacagaccgatgtggcgatggacgcacgagaggcatctcactgactgcaagttctaccgatcctgacttctaaagtgaaaactactgaaagtctgaacgtccgaaaactaatgcaaatgcaaacctggagactcaaattctgaagctaattcaaatggttttgcttgaaaactggaagcgtcagcaagaacctagaaaccgtgtttgcaaatgcaacacatggattctcaatttctcatactgaattcttgagtagcataatgttttcagaagaggtaaaatggacatgaagactcatcagaaacatcgaaattctcctccacacaacatcgatttcatgcatttaggaaggacattgatcttctgcgtattttgcagaataaagattgtaacaagaaagaatctttataaaactatctgtaataacttttttttctgtattttaatataaatatgtcactgccggcctgccgggcgaggctcgcctgtcagtgtttccttaaagagaacatacagatgtttcgattcgatcggtttgtcttgcttgttttctgtgatgcatttggcaacgatgttgtgatagctgtggagtcgaagctgctgtgtcgccaggcgacaagcccggcaacgataacatttgcctcacgaagtcgaagcctttgtatcgcttacaacaagctctttatcgatagctgttttgggctccgccatttttcctttttccatggtattggtagcttaggttagagtgttgtggttttcgtccagtttttccctaattaactgtgcattgtaaggtttagtctcgttttctccttaaaataagacaccttcttctttatataaaacgtcggcaacagcctgaccgttcgaaaaactactacttaacagttctgatctatgccagtacatctttctcattgacttgatttagggcaaatcgctggatgacgaagtgataatctaatatgttaattagctacgacaataagcgagcgcgggtgcctcaaacatgatgtcattctccaagtcatggccttaattaaacatactttctagccataatggaagcatcaactatatatatggtggatccctgatgatgattgctaacatgataaggccacgattaattgtcatcagaaagagggaactaaatcaattaaactgaaattttcacttgctataggtttatgggcttggtaggtggtgatacactagctagcacattgacaaataaccacgttgatctgacccatggaggtgaactttttccccttagatgaatggaatgaaactaatgctacatcacatccacacaaatgataaaatgattaattaattaaccctgtcactgcattatcataatagtaagtgctgctagagatagcgtggattttataattttgcggtggactctcggcggattttagaaactcgtgatggcaacacgtggtacatatgcttgccacgataacatgagtagtgccgcgtgtagttaacaagatagccacgttgtaggttatatcaatcttattgacacaactcgtgacaacactatggctacggcgttgtcatttgctatgatatcgagactatatgaccataaagggtacttccaacaaaagtgacacggccatgatggcactgtggctacgatggtgtcgttttttatgatgccgaaactatgactataatgagtacttccaactagagttgacgagagacacgtccattgataaatgtgatcaatggttatatgggtggatttataaaaatataaatgcatgagtatgattcaatatttggttatcaacgttccgctctgggagcgcattatacaataaatttatgagaatggcatacaataatagtatatatttacagcaatatatttttatatgcctttactatgttaagaattgtagaacaaataatgtgtccatatcaagatagtgaatggcacctggtaatttattccatgggaacacaaacattgtcttgctccaagttcttacatgttgccggaaaagtgccattgatcgagatggtaatgaatcatctcatcttgattggaacgattaaatcttttactaccatcatgatgtgatccattatttaatttgccagttattgttgtcatatatatctatggaccatctattgttatcacacaattttatgcagttaggatcagaaagttttaatccagtactcattatggctaaaaatcctcctgttttacatttgacgatttgaatattccgatcgatctccatagttttaaaagaacttccttatttgatgggtacttcttgttagataccagtatgtacttacacatgatttaatgacaatttgcatgatgcacgcagttgaatgcttctccccctcctacgtaaattggaacgggcagactttggtccaacaactcacatttgactttctcacaacgatctatcttctgtagactgcgtacttcgtcgccagccaatgtgagtgtcatacatttcaatgcttcttaacacgtagcagtaccgcacaataactttgcatatgccccacaaagtaacaaatgtctccaaacatttatgtgagtaattatagtttaatataatataaccttattgttgtcactacatttgaactctataaaaatgcaatgggaattggggagtgaggattggacataaaataaaagtccaatacccaacttcataaatattctgcaactcagtaattgtatgcatacactgtaaaatcataaaaaaatgcaaaaagaaacaattaatcacatcatccatatcaagttagaccatataaattaaagttgctttgacttttctcttattcaaattcatttaaatttgactgaatttgcaaaaaaaaaatatagcaacattttcaacacaaaacaaatatactatcaaaatgtattcaatgttatatttaataaaactaatttggtattataactgttgctaattattctataaaatttaataaaataaaaagtaatatgaatcagagagagtaaattacagtaacctgcatatgatttattttcccctaacctgcgcggagaaaattgtcgtgtagccaacccggggtgctccttgcaaaataggcgccccctatttgtaccataccaccgcgctacgcgtccccatcccatcccccctccctccccttcttctgctctttcccctctcccccacttctctcgtcttcctcttcgactcttgcagtttagtccactccattcccaccaaaattcctctctactcccaaattccccccacccctcccggcgaattccccccctccgccgctcgattcggcgctcgaatccgccgtctccgccgccaattcgctcggtccggcggttcgctgatccactctctcgtttttttgttttttttttaccttcttacgcggcgattcggggtgtatgagctcggtttcgcggcgggttggttgatttgctccgccgcgtcggagggcggcggcgcggggaagaggggggcatgtgggtttcgctggtctggatccgtgggtgcgtgggcgtcacgttcgtcgactacttgggcgggagggaagccgagtagatccttttacgcggtgtgccggggagggaggtggtggttgaggttgaggttgacgaggggttctagggtttcgggggcggggggccatggaggctgcccgggtcggggcgcagagccgccacctgtacggcggagggctaggcgagcctgacatggacaggcgcgacaagaggctgttcggctgggacctcaacgactggcggtgggacagtgaccgcttcgtcgctacgccggtgcccgccgcggaggcgagcggcttggcgctgaacagctcgccgtcttcctccgaggaagccggggccgcgtcggtgagaaatgttaatgctagaggtgactccgataagaggaagcgggtggtggtcattgatgatgatgatgtggaggatgacgagctggtggagaacggcggcgggtcactgagcttgagaattgggggtgatgctgttgcccatggagcaggggtgggtggtggtgctgatgaggaagacaggaatggcaaaaagatcagggtgcagggaggcagtcctagtggccccgcgtgccaggtggagggctgcactgcggaccttactggtgtgagggattaccatcgacgacacaaggtctgcgagatgcatgccaaggctaccactgctgtggttgggaacactgtccagcggttctgccaacaatgtagtaggttagtttaattcaaactactactgcctttcattctcattctataatttgttcatattggaatgattaggtagaatatgctatgcaagtttgatgcaatgcggctaaacagattctagaccctcacaaacttccaaccctaacaattttgtaagcattggattttgaaagtaatcctgatgaatatggtaaattaaattgataaaatgatagttaaagagaggagttggtgtgatctatcatctgtgcatgttcaatctagattggctgagataaatttatacgtagacttgtctgtattatatacttcctccgtttcacaatgtaagactttctagcattgcccacatacatatagatgtgggctgcagga

SEQ ID NO: 74850 - DNA, 559 bp, Oryza sativa
ctagccatgccctctgaaacacagatacattacagagatatgctagtcacagatacatcacccccccaattaacatcccagatccatcttaaacatcacagatccccaacaacacatatatgcagttcaaatgccacaattttgcacagcaaattcacaccccttgaaagccacaatttcggtcgttgctcatagaaccgcatatatacttaccaaatggattaaagccataatgtactcgacctccacaacctgtcaataagggaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagataaaggcgcacacttcgcctctgatagcggggggggggggggggg

SEQ ID NO: 74851 - DNA, 27017 bp, Oryza sativa
aagtcttacattgtgaaacggagggactattatggaagtaatgattttggatcgtaccttttgattttgaagaataattttaggtatattttttttccttctcatcctaaagtcaaattctcaaattcatgatgatatgatatttgtctgcaccttttgagcttagagtgtaatgattctttaactcaggacgtggtttattaatttgacatctgtcacagcatatgggcgcagtggtagtaaaatgaaaaggacaccataatttgtggagcgaagattaaaatgacgatgcttatgttgtaattgtgaaaaacacggactatcagtcataggcaagatttagtgatgatgctggaagaagtgatcaacgtagtgccatgctaagagaaatcgttagggattaactcttatgaaagcagtgaatacaaccgaaaaggagtcgtattgcacaacccatttgaatatacgatataaaagaaaatgttcgaaagtaaatatattataaaatggcctatgcccttctagctgtgcctgtatatctaagatctatgtggtactgccgatggctcagctcaaaattacagttgtacgtgtcataacaatcagactgctttctctcgtaatttctttggattattttctcttcaaagaaaatacttttttatttccaacatctgtactgaaagtctgaaattaattttttttggggaaaaattagttgaagttgacaaagccagaaacatttttgctaagatattttttgaatcgtagaatttctgagaccatttttacatttcgtaattgctagaactagtacgcacgtttttcatggaccagtattttcatatattctttttcgtctgatgtaagagaacatttggttccttaatgtcctcatttgtgcatcccacgtccaacagtaatgctttcttttgctcacccttttatgtgtgtgggttgttcctatgcttaacaccactgtcaacttttagaaaatattgtgaattcttcttgggcactgtcaattataatagtttttacagtatttgtttttcatgcatattttttcataaatgtttcaaaggaactggcactctgttcaaagagtaccgtgtgattacatagtgctaatactatttacaatgtactgtgctatggtgccatagtatgcattttttttttcaaaaagatatgggtgaactctgtaattactgtacatgcttacatgttccttttacagattccaccctcttcaagaatttgatgaagggaagcgaagttgccgccgacgtttagcaggccacaacagacgaaggaggaagacccgccctgaagttgctgttggtggttctgcatttactgaggacaaaattagcagttatttattgttgggtctccttggagtatgcgccaatttgaatggtaagtaaacatattcttatttgaactgtaggtaatgtttttatggtacaataacatagatcctccatctgcacgtatgtattggtgagctggtactagtatagtttgttttcaattgcgtacttgagtttgactttatctgaatatgtttctgagtgaatttacttggtattgattgaaataagacttctgatgttttcaagtaaggtagcttttatgttgtatatggttcttgtttattggaaaggttgttagtggcatagtttctaggactacaaagactgtagtgtggtactagatgagttcatagttaagtcttatattcaactcccagatttgcttacaggaaatttccacctttgtgtcaagattgcctatcctatgtcaagacttcacaacagcacaattctgcaatcttttagccatttgcttaaatgtagagcctcccaaaataacgtaggaatacttctagtgcctagactggactattatgaacatacttggtccatgcaagctagttttatgataatactcacaggactccacaattgtacttgcagctgacaatgctgagcatttaagaggtcaggagttgatatctggtcttttgagaaacctgggggcagttgccaaatcattggatccaaaagaactctgtaaactcttggaggcatgccaaagcatgcaagatggatcaaatgctgggacctctgaaacagctaatgctttggtaaatactgctgtagcagaggctgcagggccatctaactctaagatgccttttgtgaacggtgatcaatgtggcctggcatcatcatctgttgtaccagtacaatcaaagtctcccactgttgcaactcctggtgagatgcacaacatttctagcccttcagtgaatgtttccaaatgaagattttaagttacactagtggctttttttcacagaccctccagcatgcaaatttaaagattttgatttgaatgacacttatggtggcatggaaggtttcgaggatgggtatgaaggttcacctacaccagctttcaagacaactgattctcccaattgtccatcatggatgcaccaagattctactcaaagcccaccacagactagtggcaattcagattcaacatcagctcagtcactgtcaagctcaaatggagatgctcaggtttgcaaatttgttccttgcaacttaatgtaaagaaaactagtttcccaaaactaaagggatcgcttcaattttcaaatgctcacgacttattggtctataataacatccttatcttttgataacaagttaacaagaggtacataccaaataaggaaataactatcttaagtgggcattagttcaagtgggattttgaactggaaggggattttagtgcacttctacaagggttggagtgctgtcaaacatgccttaatttatgcagtactagatatgcttcagattctgttttaaggggtatataagtatgaacttaactgtacattttgaacttaaaagttacacacttacacgtgcatgacttttcagtacctttactagaaaaattgttgcagatatcatcaagaaccaaaaacattaagtctgcagagaaatttgaacagaatgcacattttcccagatccaaatttaactgactcatctgcaccagtgaaatgtctctaactaattcatcgcatctgtttctcacataaatgccacataaacaaggtgaactgaactaccttttgatcagtataaagaagtgcatgaagaaagagaatttctactgataacaacagtcggtctagtacatacgtattgagatgccaaatgccagtattttctattttgtaatattgcatagtggatttgcacctcaaatatgttgaaatgcgtgtgctctctctctctctctctctctctctctctctctctctctcacacacacacacacattgattgtcattatgaatgcttgcagtgtcggactgataaaattgtcttcaagcttttcgagaaagttcctagtgatttacctccagttttgcgatcacaggtaaattatgcattccctcagcaacgtggaagagtaaatatcgtaaatctaacacttcaatcctgaatttcagattcttggttggttgtccagtagccctactgatatagagagctatattagacctggttgtattattttaacagtatatcttcgcttagttgagtctgcatggaaagaggtatgatttttcaactaattatttcatgtcatgacaatgatctttttgcttaatgcttgatagcttgatgttttcctcttatttactacagctctctgataatatgagctcatacctggataagcttctgaatagttccaccggcaacttttgggcatctggtttggtatttgtaatggtacggcatcagatagctttcatgcataatggtaagcccgaatgcttagttagcgcagtgctcttcaagttctattatacatattttacatcggaattttgttattctcaccactcctttatatcactgcaggtcaacttatgttggacagaccacttgcaaacagtgctcatcattactgcaagattttatgtgtgagaccaattgctgctcctttttcaacaaaagtgaatttcagggtagaaggcttgaacctagtcagtgattcctcaaggtactttgccagtttgcatctacagtttacatatgtttgttcttgatggagacataggttgatgtttgcttaagcttacttgtcatctaaagattgatcatctcatgttttcaggctaatttgctcatttgaagggagttgtatattccaggaagacaccgataatatagttgatgacgttgagcatgatgatattgaatatctgaacttctgttgtcctctccctagttcaagagggagaggatttgtggaggtacagcttttcatatgtctgctgttttcatgtgtctgttttctgtcacaacctttgaatttactagaatgccatcgttaatttcaggttgaagatggtggatttagcaacggcttcttccctttcataattgctgagcaggacatatgctctgaggtctgtgagctggagagcatatttgagtcctccagtcatgaacaggcagatgatgacaatgccaggaaccaagctttagagtttctaaatgagctgggctggcttcttcatagagcaaacataatatctaaacaggataaggttcctctagcatcctttaacatatggagattcagaaatcttggtatatttgccatggagcgggaatggtgtgctgtgaccaaactgctgttagatttcttatttactggactcgttgatatcgggtcccagtctccagaagaggtggtgttgtcagaaaatctgctacatgctgccgtgcggatgaaatctgcccaaatggttaggtttctgctgggatacaagccaaatgaaagcctgaagagaactgcagagacattcctattcagacctgatgctcaaggcccttccaaatttacccccctccatatagcagctgccacagatgatgcagaggatgtattggatgcacttactaatgatcctggactggtattccccttatctataatccttaggatatggttttaagtatttgctcgtattctatgtgccttttgcacagaaatatagacttccgttgcaattgatgttgggcacatcaacaacggtgccgtgccatgtgcactatagatctttctatcctagtttttttaaaaaatgaattacacttgaatatcctgtctaatcttcctgctgctacctgttattgcaggttgggatcaacacgtggagaaacgcgcgagacggcgcaggcttcaccccagaagactacgctcgccagaggggcaacgatgcttacctgaatatggtcgagaagaagatcaataagcatcttggcaaaggccatgttgtcctcggcgtccctagcagcatacaccctgtaataaccgatggtgtgaagcctggtgaagtcagcctggagatcggcatgaccgtgccgccgccagcaccgagctgcaacgcctgcagccgtcaggccctgatgtaccccaactcgacggcgaggaccttcctgtacaggccagcgatgctgaccgtgatgggcatcgccgtcatctgcgtctgcgtcggcctgctactccacacctgtccaaaggtttatgcagctcctacattcagatgggagctgttagaacgtggaccaatgtgaggaggagcttagaatggaataagtgtagttgtgttttacgtaagtcgagagcttagtgtgctggctaagatcaaaataacagtactatgtgaggaggatgatcctttgtatttaaagcaggatcgtttcgtttatataaaagcttacataccgtcattattaattattattgattagttattattatttatattatatttaccgcctaacatgtaaacagaacatatgttccataaaattcatggtgtggttgtagaattcattctttccagagcttcttgttggagccatgcttctggctgctttcggttcattctagacttctagttttgtggctacaagattttgtcggtgttgtattgttgtaaactcggaataaaacttttttttttcgtcagcgttgtattgttgtaaactcagaataaaacatttttttcatgcgctttgtgagtgttgtattgttgtagactcggaatagaacttttttttttcatgtctttgcgctcctttttttttcttgtctatatatcacttgagatcaaatgttgattcagaaacgatgctgaatctttcccaacatatttgttgtccaagtgcactggacgctcaaaatgcgtgaaaaccaggtcgatttgaaaagtttctcaaagtactatcatgatacttcctatctcggagcttgttaatggtacgctatacgcatcggcataattgtaatatcaaacccaacggtaactagtgagataggaaaagatatatttcagcactatgtatcattcaaaatgtgattcaatactggaatttcacatggagactgctctcatattgaaatttcacatggagatatagcatgctctccggatgtttttggcttgcacacctaatttttcactgaactgatgagcaccatatgtcataaattatacaaccaaaatttgcgaacttaatcaggttcaaaatggaacatgtaagcttctttttcatcctgataaagacgtacattttgcaatgagtaagtgattctctggagaaatatttgatgggacgtagcttacaagatctgcatctaaacccttctctctaagccataatagcctaccagtatcaataatatctttacacataaaccccaaggcagctctctcccctgctggtatacttcggatgagtctatcgattccgctgacctccacatcagacttctctgcttttccgcacctgtaaaaaaacgtagcgacaaacatattaagcttccgtgacaccattcgagaatgattcaagaaaacgaactgtaccatgtttttgcccatacatgatgcatcataacaatttaaaagggtgatacttcccaccaagatttgaacagatgatcttttatagctatcagaatgtagaagaaaactaaggcttagttcaactaatggttcttacctgtcttctacagatgagtcttcaacctctaaagaggaatccggggagctgtgatcaccatccacagcccagctgctaaaccaagtcatggtatggaaatcttcctctgtaatccctaaccctgagaggaatgtcttatctgcaatgagaacaggaacattattctctaagaagaaaatctaaaggttttactgcaattttcaaaggaggacggtataatattatataaagtagtcaaagctgtaagcgacataatcgcacgatacatcctaaacaaaaataattagcagcattggctggcaaaaaaaaatttacttgcatagtgattccattggcacagatggtggcagcaggtggccaaagcaaggccacatagattgcttttgccatattctttttcatgtgcctggttataccgttcatgaaggcagcacatcatggtcatatctggagaggacaatattcattatatacaatcaagcaatcagttaatctcattgtcatgtattatacatcagtttgtcggagtataaaatccatgaataaatttcatatgttagaacttagaaccacctgttgcaggtccacatagatgctttccaattgctagataatgaagtccactcaatgcctctattccttgaaggttcaaatcttcaactgcattgtgtttatgtttcttatgagtgcttatatctcttactatctcaaatcacagggtatgaatgtgacaattcgttttaagaacacagagaccacccacacatgcatataagtgaactgataacaaacacatttggccttcagcaccaaaggtgcctaaaaaccacttcaaagaatgaaaagaaatcttactatcaattctcaaacgcttcaaagtaacgccttcattttgtcgcaaacttcgatcagcctagaaagtacagagaaaaggaagaaacagggcaacaacagagcagtcaaagaaccaacctaagctgaaattagatttaacacaacaagcactttcagaaaataacaaaacaataaaagttttactgcaaatcatgaggaatacagcaacaatgtgtcgaaacaaactcaaacttcataaggcactagacacagataggacagtgcattaaattcaaaatcactgtaaacaacctatacatgccttcatacttaaagttgagacatcttaaacaacgaacacaaaatactgaattaactattgttgagcataatagcaagccaataaattgcagatatattctaatctggcacagaaataagtaatgtccttctaaatttctacatgaaaaataagctgaaattgatttcaaaaggtcgaataaccaatggcaactgtccatgtttgacaagctcaaagtagatatcatcctgaggcaatatgaacagagaaactgaccttgagcttgtatgatcttctctcaaccaagaaaacattcctaatcccgtagcagtctgccagcatctgagtcaagtaccctctccctgctccgaattccaccactgccggagcatttttcacaccattctcctccgccacctcacctcccttctgcagcaaaccaaatgcctccatattgccaatgatggatgcctgctgcgtgacatgcttttcctggtatggcaccttcctgcccaacacaccagcttaaatcactcctcactacaaaatcctcaaaaaaatccaacccttacaccatcaaaagtggtaagcacacacacctatcaacctggttcctcatccaattgtcgcaagcatctgtaacaagaaatgaatcacgcattgccatggccgccgacgcatgcgccaacttgatcttctcaatcaaggcgcgcaattcatccttggtgagcttgtgcaccaatgcacgcttagcggccgaggtgacacccccaccgccttctcccccaccggagttgatgcccttggagtagaacggctgcgctgcgagcgccgcggcctgcttcttgagggggcacttgccgacgtgcgcctccaggttctcctcgagcacggtgctgcccaagacaaggcggcattagcggatagggacgctggtgatggagatcacttggcggtggtataggattttggggggtcttactgcgaggggtcgacggggcaggggacaaggcggcggaagggcgcaccggcatcggaggcggaatccgggaggtggttcccacagtacctgaggaggagggggaggaggcggcgatgggggttagggttagggttagggttcaggggttaagcaggaaggtaactcggagagctgcttactgagaggttgggagcggagtgttggcgcagtggcggcgcttgttagggagccagaagtggcaacggcccggaggcggaggaggcggcggcgacgagggcttccgtttcgccggagcacggcccatctctgacagcggcggcggcgagcgggagacgccggaggcggagagggagcagaagtgcagacccccggtgtgaacacaaccgaaggggaaatgcgtgacgtcattgctaaatttgcatcttatgaatttgtttttttttaaaaaaataaatttcgagtgaattcgaacatgtgaaggtgtcctccacgtttgacacaaaatcagattatcgtaccgctacatatcccttataaatttgacgttaaaaaaatattactagattactccctccattctcatttatttaacaccgcgcactaataaactaaccaacgtcaaatgaaaaaaatagatacttcctccattctcatttatttgacaccggttaactaatccacgttaaaaataaaaagagatagagggagtagattgaaaaacacaatagccatttttcattcgcagagcgatactagaactaaccgagaagagacataaacacaaattatgtcagacaaatttacaaattcaaaactcaaaaattgttacatgaaaacatgctccactgagtccaaaaggttgcatcatgatgagatgcaatggcaaccaacatataatattacaaacgaacaaacacaattttacaaaccacatgctatgacaccacgtcaccattgatcgcctaataagaaaaagggatcatctttccagtcaaaacgcggtaaaatttatcgtaaagatatgtttttcttttaaattaaattaatggcgtcggtccgtgtcacaggccgacggactggagcacggcgtagttgacggcggtggtggcgccgtcgacgacgaggttgtggccgctgacgaaggcggcctggtcggaggcgaggaagagcatggcctccgcgacgtccgccgccttgagcaccttcccgcggagcacgttgtggggctccgccgccgcctccatctcctcggggctcatccccgtcagcccgcagctcagcggcgtcgccacgccgccgggggacacgcagttcacgcgcacgccgtgccgcccgagctcgccggccgccgcgcgcaccagccccagcaccgcgtgcttcgacgccgtgtacgccgccggcccgaacccgccctggcacgacgccacgctcgccgtgcacacgatggcgccgcgggtgccgcgcgacaccatggcgcgcgccgcgtgcttcacgcacgccgccgcgccgcggaagttcaccgacatcacccggtccagagccgcgaggtccatgtccacgacgggccccgtcgggagcagcacgccggcgttgctcaccatcacgtcgagccgcccgtgctccgccaccgcggcggccaccgccgcctccacctgcgcctcgtccgtcacgtcgcaccgcacgtaccggcacccgccccccgccaccgacgccgccaccgcctcgcccagctcgtcctggacgtcggcgatgaccaccgtcgcgccgcacgacgcgaacagccgcgccgccgcctcgccgatgccgctcgcgccgccggtcacgatggccaccttgccgtccatcctgcacgcccccgctcaaatccatcaaacgaattcgacccaaaccaatccaacatcctcaaatctaaaaaaaaatcaaacgaaaaaaactactagtagctgcgagtgactcaccttgtcttcgacatgatgcaatgcaaaagctgtttcgtgtctgccttctgcatcgggatgtggttgtttatatagtgctcaattcgcttttaaaagtcgtcaactatgccaatattttactcaaaagcaaaattctttttaaaattcagaggaatgggcatatatatccgtacacgacgagtataaaatactccaaaacccaattctattattaatccaaatcaacagaatgccacatccttcaaaccttcaattcaatatttcatcaattaggtagcagcacaactaaaaaaaaaacgaaaaacgagtatccaagaacacggcgtttccaaatccagtgagatcatcagacagacaaatcccagagaaacaatagacatggaagcattgaaaaactcatcagagtttcagttttataatagatggatgaagcggagaagacgagctgagctggagaagacaaaagcggttgatccaagcacgctgtcatgtggggaacaccatgaaccctaatcatctcgcgttgcaaatccggtcccaatgctcatggcgctttgcttaccatcactgtcattagcggatgagaagatgagcttaacaagatcaattcaagaacagaaaggataagaggaggaaatctagagttggatttgggttgggtcgctgccttcatttctactgctaatgattactccacgacagggtcggctgcaatgcaatgctgcatcctgatcctgcaagaaactccatgcactgcatgttcactttcaggaaaagatgcagtcaatcgaacgcgaagcttgccgggatttctgttcttgcttgtaattgttgctgaagcattccactctcgtaagtttgcttatgactgataagcgtgaaaaaataaacaagcaaccaaaaataatttatatgcaaaacttttatatttacgaacttagcgatttaaaagctagtacttaaaaataaactacaatgaaaaaacctccaatcaactgtaaaattaagttttaaaattctgatttaggctgtgtataactatattgtcggtgcctgtcttactaactttactgttaccgttactgttagatgctgcctgttggtgactgattgcctgacagaagaaaagaaaagaaaagataatagatactacaggtattgttcagagaacgacaatagtgaattgtctgtaatgtggtatggtcaatggccgcaattattggatctcacgccagttttctcgcactggcatgtttaattgtttgcactgctgctaatgctatctcccaaagtcaattagcttcagattagttattggctctctgaccctgctgatatgacagctcccttggtttcatctgccagtaggatcatttgcagtagtcaaagcacaagacttttgcttcagaattgacttctatcgcactgaatgactgaatgaccatatcatttgaagtttgaactactagaagaatgcaatgttttcagaaggagcacagttccttttcctgtgcaaaagtttgattctcggattaaagaattacacagtagcagtgtgctttgtaagtagactttcaaagcagtatatagcacttgaactgagttgcatggatggaccatacatgtgacaggaccagcagacatctttcagaagaaaataggggaaaactaacacacttggaattgaatttttgcaaattgaagcaatagttcagatagatatatatggaccagcaaaggtgagctgttacctcaatgtctattggttattaccagccagagtttctttgcatttaatgacgaaatgctttgaaaagcactcagactatggaaggatttgaaacaaaagggacatggtagttatgcactaaaagaaattaagtaaaccaaaacaccaacactatttggttgttgtctactagtaccaactaccattttttccacattatacgtagacatagtaactatttacacagtgttgttgatattatcttcgatatgtccaaaaatcggttaagctaggaccatttagaaaaatcattgaggctaactaccttgacacgtcttgatcaaatagctgtgggatttattatcctatgaacacaggttctttgccttgccacttatgtcagcagcgacaacgtatatacattgtattgtactatgtagccttattgtactgttcaatgttcatgcattcatgtaagtagctgttagtttgccactgtcggtctaaacgaatcaacgtgttggaattgatggatgcgactctgctcactggactcaatgatcaggtttatcctacacaattcatctgtctaaatgattagtaaattatactccctatttttttaactaaccaacgtcaattagaaaaaaaacaacagaggtagtataatattactccatccgtctcattttaagtgcagccatggtttttcgcgcctaactttaacagtccgtcttaattgaaattgttttaaaaaaaatttaaaacataagtcacgagtaaagtactattcatgttttatcatctcataacaacaaaagtactaattataaaaaattttcaaataagatggacgatcaaagttgagcgtggaaacttatggttgcatttaaaatgagacggaggaagtatgatgcatttgacttatagtaatgtatagtagggcatacatattgcaacgggtatagataactgtagaattcacatcttccttggtgttagtgtatagataactgtaaaattcagatcaatctaacattgtcatgacaagtgacgactataagaagcaaactttagtttttgctatgaaaactttttacactgcttcctagtgagaataggagaggatgcaatttagtgttggtaagaaaaaccatggtagtcataaaagatataatataatgtcataaacaagacaggtgtgggctggccgctataggctggccttctagttctagggctaatgggctattgcgtcaataactaatcaactatgttgtcagcccttaggtaaccacattgccttttcttaataaaaccgttcaatattttacttggaagtaaagatgatactacaaacacgactttgtttgagctttgtattccttttacccatacatcttttccttctcttttaagcatttatatttgtattcagaaatattttctggactagatagagtaccaaagatgttgttatacctaaaggctttctatggaacatgtgatttgaaaaaatgcaaaagaaaatgaaaaaaaaaatagaggattggagtgtcatatatggacaaatcctacataaatttgaaacatagtaacatactatgtttggatggttcatgggactatgaatttgatataatcataaaatgggtatgccaactcacaagttttttcctcatccatcccaaccacatttttctacctagacctatccttgggtatccctatattcatattcatattagactgagtttatttcaccattttcacaacttctattttctcgttttcatgcacatgattttcaagctgctaattttcaagctgctaaatgcagttattttttttgcaaaaaaagagagaaaagttggcttaagacatcgggcctgttcactttgatgccaaaaaaaaccttaccaaattttggcattaccattttggcaacttgccaaaattttagtaggatttcttatatagttactaaaatttggcagcaaactaaatgtagccactttttttaagtgaacaggcccatcatgccaatccattttaagttttttaagctaacaatacaccgttttgttttgcgtgctgtgggggagaggttcctaaccccattgtgcaacacaaccttatttggataggggatagataaaaaaaatatatccatttaaattttggatatagtgagggtattactcattttgtccattttatatgaacccatttgctatgtgtaaaatttagacctaaaatttttaaactaatgttcatattaaaaaaaactgattaaaattcgggagatgatttattatatagaggagcaactttgtataaattttgaaccatttctacatggtcaattattttattttattttttattctattttttaaaaattatatttctacttggactttatttttatatttaaaatttgtattgtctcttcacttacccattgatgagtaatactcaattatgggatggataaaattgagtatgaataagtgttaccctttatgcttccctggtggcagatcaataattatgcattttatcaaaaggaaaaaaataaattaacatatagcaaaagagaaaaaaaataatactattaatcaataacaaaaacttacttcctctgtcctattttaagtgcaaccatgaatttccgtgtccaactttgattgtctgttttattttattttttttgtgattagtatttttgtttttatgagatgataaaacatgaatagtactctttcatttccaaattgatcatcatataatggaattcaaaatttctcaaattgattatcatataaccgtatggatacagattttatcaaaatacaattaatgcaacatgggagaatatgtacatgctaaggtgtaattggtatagtgtttaatcgatgcatgtattataggagaatgtgtgcatggtgtcttgattgatgtgatttaaattatcattggtcttggtgtataaagatatatgatgatcattttaggaaggaggagtactttactcatgacttatagttttcatttttttaatttttttaaatacgatatatgattaaagttagatgtactccctccgtcaaaaaaaaagacaaaccctgggtttccgtgtccaacgtttgaccgtccgttacgcataaagtattaatcatgttttatcatctaacaacaataaaaatactaattataaaaaaattcatataaaacagacagttaaacgttggacacggaaaatcaaagtttatctttttttttattttacggagagagtagaaaactatggcgacacttaaaatgctgacggagggagtaagacagataccaaaataccaatatctcatattctcgggcatccttgcgtaattgtgcccaagaaaaaaagagcaaatcgtggcgtcgtgcagtgcggtgcgtcgaggatattttccccgcagaaatcctaaattcccccgtcccctctcggcgtcgactcctcgtgagtgacttcgcccgccgccgcctgcgccaccgccgatccccatccgtcccgccaccgcgagcgggcgagcagcggcgccgtcgtccgtccgccctgctgcttccgccgcatcgcatcccggtgagcatcccgtcctcttcctcattcatctctctctctctacccacccactttttttttcttctcgaatttgtattaaccctagcttctgttctagaaatttgcgttagactcagtactaataacagtttctttgctcccaaaatttttcgtgggttcgactgaacccccatgtggccatgtccgttgttagatccgccactgcgttatatcctcgtgtttttgattgggtggcttatcaaataataggtttctgaatgtattatacaaatatcttgtgcaacctacccttttatggttgttattgcctttatttaggtctttgctttgatactcttttagtagaaaaggcttgcgctaacctcgaatcagtattctgttactaatgcttttaggtctttgctttggtactcttttagtagaaaagggcttgcactaacctcgaatgaaaattcggttactaatgagtcggggcatcgcgacaaaacactaaacactgaaatgtaaaattagctctgtcctattctggtgtaaattagttaatcaaaatacacttctgttgtcatcctaaaccaactattcttaattctcagccatgacttcaatttcatgtttctcttgtgattggttggggctaaaatttgttcaatacagtttgttgctcaagggatgaatgccaacaatttactgtcactcattgatgtaggttccgttaacacacttttactatgtctaatggatgagactgcattaagtaatcgatataccctctaaatatgctatcctttcaatgtaattcgcacccgactacattaacctgctgacagtcacatgcaattgtctcttgctgagtgcatgtactgcatttgagtcccagtgactatttatgtgcttagagattaataaacttcttattatatggagcactaaagcatggcacatattttctagtaggtttattttatatccatccttatggcatgtctttttgtacccataggtactgttttaccaaggaaatatggacagatttgtataacattgcctaagctttgaatctactttgaaaccatggcccgaaaaggaagtcaaagtaaaagtgttctgaatcatgcttcacctaaccgacaaaatgcagctaattgtgaggtactaaatacaccagaaagtgatgtgatggatggtgaaaatcgaagttcacatgttcaaggtggttcaaatgtttctggagtaaactatggccagaaaacaaaaggtatcaagaagaataacagaagcaatggcatttcatcctctggcaaatcagatgacagagcctcaaaaaagcagtcagtggacaccaattatgatataggtaattcaggagaaaatgacaatgagttatcatccagcacttccaaagcaagaagagatagcaagagatcatcacggcgtggatgtggtaaaaactcatcgatagaacaaaccccaatgccagtttttgcagaaaaagttttggagaagaccaggtgcatagcttgcatggctgcatccatttttagggcttccgtgatgtatataatagaagaaagcaaattgctacttgagagaaataggccagcaatcacaactttcatggctattgtgcacaaggggcatgactatgtccgcagcaaaattaagtatacttatcctatttgtcgggcatggatgtttagtgctggaaagttgatattgctcttgttggcagtttggttcaactgcaacataaggggcttcgattctttgctacgcctagggacaaactcactccttacagtactttggtgcagtacactatcagtttttgcaatgattggactaaagaaaatgctaatattaatggtatgattcagctatccttttgccttttgagttgcctctgctgtgaatgtttactaggctatgttgcatgatgcaaccaagagatattattgttgtacagttcttgcctacagttcggtttttctccacaaaacaacataactatgatgaaataatgcaatgagtatagattaatgggcattaatagtgaaagtttgaattatgaaatggaaatagatgctcctgacatattttcgaaaacattcatcaattctattctctctgtgacccaggtaattgctgctgctgtagttgcctttgttggtcttggttttgctgttctggttatcgcagtggctgcagtggtgattttgtggctgtatggaagcttttggacaacaagcggcatcataattctcggaggtaatattctacagtttgtttactattagtcaagtatatccagcacttgagaatgtctaagaatgctgtaatatttcttgaatcacaggtgcttcctttttcctgaagcatgaacgttttgcattgcttgtcacctgcctatattcaatgtattgtgcaaaaaactatgttggatggcttgggttacttttgagcctgaacttatctttcatttcaagtgatgttcttgtgcaactcctaaagaacaatgtagacaataacaaatctgctggctcttcaaggaactctgagcaaaattcaggcaaatcaggcttctttggagaatttcgacaatcatcagcagataatacctcacagtccgagtatgctcaaccatcagatcggggccctggcgatccttcaactagtggagctgagaaagagttgacctctgaagatgaagtgtctcgtttactgaactgcactgatcactattcagcattaggcttccatcgttatgaaaatatagatgtatcattactcaagagagaatacaagaaaaaggtgatactataaacattaaccatcattgtgcaccagactgttcatgttctgcaaagttgtagtatgtaaagttatttgttaattaaatttaataatttcgcaggctatgttagtccaccctgataagaacatgggcaatgataaagctgctgatgcatttaaaaaacttcaaaatgcatacgaggtttgcatgtatttcttgttgagttaaccgcatatctgataaatatcctatatattaatgaggccccaattcaaaatacacaggttcttcttgattctttgaaacggaagacatatgatgatgagctaaggagggaggagcttttgaactacttcagacggtttcagagtgcttctcaaaaggtcttattagatattcctttttctgagtgttcatttgtgctttgctatattttttttcctaaatcttctttctttaaagtagttccaagcagcatgctgagaactatttgcaactgctgatagcccatgaactttggttggctcttatcggatgaaaactgtctagtttagctggactgaatcctcaatttttgttgtccaaatgattttgaagcgcatgtggaatagcttgcattgcataactaaagtaattatatatatatacatatctttaagtatcaaacaagaggatgagcctgcctgaggtcctgggtgaaactgaattggtctttgtctgattcatgttatagattaacagtttgtgttactggagcaggattcttgttatagctcaatggtagattcatatgcggcatttggcaattgtagttttggcagttgaaatggtgttatacttgcaatcttgtcaagcactgcatctgccaaaagcaaaattttggcttaccaccatcaaatgttttttttgttctgtagtcaattcactaaagatggtctgaaggaagtgtcagtatgcacacatggttttacttgtaccaatagtattttagtagtatgtgctgcaaagaaactgctcttttggattgggcatattcttcctggtttcctatcagttgctttaatctgtcctcttccttgtaactggttattcttctggttggcttgatattcttttcttatttgttttctctctaattgctagaaaggaggaagtggtatttttcgacaagggtttagcccttctgaaggtgttgatgaaggaccttatggtttatcaagaagaatagcctgcaagaaatgtggtgacttccacctgtggatttatacaggaagagctaaatcgcaagctagatggtgtcaggtattttcttttggcatgtggttgtttttacttttgataccatgcttcaaatctgttatgaaacttctgtgttttctgcaccataggactgcaatgattttcaccaagctaaagatggggatggatgggttgagcagtcttttcaaccagttctatttgggttgctgcacaaggtaatgtcaggttattcgagcccttgcccaatactgaaaattcagcttctttttgaactaagaagaattatttgtgtggtaactagcgatcaaaaatgtgctatgactgtcatgtaatgttgtttattgttatgcagcctgaattgcctcatgcatatgtttgtgctgaaagcatcattttcgatgtcaccgagtggttcacctgtcaggtaattcagatattcttcaatgaaatttctgattcgttcagttgcttgtttaatattgctccaacatggtggcttgttttgtacataagggccttatctattttattcttctaacaatgttcatgcaagacaatatacagcaagggttgcatgttgaatgctcatagctatgatctctggtctgtacggtatacaatacactatcatgtagttctgcgctttaaaacgtatacagatgctatgcaacatgagtactatatgcagtattgccgaaatgctaaattatttcatccactgaaagctttgttttaggtcattaaaactgtgagcagggacattaaggagaacaattattattgttttttaagactaacgattactaatatcaacttgaagatctggcaaaaagtagtactgggggggggggatttctctactctccatgtaaggcctttgtgttatggataggaaaacattacactattcacagtaacacacaaacacatagactggttgaggtgcccaatggagttatccaacaatgtgatgcaccgacaaattgtctctgcctattgagcagagagaaaatagagatttatgaattgatatgcaactgttctgttcttcagggaatgagatgccccgcgaacactcacaagccgagcttccatgtcaatgccagcttgttaaagcagaatagtggcaaggggagcacctcggcgcagaggggtggagggatccctaatggtgtaaacatggatggcggaatcgatgaagaggagttcttcgagtggttgcagaatgcactgcagtctggcatgtttgaatcgtttggcgcgcaaaacgagcccccttcccctggaagtggaagcaatgccaagggtagtaatagcagtagtaagaaaaagaagaagggcaagaagcaatggtaactgaagaaggtccgataatggcgattcttctttgtgagcagaaagaagtaaaacatatggtgtttgttcggtatagttatgcaggaaaacaccccaataataggggtcctagatgctcaaccatcctgactcgctttaaggcgatgccattcaaaatcatgattcatcttgctgtgatttttcatatggagaattagaaatcagaagagaagaaagggccatgtatgtggcaaagattgttggaatgtaaagcgcaaaatatgttgagcctacatgattgaattgtttggacaggtagcgcaagctacaatttccatacacttgtcatcagatatattacattgttgctgatgtctcgttgatacatagaaatctttctgcccttgctttacgattcaattgtgattttacccctactttttagggtttgtgatttgcccttgtttttctgaaataaagcagccgtctagccttggttttgatagaagtttggtgggtccggaatttcagatttaaacgaagatagaaaatgttattatcatttttgaatgaccattctacccttacccttggttcaatgaaagaaccaaatccccaatccctatcccgatttccactccaaaacccggcggtggcggcggctacgcgcggcagggaggagcggcggcggggccagctgccacggaatagcgcgcggcggagtcgggcgcgggcagggaggcgctgcggcggcagcgtcgcgcgtgcatggaggcgcggcgcggcggccggtggccccgcggtcagcgcgcggcggagaggagcggcggctccgtcagccagccagcgagcgagcagcgagcaggtagcttggcggcgggatggcgctgttaaaggatgtaggcaggcgcggcggcgacctcgggctggagcgcaggctagggacgcagggaggcacgacttgctgccggcgggctggcgctcctaacctcttgccggcgcagggacggaggcctagcgctattgaaaatacaggattaagagacataatggagtaaatcttgtgcatggtggaaatctgctgcaaatcccctgttttctttcccattttcctgtcttgtatctgcgagagatttgtttggtgaatggtgatttcttcctgtgatgaatcttgttggtgaatttttgcacccgatgcaagttctttgaaaatgctgcagaaatgatgttaaattcttccaaaatttgtcaaagtttggtcaaattcgaaatatatacgcattatatcaagaaaggagaggcaaatgtgtaagggtatacaagtccttctactgctaagttgacgctgttaagtgatgctaacagaataggggcaaaacagagcttcgtttgaaaaaagtgagggcaaaatcacaaaccctaaaaagttagggtaaaatcacaattgcaactcaaagtgaggataagaacacaattgcccctagaagaaatatgttactacctgcctaaagaactgagaatataaggtgaagcagcaatcgaatttcgcagttcattataacttgatatgagcatttggatgagtacaaccagtgtgtcttacacttccccttaattaactgcgggattaaggatgctaattacaagccacgtagtggagtacacaacagtagtagacagtagagtagttgattagtaaattaattgctcttgttgttgttggcgacgacgccatcgttgccggcgagcacgaggtacttgtccctccgcgtgagcgccgtgcaggtgtaccccagcgtctccgcgatccggcgctgcacctcgttggccacctccgggccgccgccgccgccggcgacggggtcgaggaagtgcacgacgtaggccggcgaggggttcatgaggaggaagaaggggtcgagcatcttccaccccccggccgtggtgccatggaacatggccacctccgagtgcagcgccacgggctgcacgtcggcgccgagctccgtgaagagcgggctgaagcgcagcaggaacggctcgcggcaggtggtcccctccgggcacaccaccaggccgccgccgccgccgccgcgccgggagcgggagaggtgggcctgcatggcggcgcggtcggcggcgcggtcgcgggtgaggcggaaggtgcggatcggggcgaggatctcggagaggcggctgatgctgtaggtggcggcggcgaggtcggcgcggccggcgacggcggagacatagagcgggtcgaggagggagcggtggttgcagacgaagaggtccaagaccgcggcggcccgcagcgtggaggcggcgatgcagcggcagtggatgccgagggcggcggcgatcggggcggcgagggagaaggggaggacgacgacgatgagggcgacgcggaggagggcgaggggcacggccagcggcagccacacgaacatggccagcgtcgccgacgtcgtcggccggaacgcgacgcggccgtcgtggaagatgaggggcttcgcgtatcgccggggatggaggggacgccatcgccgccgcgcccactccgacgccacgtacacctcctgcattcattaatgtttgccattctcacttgattaatctatcttgcatcttcctttctactctctccctaaaaaaaaaaaatcaacttctagagcttaaattttatcaaaaaaaacttgtacaatcttatctattctcagcatgtaaaatgaaaagttttattccttcgatactctttacctatctatcaccattactattttttcaataataaaaagtattttgttcatttttactctgcactaactttatatagggatgcgagggtttgattttatatgggatggagggagtacacaatgtgttcagtaccatcgcacaacacctcaacaccatgaatgcgtccgttttaacccacagtaaaagtatcgggatcaatagtaaatctttagcccgattaaaaaaaatgtaatctttatattaattatttgagcgtgtaaatatttttctaaaacacggaacaaactcagacgtacacaaaaacgcgcacactctatccctgtgagcatttttaaaaagactgagcgacattcttaagattgataaagtcatcgcgagcgtctctctatccctataatgaaaagaatattaattataaatgcgagcacgtgagctaagtctaggaattgaacccgaaagacagtttccaccacaaggaacccacgcagttacaaaattactaattagcgatcgactgcgtgtctggtcagtttccgatcatgccttttttttctatttttatacatacacgcataatttgtacatagaagtataaagtttatatgcgtatgtgtattttttatacatctaaaaagtatacacacaatttttctaaatatagaaaatttgtagatgtatatgtgaagtttatactttgtatacatacatataaatttagtatatatacatgtataaacttggtatatatacatgtacacagtttatacgtgtgtatacaaaagtacagtggtggagcaaagatgccatgaagcccagacaagtattagcgtttttcagtaatcaactaattttttgggacatcaaatgctatctacagccgagacgccagcgacagagcctaagcgaccgcccgacctgcccttgagttagctctaccactgcaaaagtatgtacaaacgtacaggggatgtaaggaggtgaggtgaccgtgctaggcgcgtggcaagccatccatcagcagcccctaactagttgagctacgctcatttcgtaagatgtaaatatacatgtacatgtatttattaatcacgtagtagtatatactattgtagataataaattttattctgtttgtgcacaagcatgggcgtgaatgagaaatccttacgaatttatggttgagaaagatgtgtagtaaagagtgatcgacaactggtagttaatcggtagattaattgaccgatgtcttaatcggttatgcagatttatttgatcggtacgaatattaatttgaccggtgtcttaatcggtcggtagattaattgaccagtgtcttattgttggtaaaactaattttatcaacactgcagctgatcatgcatactacctccctaaataaatttattttttatcaatctcacacgtatcaataggacaaaaaaaactaaaatagttctattttattaaatcacaatataattgtttcttattttatctagtttcaatgtatttactattcacttttacaaactctaatacaatgattgctaaaagtaaatttaatttggaataaactggaggagggtaaacacgatgttattttaggacagcggaagtaaatatgtaggatgcatgtcgggtgaataatacgatttgattcacctgaataaaacagtgctcttaattatatctgataagagtagtaatataaacgtgcaacgtacgtcgattcataacgaagtgatgcggagctactgtatgcacgggtcttttcttaatgatgatgttgatgtgaacagagacttataattaattgatgaaaaaaaaatcgatcagtgccatatatacgaaaatacggttcatatgaaaagaatggcaggggcattttagtctatatgaaaaatacttgaacaaagacatcctagatgtactgcgtactacataatgatatggtttaaactttgcaaaataatcattatatcacccaatttcatcctttgtaatgataaattttaatagggtattttttataatgacataaatccaattaaccttcttaaatatgcatggttatttacatactaccagtatgaacagttgaaaaccatttgaagatagccttaaaagaagcatttaattttaaagtggcatatatataggtactacaagacaagaggtgaataaactgtagctctgctgacaaaaattcagtaacatgccaattaccgttctgggccgtgtgtacgtaaactgagatttcaatgaaaaccggcattcataccttacccataactcgctatatacagtccggc

SEQ ID NO: 74852 - DNA, 582 bp, Oryza sativa
tttgggatctatgtgactttccttgacctttttcaaccccttctgaaccttcctcaacgtaaacgctctcctccggaatgtcggaaactaaagcaaatgaacaaaatcaacaaaacagtacaaaaacaagcataaacagtacatttggatatttttgacatgtagatctcgattttagatgaatttagcaacttgaaccactcgaatccgagttacgatgatttagttatgaatttccgaagtttaatcgattttcaactaatacagaaaattattacgaattaaataaaggattgatgacgtcacgatgacatcatcgccgaccatggcactggacgacgcgaccaccagcgatagagggctcggccgggctatccgaggacacctacgcgaagaggacgacgacgcgaactcaccggtgcaagaaataacgaagtacggcgtccggtgacgaggaccaatggcagctcggctcggctcgatgtcgacggtggcgctccggcggtctttggcggttgcgaaggggcggacggggtgctcctccaccgtgcgaacccggtggtggcgacggacggcgatggc

SEQ ID NO: 74853 - DNA, 527 bp, Oryza sativa
tccactgcagacctctctgccgctcaccctctctgccgaccttcccgacgccggcctgcaccaccgccgccgcactcactctctcgaccgccgccatccatctccaccgccatctccaccgtcgccgtctcgacctctccgccgccatctccgccgccctctctgccgccatctgccaccctctacaccgccctctccatctccgcctcgacctctccaccgccctcctggccaccgccctctccactggtgccgcctcactcactctctcgaccgccgccgggacctcctcttagtcgccacgccaggaccatcatcgccgccaccgggatctcctctccgccacctcctcctctcgactgggacctccacagtgcgccggccgggactcgtagtcgccgtgcgccgcctcctctgctcgtcgtctcctctccaggtacccctctctctctgatgccgatgaatggaatggtggagttaatggatgaatgaatgatgcaatggaatggatgagattttgttcaatg

SEQ ID NO: 74854 - DNA, 878 bp, Oryza sativa
  unsure (1)..(878): unsure at all n locations
agagggacagctaatatgtantggtaatttaatttntactttcacatttattatatgttacgcagggatgagtaggggtaatttncctgttcactactcaccccccaggatgatgtcagtctgcatccagcacngacggaaacagnntaatngaaggaaacacaaagaaaaaacancaanccaattncggacggccgcgaacactctagaaatctttctttatgttgggcccataaaaacctgggcccaaatcttaataggccgggaggcctttgtgatgatcgggccggatccaggcccataaaaaacctgggccaaaagctgtttgacctcctcttcctttctatttctttcacacagttacctttcacctcgggggcgggcggcggccggcggctaggtcctgacagcggagggagcaagcggggaggaccaggcattgggaccctggggcgggcgatctacacggcggggaagtggatccgcggcacggggcaggccatggaccgccttggatccaccatccagggcggcctccgcgttgacgagcagcgtaagcagcagcagccgccgtctctctctctgacaatttggcagttgttattgggaagaaattggtaggaatggattgggggtgactggattcgaggagtttcgaaatgaggcctaattatcgtcggttatttggaagttctgcattccaggttttcaactagtgatcgatcttagtgtgtgaacactgttacagtaaaacaagnnnnnnnnnnnnnnnnnnnnnnnncatactgcccattgggggagtgtcacattggcaatttggcatggccaaatttggagtggttaggcgattaattcttggggcgtaacattatgaaaat

SEQ ID NO: 74855 - DNA, 992 bp, Oryza sativa
aacgacatggactgctcggattgtatccatattggtttccttagttctacttggataaggggacatctatgggtataaatacaaggccccctaggatgagaggggacacgaacaatagatcaagacataagatcgatatacaagccaacatacgccaagacaagccgccggacatcgacatcagagatatgcctagatcgaccctatctggtacctacagaggccagccgtagggatctagcgctgtctctgatctcgctgggtacgaactcgagaaggaagaataccctgttgtcgactacgagtcagaacttcagaccgccaagtcgacaacagttagataggctaccccaaatattgtactggtgtgattatggtgaataagaccaataccgggcttcggccaacaggatgtaggattattacctgacaattcaagggcccgaacctgtataaaaatctgcgtctccatctcttttactacaatctcgcatatatcctagtaccaacgatccccatactatgcaaacaccggaatcgcgacatcaaacatcgacaacttggtggcctacaagagttggtagaaatgacacataagatataatatgatatagtagtaaaaatatagctaatatagcagtggaattggtgatttaattaaaacaatctacagctgctaaagtgtatgcgtagatcgtctataaaaataattgtttatttacaacaccaaatcacttgtattgtaaattaaattcctagcgtttgcacgttcacactcagattactctctatgaaaaaaaccgatctaataatttatgataataaattatggtgtacatgtatcatgtaatttggaaaaaaaaaggagaattaggatctggatggcatcaatcgagctcaccgaggcagatcagtctccatgaaaatgatcacaaattatgatgcacatgtattttgtaattagtacgaagggtaccgagctggattgccaa

SEQ ID NO: 74856 - DNA, 1095 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagt

SEQ ID NO: 74857 - DNA, 615 bp, Oryza sativa
tgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagcccgttttgctcacggatatcagaccagtcaacaagtacaatgggcatcgtattgcccgaacagataaagctagcatgccaacggtatacagcgagtcgctctttgtggaggtgacgattacctaacaa

SEQ ID NO: 74858 - DNA, 1714 bp, Oryza sativa
taacatcaggcgctttccatgcaggattcggtctctccccaaaaacttttggttcccggtcaacatcgcatgtgtgctcccatatctacaataaacaaaataacctagttaaaaatcctggagaatgagacaggatgtagatgattaaacgagtgtcttagagttcacaaaagaagacaaattaacctaatgtaactaggaaaagcaccaaagtacctcaatatcaaacatctcaagtgatggtgcagcttcaaggaggtttgttgtccataacaattcaaattcagaaaagatgctatgtatagatagcttccttagattgctgaatgcacggaagagttgttttccttctggctttatccatagctaaaacaagaaacattcacgtcaaaaaaaaaaagaaacattcacgacaaaaatgaaaaaagaaacatgagaattgatgttatgcatggatgagcgtacatttgaattagttaaacaaaattaaggcatgcatcagctttagaaatgcatacatataatcattgaagtattgctacttaacattaaacatttgttcttgctcatgtgaaaatatactagtagtacatcacgaacaactatatgctaatgataacagcagtccatgaaaaaggatggacttaccttttctccttggaaatccaatgttagagtatgtatatttgtagtaccacttggaacctcacttaaaataaatccttcatgtttatttgttgcaccgcagataagagatacttcctgaagattcgggacaacatcgaatgacagcggggcataagggcaaagccaagtgtcccaatttagtcgctccaatttgggaaggcagagcacctcaagtttctccaagcagcatacatcaagttcaagaacaatgatgttcgaatttggtgcacttattttccatatcgcattcttccccacatcacaattggatagactcaggtatcgtagttgattgcagcattcaaacagatgatggtgcaagtcccaacgggcaaaacatagattgtaaagagagagccttgtgaggcgagtaagcacactaggatagccactgaaaaggtctttcacagatgaagcttgctgtagaatgtgcttatcggtgcaatctacaatctcctcctcgtccagaacagaaaggtccatatcttttaaaatgccaacctcaattgccttatcaagcataggaccgacaacacgtgagtaattattgatcaggtaaagctttagttgaaacctattgatgggaaattcgctccgagctatagtcaataagctcctgatccctttggttagagatgccattgcttcatccatatgttcaaccttgatgcggttcggttgtgggacaggtagaaaatccttgacatcaatggtgaactcagggagcaaccaaggcagatgtttccagcgtgttgacaccacacttgtccttacagccgagattatgtccactctccccaagatagacagtaaaatgtcatcagttagcattgagagccgatcctcatgatccatatcctacaacaaaacaaacatcagagcacacatttgtcaaaggagccaacagaatagacattataacataataagcaacaagagctagtacaacttttcttgattctaaggtatgtttaccaggattctttacattataatgaaatattgtgctctaattttttcccatatg

SEQ ID NO: 74859 - DNA, 966 bp, Oryza sativa
agggggatttattttctttagtttttcttttagtaaactttgttaattgtttttgttgcttaataattatttccggagctctgaaaattcaagtaaaatttgagggctccttttaaaccaaggagaatttaacaaaaattctccggaccacattcgaatttttctgatacgtattttagtgtttgccaatttcttttcgaattttaattaattctattattccttttagaaaataatttttaattttgggatgaatttatcaggatgtgacacttgccccataagtaaaccgagccaattcatctctctctctccatgttactgcacctttttttcttactatacatattcttgcagtaacgttatcaagtaatcgcggtaacacactatgttactatgaaacttataatcgttactacatcttgtagtaacggcgttacatgattgcagtaacgcatagcagatcagcagtaatacttatgatatagtatcgtggagagccaaatttttaaaaaaccaatctttgaagggtaatatctctcacatcatgtactacttttaaaaaccatttgcaccatgatgttagaaaaaaagtgcttatcaaaagtagatccgtcatgattatattatgactacatttcaatattgttactgcaagtaagacatgatgttactgcacgatgaacatcgcgttactacgttgttctgagacgagagctgataagagtggaggtggtggggaaagtgaagggcgggtttgaccgagatggggagctttgaccgaggtgtggggtgggttttgccccctggaggtaggggggtatagaatagttattctatacccgggtgtagaatagtttttctctctctctctctctctctctctctctatatatatatatatatatatatatatatatatatatatatatatatatatatatatatatatatatatatatatat

SEQ ID NO: 74860 - DNA, 25678 bp, Oryza sativa
  unsure (1)..(25678): unsure at all n locations
ataggcatgcaaatcaaattaaactctgtatcatatcactaactactactcccccgttttatattataagtcgtttatttttttcatagtcaaagttactaaatttatagaaaaaatataataatattttaaatataaaataaatatcaaaatatattcaatgttaaattatatgaaaataatttagtgttgtaaattgctaatttttttttctataaatttaattaaatcaaaagaatttttttaaaaaaaaatcaaaagacttgtaatgtgaagtcagggagttctggctttgatcatcaacactagatacggagtagtagctacgaagagatatgcatgcataacgctgacgtggagtaaagtagtttgcatgtgacgacacatgcatgcatgtagagtgaattaggaagtagatttttttccctcgagggacatcactcgttttgcgtacctatagttttaaaaaatacttttaagatagatcactatataatatatcttttcgtaaacatattagttaaaattcaacttatataatataaaacaaaaataacaaatttgactatgaattacgtgttcacttcgtagttaaatttattatttttgtttttatctatataagttgaatttgaattgaagtggcaaatcatatactgacctatcttactaaatttttttaaaaattttgatgactttttaagtgatatcccctttaaggattatttgagttttccgagtgaattactccactcctaccttgcaatagttttggaagagctgatggaacgagttcccgagtccggcgatgccgacgacggtgacctgtccatcaccgtcaccgtcgccggcgccgccgcgctccttcatcccgatcacctcctccatgtccagcctctgcatgacctcgccgtcggactccgcgaggccaaggtaataccccctgaacgccctcagctccggcgccacgacggcgtcgacggcgaggtactccttcaagaacggctccaccatctccctcggcatggagctcacgcacaccagccgccgccgccgcgccgccgcatcgaacacctcggcgctgacgtcctccaggaacagcttgggcatcaccgccctgcccacccggaaggacggcgacccgtccttctccttcctgactccggcgaagctgaccatgaccatgagcttggtggcccggtcatggccgagcaggagcagcacggggtagagcagcagcaggaggaggccgcggaagagccccccggcctccagcgcgacgagcatgaagtacgggaaggtcgacggcgacatcagcaggccgccctccaccttgcacaccgtcacgtccgccgccgccggcagctcgtccgacgacggcggccgcctgacgacgtgcggcggcggcggaggaggatgcgcatggaggacgaaggatttgagccgcctgacgatcttgttggagtggaagaggagggacttggtgaaggccttccacgacatggctgctacaactcgttcgatcgagcgcgaatattaaagcagcatgggcaaactctaattaacaactaattaagttagctagttgtattgggagctagtgttgcacctgtactaacattatatatagacggccgggcaggggcaccgcaggggagagggagaccagtgagagtaactatctctgcaattggcatgcttttggtcattgtgtttttatcaaatcaatcatatatttatgaaaagaataaaatgtatattactatatgaatctatttcatatagagattggtttcttctgtacggggaggattaaattttggatactcgtggcacgcttttcaaactgttaaatggtgcattttgtgcgaaaactttatatacgaaagttgctctaaaatatcatattaatctatttttcaaatttataataattaaaactcaattaattatatattattaccatatcgttttgcatgaaacacttaatttttatcttcatcttcatcctcagtagattcaaacaccaccgtactaccacgtatagaatcacactacaagctaccatgggtgggacccacgtgaataaaaaagggaaatagagattgatcactttctttgtgagcgcaatgatatctgacatgtgggttcagtatacttttccttaactgaaaccggatgctaccactagtgcctgtcactacgcttaattcaataaggagaattttgcaatgtatacagtcggctctatcaccttctttctcctatggaaccctttctaaatccaacaatgcacgtgctatataacatactcacatcctttgctccaaacaacatatagagtaaaaattcctaaggtttagaatactttaaattccttcgatcaggtcaacgaggagccctaaaatacattaatgtcaaggtaaaaaggtagagaagttaatagtgccaggtgtctgcaaatcatccaactaacaatatttaggttgcgttcgagagatgacgtacacataaagctagaaagtccctagcctttccacgcnnccaccacttttcttaaactattaaacgatatgtttttggtaaaaaaaatctatacaaagttgctttagaaagttcacattatctatttttaagtttaaaataattaatacttaattagtcatgtgttaatggcttactcgtttacgtttattttcattttatcattctgttttctctcaaacatagccttagacgccaaaattctttatcgggtaagttttcatctacatggaaggcaagtttacacctacatgaaaggcgtaatgatgtatgagagaaagagactcgattagtataggatatattgtaaagatgaaaactacctatatctagacgaatagctttgttgttcctttcctagctatatgcagcttaggtggaagttaggcacaattaagtcatcaataagatattatatattttagaggatcctgatctaacgcaacactgtatatttccaatatttttgagatatttttaatagacctgtttatgagtagctaggttagtacatcgacatttcactatatatgtcaaagtctgaaatgacatattggtttattagctgatgtctcacattttgttggaaagccccttccctgcacacagttagttgagccttagctacatggatcgatttccagctttaaagtgattaatacagtggtaaccatcaacacggaaggatggttaattaattggagcatacatgattaaattgccaagctggtggcaggcgtctatctatctagtacggagtactacgtgtccacttgtacagggctgtaattaattatatcagcgcttaatttcactctgttaattttccttgaaaaagtaaggttcactgttgcaataattactactcctaattagctgttcctacaacgacatgactttcgctaatttacatttggagtatatatactttggcgacacaaaacctcatgaggtttctggtagagtgatatgatatctcattggtggggtattgtatattaattattatcagcacgtctttgtatatagtcagcatcatgttggcgatgtacgtagctgattaacgatgaagatgcacacagattactcccacccaccgccgcgtttctctcactttaattaattgtagtatttgcaaaataaaaaagaagtgcaaaagagttgcattgctagctgtactattgataactacatgtacatttggctaggtaggatttatgtttgccatttacactgttataatattatcaatgctagctaatcatatgcatggaggcctgcagttgctccaaatttccattattcacaatatgcatgctatctagccatacaaaattcaacaagtccgaatgcatgcttgtcgttcccgccataaatattttatgcttaagataaaattgggtaaacttttaaaaattccgataatcaattttatatttaaataaatttgtaaaatctaataagtttataatattatgatagtacttttgaggcaaatacacatataccttttttaagctaagcatttgaaaatttactgatggtcaaaatttaaaaattttgatcgaatcttattctgagggttaattttttttgtatgtcctgccgtttcccccaaaacagagggcagcctgcgcactgttatatatatcaaatgctgaacatgcttgcaggctacagttcctccaaatttccattcacaaaaacagtctgcatgcatgcatgttgttctaggcgccatacaaaatgtcatcaacaggcttaatcaaaattcaaaagttatctccggtcattgacgcccaggataagatttgatcgcactttaaaatcccagtaatcaatttcatattagaaatgtttgaaaagtctaataggataatagtatttttcgagacagatacagcataccattttttaaattatgtatatgagagattttgttatttcaaaagtttgacaaaagagagtatggatgtgcttacatctaggggcgtaaagttttagcgtgtcacatcggatatactatacgggcatacatttaaagtattaaacgtagtctaataacaaaaaaaattacataatccacctataaaccgtgaaacggatttattaagcctaagtaattcgtcattagcaaatgtttactgtagcaccacattgtcaaaatcatggcgcaattaggcttgaaagattcgtctcgcaatttacacgcaatctgtgtaattagttattttttgtctatattttaatacgtcatgcatatatccaaacattcgatgtgacatagtgtaaatttttgtgaggggatctacacaaggcctatatacgcactggtgctaatttttcaggtatatagataaaattagagatggcggcttatgatatgatagatgaatgtgatttgcctcgatctgcatgggatgggcacaagggactgggtgttccaaccgatctgattggcacttgcagtattaattccatcgaccgaactaacactaggtttaagtagctacagagaaataatttaggtgaattaaatatattgttctggtctccagtagcaggtcaggccaccttttcgtcgagtgaaagtcacaggcttttagctgataataaattgggccacctttgataaccatccgaaaaactagtgttttaaaaaaaaaacccatcgcatgtgccaacatatggattatggcctatacatgttattttcatatttgatgatattttgcaactcacttgtctctaacatggcattttccatttttttctcaaataaatttcaatcatttttcgtcaagctttagtcgcgagaactgaaaaataaattcatcgatgtccaggtaatgctgcatatgcaccaatgtaaggatttcttttcccccaatgaatgtcaaattaattgaatgtactccctccgttttgaaacggaggaagtacattttaatttgcacacgtacttacacaagagtctctgaaaaaaacgtgatattaatttcaaataaatttatactattgtctagggcagaaactgaaaagagaggacaacaggaaggccacacatacttttcttgttacaggacacattgaagttgtattacaccggagcagcagaattgagacctaactacacgtggattttaaacatgacaaagtcagtcagaaaaataatcaataaaactcaccccttcccttaaaagaaaaagtcagtcaaggcaagcatcacccacgaaagagaaaaaactcaatccaatatttcccttcgccacaattttcttcttttttttttggcattgatatcgattaggctcatagtactgtaacttaagcaggcagtgcatgtcattggatgcaaatcagatggtacagattgcatgctgtactgtgcatagtactgtagcaaaatactgtagtgtgaagcactgtagctattactactgtagcgctcgctctgagccgttgatcgtaaaaatggatggccaaaattgtgtgcagttttatcttataattacaagtgtaactgagtgtaactgcacccgatctcaattctctaaggagtaacatgatatctttagggagaaattatatcctcacacggtgaacatgtcgatcatgtctgcacgtggataagcacgtaaccttaatcatgcaggcgtaaatgcaaattaggaacgcattaagagaaatgtttttgtattgtgtatgtattatctcgactcgatccatttctcaagttgtgataaaaattttccgatgcattcattgcaagcagcaaaaccacaatgacgaccaaaaaaaaaagatctgactggcgaacgaatttgcgatcatatgggaaatcaatgtcaaactacagttagttagtttcctttcatttatgcaaattaaacaggagagttagtttgcttatggtgaacagtgcctgtactaacaaacacgctgcaatggcataactgatgttagttaaaacataaccatagccttatggtgcacgagacgcctggaagaacatgacggtctctaggcacagcaaaatcaacagtacacacgaagatgacacctgaataacttgaccaaagtccaaaggtccactgcaagtactagaagtatcatcgtatcactgtataagaaaaaaaaaaaaaagcaacctccatcgacaccctactaaccactgatgcatcattgttttgaagtctctattggttgtgtcccggcatagtaatagattaatagacatgatttattgtttctaataagtacttgtataaagatacattgacgtgtgggtggacttaggtcatgtaggaacctgcgtgcttgcgtcgtggcgcttctggtctgaatcgatttacaggtggcgaaagaatggtggattggtggcctacagcttgaatatggctgctccactcgacggcttggacgcgaacacgtacaacccaagatccttctggttgatcactccccggtcgatccttgatttatagtacgtttcctgcaataaaatgtatatcttgtcagtgaggatcacctccaataaacagagttgggtgctgctgtttcacttgaaatatgtagactatagttgtctgcgtggattatgtatgtattatcatgcatatatgttgcttattggataaagacaagagcttacagatttaatttacctttaaattgagaataaactgcgggacaatgccttccttaaccaaagcgactgcacagccaccccaccctgctccagtaagacgtgctccgagtgctccgttgtctctacatacttttacaagctcttccaactcgggacagctgggcaatggaatatgtcagtatgctataactttttttctgaaagagaggactgttttcatgacatccgaagtgtcaatacgagttttaagtatcaatgtgtctgctcaggaacgatacccatcgtagttaaagtacactactaaaaatggtacctgcattcatataacacactgcagctatagtgactttcattcataagatcgcccagtttttgaagcatatcttccgcactgcagaaaaaagatagcaacagttagatctctcaatttagaaataaatgttcgtatacgggctgctaatcgtccatgacagctgtgaggataaatgtagtaagagaatagttgggaagaaacaaacaagaaaataaccagaatatgcatggtgactgcaattaatgaacgtacctgagttttgacaatacagtatctctgaaggcataaacccgccttgcttccgagtacacatgaaaggcacgctgaaagtaaacacacattagaaacttataaccaattggcatatcatcaaagggcacagtcaaacatattcctgagttacacaaaactaaagcgaacttcagcaaaaaataatgcaaaaaaaaaagtaccacgcaaaaacaaagagacatgtataatagaatgacaaaatatctttaaaaaacagattttccacagaagagttgttctactgagtaggactgcatcaaagggaaatcacctgaaataacttgaaatgctttgctgctcttagaacatccaaggaagtttgagagctctggaagatagatgtcaggctttgacctgtaattttctctatttcttctgttgtatatgattcttcatgtaatagtttctgcaaaattacacaataacacaatcagatgagtacatgataagacagaacaaaaagaactttccagcattacttttataaaaaaaattatatacacccaaacgctaattacaacatattgtaaccaagtgtcccatatgagtacaaaataatgaaacataacttgcctaacttgtaccgatcatctcttttctcgaataaatagatggaacgtacgtatatccttcatgagaggataatctaagttcctgataaaattttgtaccttcacggcaactccaggatcagaagaaccctcttttccagcaaaagagacacataacccctcaacatcagagagggtggtaacagaggagacagccttttttgtttccatccctagtttgatggcaagaacaatctgcaaaaatgcaaaacagcaatattaaatgaacaaatgaaaaagaaatatcattactttgttggtgatatagcagccagctcaaatccagttccaaagtaaaattttaaaattgccctagaagctgaataaacatgttaaggtcacttgcattgtgcagcagcacaacagaaaggaatctgggaacctttgaatattcttaaaatttcaattcaaaattaaagtcaatttacagctgccaagtcacacatgtgcaaaataaagatgtctgaaactagtgtttaaacatgttcagtccgaaataaatcacttactgcagccaggcgacattcaacaacacggttgttatagtttgttgcagctgtctctgctttcttggactctgccaggcaatgggcaatcacaaatgtaccgcctggaggtagttgcacatcagtggcatggattggattgaaatctatcaactcagcaaatccaggtttggccatgatagatatagcctgggaaaatataatgaaatgttaacagacaacagggtagttcaaaataaaaaggccaactaaaatatgttattcattatataaatagcattgcttgtacacacagtaataatatataaaaagttctgcaaaatttattgatggtcatcctgtcatgagttgattttgtaatcaatacttggaaccacgatggttttttgcacgtaagcatgattatattaacaaaaagtttcagaagaacacaaatagtcaaaggattatatgaacaataagcgatacaatttacgaagtagtatatttggatgtccatattacaaacatagtaatatctcgtccataagctaaccccaacaaatgacattttcctttagacagatgtactttgatttacatgacaggtggcataataataagttaaagtacaaaaagaactgagtattaccataatcagttagaaaactatgaactatttacctgatccatgcccccagattgtgttccaatgtggcgctcagattgacaggtgaattgtgcaacttctttctgcatgatttgaatggaaaaattagaaaaaaaaatctcttgaacttttctgaataatgaatgcaaaaaggaaactgaaattacagaagtttgaacttagactatgaggtgaacatgtcaggctccagtttaaacttagagccaccaggatcaattttatctctcaagtttgcactgttcaagttcttggtgtaccattttctataacaaatacatacccattatgtacaaaagagcagttcttttttccccaaattttatggtataaaatcacttcagcaaaactcaagattcatcattctatccatccatctcacccttatacagtgtttcagttgtttgcaatccttttcagaggagtttggtaggcttcatgcctcccatacgaattaaaaaattacttcactatcagtttaggcaattaatattattttgttttgtggacagtactggcaataagggagctatgtgaagataatggcaagggagttgttcgattcgtagcaagggatacctttgggaaatttttctcaagaactcccatgatagcaattgttgctgaacagacaaatgctgctgagcttgaaagtccagatcctacataagagtaacaacacgcaatcatgtcaaacttaacatgcttattatttggaagtgaaagaatcccaaaacaaaatatcaaaaatatacctgtaggaactgtgccatcaacaactacatcaaggccaacaggtccacccatatctatcccttttgacctacaatactcataaactcccttgtatctgcagatagagaattgaacagacaggatatgttcgttttctttttcttgtggccaatgaagtgtatgaaaaagtgaacaaatttcgctatttatgcaacattatacaatattataagaattaacttacccacacatgaaatagtggccccatttgtggttttttatgtcaatttcctgcatgaaaaatatttatcaacaaccaaatcaatatatcaaagaaataatcaaataactgaagctaagaaaaaacagcaacttcagacggatcatggcacaattccgaagccagagatagcattttccatttcatattattccaagtcaaatagaattaagaatgaagcaatagtactagtatatgaaaatccatttgcaactgcaacatgatggcccccatcgtttggcttattcggcatatttgaaaacgaaaaataatttataaataaaacttttatattagtgttcttagcgatttaaaagctaaggctgaaaaataaacttcaatgaaaaaacctcaaaatcaactccaaatttaagattaaaaattcaaattttggctgataaggctggatgaggctggatgcaatgcagtattaagcccccatcgaagggctgaatgggagtccacaaggaatgtttgcaatccatttgaaggccaccagcctaaaacaaaacaaaggggaagcatggacttccacaccattatctctgtgggccacaagcccgcggggacaacaaattaagctcacgggcagggcaacgaaactgtatcacgggcttcttgttatgataataaattaattaatggggtaataacgcaaccacccacccatcctaaaatagtaaggagattgtctctacctccaccgaaaaaaaatggaatccgatgcgctacagaaaactctctccctttttctctttagaatctcaactaaaaacattccccgcgataactgataaggacctacgttcttcaatcaatctcaaccaacgaacgaaaaagcaaaaaattaacaaaatccactcaaactgagcaggattaatctaggaacaggggcaaagcagagtagaatgctggcaaaattaaccttgtcggggtcggccgggtagacacagatggggtacttgtcgtcgacattggcgacgcgcacctccttcccctctgccctcctgatggcgacgatcatgtcctgccggatggccatgggcaacaccgagtacccctcgtagtcgatgtgctcccctatcagattcacccgccctgcacacacacacgcacacgcaatccatccttgtcagatcaaatcaaacgcatccaccgaaacctagagtggtacccatccatctatcaacctacccggagagcgggcgaagagcgcggggcgcgcggcgtagacggcgtggaacttgtcggcgaggcgggccaagcggaggcgcgcctcgtcgagcggagagccgtcgccgtagatcggctccagggaggagaacgtcgggacaacctccgcctccgccgccgcggcggcgcctcctcctccgggcacccgagccgccatcgctggtgctctctcgcctcctcctcttccgcttctcgcgctgtctagcgaatcagtcgtcgtcttcttcctcacgcctcgtctctatccgttacaagtcgtatcacactctatgtgattgcggggtggcaacttcgattgactactactaaccttaaccttaaccttaacctccctgggttatatagacgggggacgtgatgactcaccgtcgcagacaggtggtcccggacttatggctggcccacacgtcggtgaacgtgtagtttcggactcggaatggatagatgggaagtgggacccacttggcagtgagagagtgcagcgggcggttttgtggggcccaccggtcagtggcactggatgggcggtggggtggacacatggcgagggcgtgggccaactgccgattagttccactaactaattaattattatccgattatgggtgattggattttgcttatcggcgtcatcggtttatatcctatcggtatcaaaacgatttgccacagaacacgtaatacgattcggcgtccagataactttatttatcatcatcaaaagatcgtttagaattcgagtaagatttatcacgtcgttagaaatgtgggtccatatttgtgttctactagtagctctttagcttctcaattattctctctatttcacactataagtcgattgatttttttaaaattaaacttgcaatttgcagtaaaatataataatgtttttaataaaaataaatattacattaaaatatatttaaaattggatttaatataactaatttagtaccttagataatgttattttttataaatttagttaaacttaatactttaaaaaaaaacagacgggagtactaggagacacgtggactcggtagcaacccaacatggtgcgcatcgcgtcacggctgcgcgcatataggcacagtccactctccagtctccatagagggaggcaaattactacattatggtgtttagttatttaggtgtaaaattattaactatacagatacatatttatacatatttaaagtattaaacgtaaactaataacaaaacaaattacagatttcacctgtaaactgtgaaatgaatttattaagcctaattaatccgtcattagtaaatgtttactgtaacatcacattgtcaaattatggcataattaggcttaaaagattcgtctcacaatttacatgcaaactgtgcaattggttttttatatttaatgtctcgtgcatatgtataaacatttgatgtgatatttttgaccaaaaattttttatctaaacaaggccttagtcaaatcatattggtgcattatttaaaagtataaccagcgttcagtaactagtacggcatgtgtatcatcaagtcacaggcacctagcatgacttgtttttgttaatcccaccttccgtcagcttcaagcttaagcagctaagctgcactttccgtcgagatacggacctaagttttgttatcatactagtattatacaatcgctatttttaaatagatatattttaaaataacatttaaccattcatactattttaaataaaaatatgtaattatagtaaggtataaatcatatttaaagtttctttaatgataatacatgttataaaaaataaatattatttatataattttttaaatagaataaatagtcgaacataacatcaaaagttaatagcattatctatttacatctagctaagcaagttgcaatgtgtactatacagtcatcatgcgtacccctcagaatctttttgggacgaagagagtatatccgatcatctgctttcccgcgtcactaagtttctctagcttcaagtagagtgaatctagcagctgaaactataccaaacatgtcctaacactggatgggtcaaacatagaatatcaaacatagaatatagtacataattgaaaaagtttgaacttcctattcaaacgcatggaagaagtttgaggctttgagccgcatgtgtacaagctcattcgtgaacacaaaataaacgcatacgagacaatgttcacaaaaaccgctataacttacattgtttttttcttttcacttttcttttgttaccagatagctaattctgctggcaaattgtttttacttcctcacaattgacaaccgcgaaccacattacaggacagagatgcaggcgtgcatcatatgaacagaaaacacatcagcgagaaacactacaagatcatcgagtcagatacaaagatgctccattccattgctaatcctgaatagttttacgattgatataccataaacttattaatattgccgcctttcttcttctgcaatagctaccaaatccagctcaaggatctcactcgcatttttgggctcttgtgatctcccatactggaagaaatttctcgccttcaatatacgcttcaatccgctggctggtatttgcaatagcgaccgtaaaattctcattctgaagagtatagagatacattgctcgttcatcctggtaattcatcaccgggaatttttaataagaataggaacagaaacttagcaggcatagacaagtctagtaaagaaaaaaagaggctgatgctacatgatgcacaaaattacaggattagctataccgttttcgtgtgccgaaacatgtaagtatcaggacttgctacctatgagttcgcaggaatgagaccaatagtgactaagctgagactttggcagtgaaccaggtaagtttatatgcaaaaactatcaccacagaattgttccgtaaaatatcccaggcagtggcaagtgatgcgtattgaaaaggtgttctcgattattaggtacatgtgtaagaattttgttggttaatacctcagggagttccatatattcatcaggagatatttgaaggaactctacggctgtttgcccaatgcaccaggcaaaaaccttttcactgtcatctgcaatggtcaagtgaagctgaaagccatgtgtacatccactgatatggcatgcgcacttacagaaggaacactgaagtccgcctgattgatcactcacaacacacccacaaagattgtggaataataataccttcaaactgttgacatcgatgtggtcaagtcgaacatggcatatctgtttattaagatatcaaacacaatcaggatattaggaacgacaacacaaatgaagaatgcaaagttcttaaaacaaacaaaataggtaccagaaaatactttctaaaatgtcactgataactctgcgattccatctaaaagaactaaaatgtaaatgcttcagaagatgtcacaataataatgaagacttacatgtgttctattagttgaatggggaagatctgacaagagtgacaaattatgcaggcatgttgaattaagaagcgctggcagcaagcttatgttaacaaatagagaccctggttccttttcagtccacgcgacttcaagcctgtcacaccaaatagtccaccaaccagaatttttcaccatcaagcaattattgcgacatttaaattgtgagcatatgaaattaaaaggaatatagtgcttacttgtttgttgaactcaaggtacaagtcaaaccagacatgtacaccatatgaccaacacctaccctgcctagcgacctgcataaatatatctataaatggatcgaattgaagtatagtagaggcagatgagctggcataggaaatgacaattttgtaaaaaaaaaaaaggtaaccttatctgaagaacactaaacaaaaatgatcgaatttagaacactgaagagtcaatgccacacttttaaatggaccttaatctttaagaattcattacccacaggctgtcaggcagaacatggcatcaacataaaaaaaccagtgaacataacatcaaatctttgtataagaccatgcagacttgcatacagtgtacaatttaggtacctcatgaattttctaatcagaattcatcagttcatataacaacagctccaatcagaaaaaaaaaagatatggtatagacttcagaacatcgcgcgttcacaggaaatagataaagaggatgcacttggtttttcttatggcaggatgcaattgatttggtgcaatataaaatgaatatcaaaggctcagcattgatttgataacagaaacagaaaatgacaaaacaatcagttcttagatggaagaaacttgatgaattcctatttcaatgatatcctgctcagtgcaaaagcaaattggatatttatttgccaggctccaaactgtttgaaacttagtacgttgaccagctttctatatttaaacctagcacacattaactcatccaaactaccaaagcatatatgccaggatattgcaaatttgacactcaacactatgatcagtacaagaagaattttggtttgtatttcaagtcaaataatcccggtgatattttaagtcaaataagcaaatcattttcagacaaaatagggaatagacagtgggaaaactagatcattgcataagtacaaaaactgataccagagtccaatgaagttaagcttcatcaggacaactcctgttgcatcttctatctccaaataaaagtaagtgcctgatgtacttgctttgcaaacacttgttaccatgccaaacagactaactccaaccattttatcatgaagatcacttacgtatacctaaaaattagacatgttatagaagcacacagcaatgaatatatcacgggaactttactgcatgcatgataattgataaatacttttatatggtataaaagttgcattagactaaaaacaaacatgatccacagaccacggggcaagaaagacagcatgtgtgtgtgtgtgtgtatagctactatatggcaccttaaggtgctacctattaaacggcacctgacacagtgatttagacccaccaactgcgcacacccccaccccccatcctgaacccacctatgttgacgtaatagttaaattctgactaccatccacgtgtcttttttaccgtgtgtagtcttttctgcacctatgcttcattgtacactcatcagagtggagtaaaaaaattactactgacttttacctaaggaaatagattattctacgtgttggtgaatttttaccatccatacagggactaattgtactactgcactgcaaccttttgtttgtccctgaaaatgctaatagcaaaaacgaaaaatacaaaatactgcaacataaaatgaaaactgcagttaagtaaaaatataactaaaggatattggtacctaaaaatacaattaatagaaaaaaagaaaaatacaatactgcaacattcagttaagtaaaaatttaactatagaaaatacagttaacagaaagaaaatgaaaacacagttaagtaaaaatataactgaaggatgttggtgctagtttctgataactctagtacttgatagtaattttttcactaagttgatttgatggtgtgggacccatgggaaagtgacacatggtgagaggcagttatttttttactgtggttgagaaagagaacgggaaggtcgatcgggtggtgagaacggcaaaagaggaagcgaaggcgctgaactggaggcttgaggcccgagggcgctacctattcgatggcgcgctacgcactacgtagcatgaccgtgtatatatatatatatatatatatatatatatatatatatatatatatatatatatatatatatatatttcaatgatttccctttatttcaaggaatcaagaatttcaaatgctgctataatagtagatgatcatgaaaaagatgaaaacaacaaaatgatacgggaagcatgaaacatagatacttctgaaaacatatttctaccaagtaaaacagcagaccacacatatgtttatgttactagatatattacacctgcattactaagaagcccatggaatgagagcacaagatgcacttaaacaatattaccgcaaattatatactaataaattactacacatattagtcagtaataagggatcgagtgctagttttcagatgattcattcagcacgttaagataaacacaatagtattgctttgttgataatgaagatctgaacaatataactcgatgcagattaaaccatgaatagaatcagtcgttatatgctaaaccaataaaccttcagttcccaagcaagtaagcaacataataattggtacgtttatctgtaaaaataaactcagaaaaatgaagttcaggttacttactcgaaatggatatttgctgaaatcaactgaaccatgcaaatcacgtggtaatgttacttgtgaagccatatgatcacttggaacacatgacaatcgagacccttgactccttatttgagtaggtgtaagaagtacctagcacacaatcatttccatcttggtcaaaaggagtagtgcaaaaagatgtagcaccaagatattcataccaacctgttcctcctgctgagcaataggcaccaaataaacctgtgtagcactgccatattcaaggcaaagttcctgagactcctcatgattattgtgcacataatttgcaataaaaggtctgtgcagtgcaagcatgctccctacgctaaaatagaaagtttagtttacaataacttgaatgagacatttggtacttatattgagtggaataaacctgaaaagatttgcaagcaaaacctgctccccccataaaacaaattttatttttgcatcatcattgtcaacaagtacaatctgctttctttctgtagatccaaatggttctaaagactcgatcttttcgatcctacagggcaaagaaatagcagtgttacaaatcgttcaaggtcaagtgatttggttcattctattcaacttatattctcaactggatagataagctcttcttcttctttttaccagaaatcatagtgttggtaactgaatgtgttgtgctaatatagccacagcagtacacatagggtgtgttcagagggcatttttgcagcagcagctgcggcggcagaagttcaaaattgctgcggcttgaagagactatgtacagcagcagctgcagcagcgatagctgccgaacagggcgaatgtaaaaaatgtcaccattaaaaactaaaaagtacaatatatctaatatacctggcataaaacgaataggaaatattgtttctgttctcatctagcatcatagatgagaaagaatacatgcaaaactgtgcggcaagtaacatggcatcttcatcttcctcctgtataaattaaacatgagtcgaaactaaatagtgtgtgatatagtacgagaaaaaaaattgaaccagttgcatctagcactccacagcacaaatgcaaaattttaacttctactagcagcttaatactagtattgaatccttataagaagcaagaagttagcagctagtttactgagggctgagtaaagaacaatgaaattgtttagtgtttagaagatatttttgtaatctattatcactgtgaacgatgaagaaccatgagggatgaaagtgaattaaaagaaaaaagaaaattgacccaagaaatgacaagctgaaaacaaaaaacatgttgtgaactccacttccttataaacctaaatgtgtttcttaggtacctcatcaagtaacatcaccatatattctgttggcaaaatacgagcatggcctgatccctccatagctgtacgtaggcaacatcccgtgagcataacttctcgacccttcttcaagacatcatgctgtccaatgtagttgtagtacctaacatgaaaatttagagtcagtccagtaacaattttaccttcattcactgatggatttctaatgcattattaagtagcattatctaagcaataaatagtcatactcagatctaccttcggtgtagatatagatcgatagtcgatgtgctccacatgtctcccaaggtaagcatgtatatgtttgtacctacaagacagtttaggaggtaatcgaagaaaatgcaagttagcagccatatataaagtgcaagttcaagcgattaattttatcagtacatttattcaaggatcatgttggaaaaaatgataatccaatgatcaaggatattcataagatttaacttgtgcccttgttgaggaaaaatgacatagagaactaataggcattctgtttactactaaacatccctgcagaggacaaatattctgatacaatataaaaatagcttgtaacaccactcataatcttaatgaaatttggctggcccaggctaaaaaatataaaaatagctaacagatatagtttctttgtttgatagaagcaaagtataagcataccaggaatgacaaacacatcaatgacaacagcttcaaggacactcttaggagataggaagttcttctcatggatagaatcgattgtgatggtattaggaagccgccttcttctatttcttgtttttagaagattggtcaattcaactttcctctttgcggtcagagacttgctttgttctgtccaagactagcaaaagcagaaaatatttaaaggctaatccacatgtccaatgcgaaaagaaatggtgaaaaaaaatgcaatcatggatttgaaatgggtttgcatttgttagtctgtacacaagcaagaagcatggattgccaaattgtgttatccttggaaaaataatataagccacttgcttgagcggtgccagaatctatggggggtgattagtgaataattgcttatgtatgcccttttctgtttcgatatagagatcacattggttcgacattcttcgatatatccggaatcgcattcagaacaaatttgattctaacaacgagcacaaggcacaaatagaaactgtaacagcttggagaaagagttgcatcctcgagatgtagtttgaattcaagtaaaaatgtctaacctggaagaggtcggagagcaggatggcggcggtgacgccgctggaataagcgcagcacgacttgagcacttgcgccaccgcccacccccacggcggccgcgcaggcgctggcccggcgccgggggactcgtcgccgtttcccccggaggaggaggaggagagcatggagatggcgtagtcgacgaactcgaggaacgcgcccccatcggcggaggcggcggcagaatccatggaaccctagacaggaggaaggcgggggagacggcgaaggcgaaggagacgggcgcgaaaaagaaaaaaaaaaacgagatggagaggagagtgaaggaaggagcgcgggaaaagagagatcacggatacgcgcgcggaagatactgctgctattttacagcgagtttttgggtcttgcaacgttggacaccgaaatcaacgtcttaaaaacaaaaacaaaacaagaacagaaagtacgaaataattcggagcagtttcttataaccgtgtaatattcacaagcacaaaacttaattctctctctcagtattttttaagctaggttttcctacctacaaaaacccatggtccgtaattacaatcattttgtttttgtttgagataaatataaaattttaaaccatttcaattcaggtcctgtttggcacagttctagatctcaaatccgcagtaaatttgaagtttctatattgaattatagtggctcaaaactttaaatttcatacaaaatgagaataaaatgatttatcctaatgttatcaatgtaatctatggatttgtggagcaagaaaaaaatcttggatccagaactgtgtcaaaaaaggcctcaatttacggactccaaatccagtgtgaatctgctaaacagagccaacccatctatgcctcctcttgtttcaagttatccaagtctcaacttaaaaaattcaagccgaagaggactgaaactaaggcagtcacctatgcatatgattatgagtgaaatgcaccactaataccacaacctgtaaggtgggtgcaatttagtcatccatcttataaaatgctcaaacaagtcactcatcatgttttaggggtgcaaataatataaaacatgcgtcttgtgggttgttcgcaatgaaattatgtgctatgttaatttattttgtaaacatggtcacacgattcataaataagccaacatgcaatactaccaatagtaaaatccaattaaaaataaattttgttattgactgccaagcacaatatggtcgtgtatatacatgaaaaatatgagcgttaatttgtaattttaacgcttgccctgcccacatggctaaaaaatgcatgatgttaggacaatacgatctccaatttgaaaacaaataatccatgtgacaatgtatttggtaagatttacaccattgaaacaagatgagtgacttaattgagcaatttgctagatgagtgactaaactgcactcacctcgcaagttgtgataccaacggtatattttactctatgattattatcaagtagtacaaataatcactaaactaatgatcccagaaactgtccagtggataatcaagtagagatcagcagttttgtatgctgcagaatgtggtgtcgatatccgctcagaaaaaagaaaaagcaaatgtggtgtggatagacaaaccttttttcctcaatacaaaagaaactagcttatgtaaacgagaacaaatgaatcaattaaaaaatacatgataatccttaataaagctccctcaactctaggcaaagttccagcttcaggaatatgcacatttatccgattcgtttgaggggaaaactgacaatttagaaggtagtcagttttatgtgcaaaagccaaagggaaaaaagaaaaaaaaactgctgcaggaggttgtgggctgttcacaatggtatggttgatgaaaccatcagagtagcgattgttgcccacagaaactgatcattcatggtaggattagctcataatcaatgatctaaagcacatctgatggatagagattgcccttgtgaatgacctttagctaattggtcataatttatgaataagacgatgacagtgatatcgtcatggaaatgcctgcgaaccttcttgtcaatcttcataaggtctgaataacgcatctcacgtttccgtgctgcttcatggagagctgcctttatgagccttcttgcacttccctaaatttaaaaaagtgttaccatcaaatagaataaattattatcctattttaagtcgttaggcaacaaccatgaaaataattaccatgctagtaggttgaagcgcatactgaaccaaattttctacagttattactagtacaagaaaaccagtgtatcaaattgtcaacagcaccaattatcttaatactagctaggttagggcatagcaggaaatgcaagcatgtgaatcatcaggagcaaccatatagaaaacaaatatatagccaggaagacaagtaatagactgcagtcattacactgcagcaagtaatatgtccccagtacttatcagaaaactggagctccttacatataagcagtaacaattcattattggtatggacctacaataaccctgtccagtatacatcatcagacaatggttatcatgaccagactgttcctgccagcagcccagcactacaggagagcaatgatccattgagaatggtatttttggcccattgctgatacagtcacaagtcacgacacatgattaaataaatggaaaagatcacagtaataggatgatcctattcctaactgcaaagcattcaaggaaacagccggcgatgtcaatatttttttccagcttgcaggttgtaacccagtggataactgtggacactggacatggattgcatgatagtaaatacttgcatccaaagccgcacccatcaccaaacaaaataactgaaaatttcacggcgcatggcaactagattttatgcagactatgctcatttagttaatcaccaatcaagtatatcagcttaatactttctgaatttgttgttttagaggatacacatagcacccaataagtgtctagtctaaatattgcaatgcttggacaatgctacccaaaatactaatgtctagatgcaaaacagaacttgaattatactgtcaccctgtggaacaaaactagcaatacagaggttcaagatctgaaactttaatgcatacatttgattgtaaatattatagcaaaatacatcaaggcattatttccaggtgaaataaggttccaaggttcaccgttcatgtcctgaagccttaacaaaaaattcagtgggaaaaactccggtcataaaatattgcaaattgtttaagatcacttgggccttgctcgtttaatcctcaagaggagggaattggagagtattgaggggcaataattccacaccacaatatgtgtggaataaattccctccaaatccccctcaatccccttgtgagagggattaactgaacaagcccttaggcaacagcagagaccagaatgtgaagcagtagataaacaagttaaatgtgcagaatcttacagctcgttgatggttgtgcacaatctcaacagcctgctgattactcaggtgttcccacaaaccatcggaggcaaatatgatgaagcaatcacttggttgaaggcaacgtgcgatgatagatgggttggcactcaatataggcctgctgaatggttcagggagcctgaactttggtttgatctgttccgtgttatactgactatgctttagatatgcatcgcctaatgatctggacacctgcattgcccaatacatttactgagaagtgaaaaatatatatattacagatacaatatcctgtttcagcaacaggaaactgaacaatgcgataaaaaccaacctgtatgatgcccttgactctccaaaccccatgtttaagagcaacaatctgaggatcatctgggtgctgagccatgagctcctgcctgacatcctcttcattggcgttatgctcactggacagttgctcggcggtaatctgaccagcgcgaccaaccttcttcccaagaacggccctggaatccccgaggttggcgacgaagagcgtcctctggtgcacgactccgacgaggcagcacgtcccgacggtggccatgtccggctgcgcctcccacatccgcgagacgaccgcgaggaagccttcctccgtggccaggaacgcgtccctgatggcgtcggccgtgacgccctccggcccggacgcggcctctgcacggatcaaccctaagtcgcgcgtttccggcggggcggcggcgggtaggaagggcgagggggggcggtgctcacctcggaggttggggaggaggtggtcgcaggcgaagcgggcggcgtcggggccggcgtggccgtcgaagacgccgatgcaggtggcggcgaggggcggcgggcccgactcgacgcggcactggtcctcgagcacgtggttcccctgcacgacggcgacggacagctccccggcgtggcaccgcgcgaggtcccgccaccacagcaggccatccctgccctcagcagcggcctggtccgccgcggccgccgccgacgaagacgacgacgaccgcgcgggcggcgccggtgacgtgggccagaccccgccgcacgcggagagcatcctaaggagcgcg

SEQ ID NO: 74861 - DNA, 9467 bp, Oryza sativa
gtgtggttgctccacgtaaaacacagtgttatacacggtatccgtcgcgttactgcacagttttgtgagacgagagctaagaagaggtgggtggtgaggggagttaataggtgggtgtgtctgagctttgatagacgggagggggctttgaccagtgtgtgtctgaggtgggaggtggtttttgggccttaaaaaagagggggaggtgggtgtggcccttcagagagagggggtatagaatagttattctatatatacaatagtcttacgctatatatatttcgcgcatatatatatatggaatacatatatatatatatatatatatatatatatatatatatatatatatatatatatatatatatatatatatatatatatatatatatatgcatatgcatatgtataaatacatatattacacatgtataatttaaagcacttaacattttatgtgcatatatattaccaaaatatatatttacactaaagtaaatgtgtacatctataaacatatacatgcatgtatagacaattcatttgctcactagctagctacgactttgacgccggcattatgtcaaaagaagaaggaccgacgttatgaattgtcgatccgttgtagtagaattcaccctcgggattaaggacttcttcgttgatgaatctcatcagttgttcttgaacagccgtgatataatccttgtgtgggagattgtccctcatgtgaatacactatcattcgaaaaataatgacatatgaatatatgaaattaataaacagcaaatcgatacgcaatgaaattttgaatggtttatatatacgtataccgagctctcgtgtggtgtagatttgggttgataggaagtgggcatactcgcatacgtagtagccgcacaggttagttcccaggtcatgctttgcacactatatgagaaaggacaagagatttaatatacacttatattaactgtaactagtaatcatatataattagcatatgcatgatttaaaattgttaaaaattctaattatcatatgtaaataccacatgcatgatttaaaattgttaaaaattctaataatcatatataactagcatatgcaaaatttaaaattgttaaaaattctaataatcatatgtaaataccacatgcatgatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataactagcatatacatgatttaaaattttaaaaattctaataatcatacataattaacatatgccgtacaacaattgatttatatggatattcaatacatccaaaatattttacattgtgtacacaacaattacggcaatacatcggcggtgacggttgaccgcacgtacttcctcctcactattgttccttccttgtgttcgctacgtgagtaaagggtgtcttcgtttgataggaggatgctagggtcaaccgtcaccgtgaaagggggttgcccatcaaactgatcataatcctcgtcagtcttgtcctcaactccgatgatttttcttttgctagggagaaccacgtggcacttcggctcatcaggccctttgcccttctttcctttgctagacatgtccttcacataaaaaacttgcattacatcattggcaaggacaaaaggttcgtccgagtatcgaaccttgttaaggtcaaccgttgtcatcccactgtcatcaatcgttacgcctccaccaatcaacctaactcattggcaccggaacagaggaaccttgagaggtccatagacaagttcccatatgtcctcgatagcaccgtaatacgtgcaagttgtaccatcgtgtcccatggcatcgatacgagcagcactgttctggttcgtgctctttatgttttggtctctcgtgtagaatgtgtacccattgatctcatatccttggaatgtcgctatcgagccagatggtcccctcgccaggtaggcaagttgttggctaatcgtctcgttacccatgagatgttgtcgcagccacacgggcaatttatcaatgtgatgccgtgtaatccatgcatcggacttaccgatgtttctggcgggaactagagccaagtgctcctcgatgtaaggagccaccaatgaagattattgcagaaccgtgaaatgggctttacggaataaattgttgtataccgtcattactgcgttccttctgagagtcccctttccccgtagtttcccttcatggcgtgattcaggcaccccgattgggcgaaggtcttcgataaattctacgcagagttcaatgacctcctctgttccataccccttggcgatgcttgcctctagacgagcacggttacgaacatacttcttcaaaacgctcatgtacctctcgaaaggaaacatgttgtgtagttacacaggcccgagaataccgatctttttgacaaggtgacaaagcagatgcgtcattatattgaaaaatgaaggtggaaatatcaactcaaagctgacaagacattgcaccacatcattttgaagggcttccaatctatccggatcgatgaccttctgcgaaattgcgttcatgaaagcacattgctttgttattgttgcccggacattgtctggaaggataccctgaattataactggtagcagttgtgtcatccacacgtgtgacagtcatgagactttaggtttgtgaacttcttctccttcgtgtttattattcgctttatattcgtggaggacgtacaagaattctgaatagggtaactcccaaaatatagagttctttttccacatcaccacgtgaccatgttcgctatcaataggctggctgctaggcccctttccaaacactactttaagagctttcaccatagcaaacactattttctcactgcgatgtttaggcttcgtacggtggtccgccttatgttcaaagtgcttgcctttcttccgtacagggtggtttgcagcaaggaatcgacgatgacccatgtacacaaccttcctacagtgcttaagatatgtactttctgtttcatccatacagtgagtgcaagtcttgtaccccttgttagactgcccggataggttgctaattgtaggccagtcgttgatggttacgaatagcagcgctagtaggttaaactcctcctgtttgtcctcgtcccacacggggacaccttatttcttccacaacagtttcagatcttcgaccagtggtcttaggtacacatcgatgtcattatcaagtggcttggggccttgaataataatcggcatcattctgtacttcctcttcatgcattgccaaaattttggcaggatttcttatgtattaaccagatttggcaacaactaaacgtagatattttttggtaactttggcaaaaaatgatatggttgaaaatggcatcaaagtgaacaggccctaattaacttgttgacagctactccctccattccaaaatataaagtataaccacccttaactcaaagaccaagaaaaaattattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaatagagggagtagtacctaattaagcatgtgtgttaatttattattaactagtaatctgcccgtgctaacgctacggcgacattcagaaatacaaattaagatcgatgaatatagttattatgttgttaattaaattgccacatgcataaaataacatagttattatcctggttcaaatggagtcattagtgacaacaaaccatggtaaaagcaaaagtaattaaactttggaacttggcaccttgaagcatcaaatccttgtctaccttgttgtctccctgtcacccccctcttaattctaaattaaatgaatgagagaaagagattaatatagtttagtgtgatagtgccaacagatggaaaatttagagcttctagttctctccttctacatctctcttaaatgtgggaccaagtccttatggggcccactcatcatacaaccatagccaacacatcatctgctcttctctcatttaaatcttcttttatttttcaaaaggtgagagaaaggtttaaattgaatttccacccaaaatgccactctaccactccaagccttctaggaaacatctatatatgggcctatttgtcgtccaaatacctgcaaacaaccttggtgaatcatctcattatcctaaattatattttcaaagagagaaagaaagagagagagggagctaaagtccaatttacacccaaacttcaccatacctctcatcttctcataggaaacatctacatggggccaatagatagccactcatacttggttgagtgaagtacaagtgggatcacagcctcaaaccactgccaactcctttaattcgtctctacccctcatgttgacaactagctctcactttccacctacttttaccattcactactacaagcaagatttttgtaacgatttttgcgagcgggtaggcggcctgcacgcacctaggggtctgggaaaataatgatttttgcgtgcgggtggcgcacccccacgggaaaacaaaaattcgaaataacatatttttttaaaaaaacgaaaccctagaatccggcggtgggcttccgcccgacggccatagtgccacctgcctcccgccggcctccccgccacccgccatcggatccaagctcccctccggccacaacgccgccgtcgcccctcccctccgccggatctagggagggaaggaaggggagaggaggggagctggatcccacgtggggagaaggaggctggctgccggatccgtgcggggacggctgccaccgcaggattcttgcgttgacggccacagccgctggatccgtgtagggactaccgccgcccgccgaatccacgccctccaccgccgccacatggaggaggccggcgcgctcctactcccaccgccaccgcgccgctgctgtcgccgcgcgccgccgccgctgccaccgtcgggaggagaggagaggagagtggagagaggagaggagaggcgtgagagagaaaggactgagaggagaagctctgcgtggaaattttaaagtggaaaaagggatagaggggaggggagaggagagaaagaggggaaattttaaagtgggttagagaggaaagagggagttagtattttttgcatgcggctctcttaataggtccgcacgggaaaatcggcttattttcgcgtgctgtccatttaagaggaccgcacggaaaaatcgatttttcccagaagaaatgagttaccgcacggaaaaattgatttttccgtgccgtcctctttaatggaccgcacgcgaaaatgagctggttttcccagaagcaacgagataccgcccgcacggaatctaaaaggtccctgtccaggaaaatcgtttctgtagtagtgattcatgaagttccttctctgcttgatcgatccattttctttgtttcttttttggcatagatcgaacacttgctggtgcgctcgtcggtgttcccggtgtccagagtgccaccatcgccccactttgccattccagtcgactcgaatcatctccagctgtaccattgcgccactgacgtcgccttggtcccaggagaacgacgcccacatatgatcaagccaatacgccgccacgaacgctgtcggtcgccgttgctctcctgctgcctctgcttctcttgccgccgagtcaccgacatgtgggcccggctgtttagccacttcattaggtgctaaggactttaattagttgaaattgaaatcttgtaaggttctttttgtaaaattgctttgtttgccatgtgggcttatggacctaaaagcaattcccctaatgcccggggacctttttgtatagggtttagggcttaccctaaaacatgaaattactatttcatgcattcattatgtcgcgaccgagaaaattaccttttcccgaacgctagtgtattaatccccgtcccaggaaaagccggggtacaccaaacaaacatgatacaaaaggcacatctttattatgtcgataatatttacattattacaaaggcacttgaggcctgacaaacaaaaataaacagcagcggactagcgggcctacggctccatcttcacaggcgctcaactggggtataagccaggactccacctaagacttcttctccaaagcttctcctactgaaggggggaaagatagagcaagaatgagtataaccaccgtactcagcaagtcacaccgggagatgcatgattaatgcaagggagtacaaggagataataataggggtttagttttgtagtaaatagcatttaaaagtcatttagttgcccaaagctattttataaagatgatcctagagctacacagtattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaactttggtacattgctaggcttgcccataatcgagggcgcggctattcgaataggttttactctgatcagaggtgtacatctttacccacaagacacgtcttcctcacgtgcaaccacgtgccacatgccaccacggcatatggacggaagacatgacatagtttccaacccatcctagccatagacaagagtaccgacccaaccccacctacggccggaacctccgggacaggtcggtaggactgagcccctagcagcagggcaccaaccctgtgccatgacatctcgactaccgggccacagctcgtgtagccttcatttgtcctagagatgtccatcgagccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccagaaaacaggttttaggggttttgaaagaggaagagaggggtatgtccaattccaccataagccaaccattccatagtatccaagagatatgaatattcacaaagtctaaagttataaaaaccacctaatgttgtcctattaatcagcgaagcatctacctaaattcatactagtggaaccatgaatagagtacccactagttggggttttgtttattctagggtgaaataggtaataataacaatagcaataataatgtcttaacaaaggtaaatataaatggctaaataaaacagtgataaagcggtaatgcattaatttaaatcaaaataattttataaactgggattcaatatgctcaaggatgatgtgacttgccttgctcagagagaacggccttccgaaccttcggcgacacccgcgaaccacgcttctggaacctccggaacgatagaagctacgcgaagcacacaagcaaagctacaagcctataaagaagaaataacaatacataaaaagaaagcacacggttctttaggttataacaaacattaggagacttgaacgggtcgatttagagttcgtatgaccaagacatggtcatccgaagtttaatgctgttacatggagatttacggattattataattaggctttgcaactataaaacatgtggaagcgctagcctggaaaagacaggaaggctgcgctgttgacatgcggaccccacatgtcaacctaagggaccacagtagaccgagtacacagagacggtccacgggtcgacggaagcggaccccgtgtgccaaccgaggcgagtggccgacaaacggactccactagacaccacgcgggctgcacacgtggaaaccacgcggctaccgagcgggcacacaaacacggtcaccacacgcacccacgaacgattaccgacaccggtacacaggcaccggggtcgacaaccgcacaacgggcacgggcgacaccgaaaggacgaggacggggcagcgaaaggagagagatccttaccaccacgcgacgaggcgtgggaacgacaacgacaaacgggcgcggcggagacagctcggggacgacggaggcgaacggcgagggaacgacttcggcagcgatccttggacgaaggcgagacgcggccggcacaaggcttgacgacgcggagccgaggacgaagacgatgacggggctgctgcacacttgacgaaacgcgggcggcgaacgcgatcggcttgacggagggacgaacgccacgacgaggaggaaggaggaagacgacgaccgacggggaggcgatgagggcagccggcagcagctgcacggaggtgaggacggcgtgggacacgccgcagcgatgcccacgatggtggcagcgcagccagacgacaagccgggcgatcgacgggacgtcgacgacgagaacgaacggagacgacgacgatggaccgaggaggggtttggacaaaggggaggcgaggccgagggcgaccttgccgttgcgatgccggacgtggttgtggcgcagcaagccgacgagccggggaggaggaaggggcggccaaagggacgccggcgacgaagaggatggaaaggccggcgcgggcgacggcggtctccagacgaatcaaagagcaggccggggtggaggtcgacgcggcgacgccgaaggaggagacggcgcggccggcccgcacctgagcggcgcggcaggggcggctggaggtggtacagtggcggcaacggcactggacgacggcgggaacgcgcctccggtggtcaccgcgcgaaacggagggcaggccggtggagaggaggcggctgcgacgctggaggaggcgacggcacggccggacggcgctcgggcgaggagggagaggcggctggaggcggccggcgcgggggaaagagaagggcgacggcggggaggggtgatacgaccacggggaggctcgggatgaggctaaaacgatagaacggaggatggggattccattttataggagaggagagggagccggccacgggggaggtcggaacggaggcgggaatggcgaccggcggccatggaaagcggccggggtagacgcgtccgttcccgacgattgagggcg

SEQ ID NO: 74862 - DNA, 69964 bp, Oryza sativa
  unsure (1)..(69964): unsure at all n locations
gtgtgcgatgcgagtcgagtgcgacgcggaggtcgcaatcggtgtacgagaagggggaaaaaaatagaaaaaaaggaaaaggtgaggtctcgggtcgggttcggtgcgacgcggtgtttgtgcgcgcctgcctgctgctgactcctccgctccgctcttgagggaattggacggccgtcgtttttcttttttttttccttttttttttgtcgatgagtagtgtaaagtattgggagtggcctccacccgtatatgatacgatgatggcggggtcagcgtattgtacgtcgttgtacctatgcgctcacctgtctcttctgcagctcattaacaaattgtgatcttatttttattttagcattggcttctgtcgacatctggaatttattttagatattaggtccatcttttttctactcttgaataggatagtatgctgacagagttttagttcgtccccttctagatacaaaatcggaattcttatcattcaaagataagaaacagaaaaggtgatgcatatcgtttatctgatgaacttacgcacgttcctataaaaaaacaaattgtatgcataaaaatacaattagtattgcttgatatctttatttatttagtgagtgaattacactttaggcatgtcgaaattttactttagactacctttatatcatttttttctttttgtcagtttttagttgtttagccttcctcgcagcaaaaatatttgccttcgcatagatggagaagttcggcagtatgccgaagccaatatgcttacaatcattgatgtgcagtgaaaaaatgttcgcggtagcaataacaaaaatatctgatccaaagaaaaatattggtaaaatggtggtccaaaataaaatgttaccagcaaaagatgacctacattccaattcactcttacttatttaaacttttattatggattattgttgcatgcttacactagggtgaatttgagagaagaggaaaatagaaatttgagaagatatgcaagacgaaatagagtataaactattttaaacttaaaaaatggattaatatgattttttaagcaactttcgtatataaattttttttaaaaaatacacggtttagtagttcgagaagcgtgcgcgcagaaaataagacaaactttctcacaatctacttgggccgtacgctgctaagataatttgtgattgatgtcatagtagtagagaaaaccattaacatatgtcgcatgtgcactgaaattaatattaggtgcaagtaattccattctcgacatgaacaaactgtaatatataaagtgttatgttgatcgttgttgatgtttaaccatgctttgctatgacactaatcattttattccactaaaatttcatttcaattttcaaattattatatctaatcgacatgctatttagcctccttcaaaattcacagattacaaaatttgtattaagttcaattccatctgaaaatacaaagacccttcacgccctcgcacgaatctcaaagccgaagaagggtaacataccaacccacacactgccccgccgttcccagatcttctcctccgttggattgcgcacggcagaagggaatttctagggtttaggcagcgagcgtggtgggagcgatggctgcggcgggcgacgagtcggcggctgccgctgcggctgcggcggcggcggcgggcggtgccgccgcgggggaggcggcggttgactccaaggacctgcagcagcagagcaaggcgctggacaagctcaccgaccgcgtcgaggaccgccagctcgattcctcccgcgtccaatccgtacgtttggttcatctccaacctcaatcccttctagattactcatattagcggcctcatcagcgtggaacatgtatagattgattgtcaatccgttcagtggcaagcaacggagtgaagagcagagctggataatttagatgtttggtagactcatgatggttcactaatgtctattggtagactcacctcgtaatagccttgcctagaggaatttcgtgcattttattttttaggtccttgtatttcagttgtcacctaagtattgatccaataattacacatttcacgtgcatctttaacctgagtaagaacagtgtggcattttcagtacaaaagcctctaatcccgtgtcattgctattgtcttcatgcacctactacaagcactgccatcatcacaagacgccaaactgtagcctgtagagcgatgagcttaagacttcaaattctgtttgtgtagaaaagatcctgtaatttgtccatccctgttacagggtatgttctgcacataaaaatcaagacacacggcagatgatcttgaggccagaatgatgaaatcctttttgcacggtggtgtgtgtgagcctgatttttttttcaagttcttggtgggtgataatgttagatagattaatgggtattttgcaggacaaatcaggctgatttgtttttttcatggtttttagctataatttagtcatgcttggcttaaacatgagcttattttgaatctgactattttattggaatgccaataattttccagatataaaggtcctcataaatttctaattatggtatcagtaatccgtgtttagcccttgacacatgatctgcttacaaatatttaagggattatgttgacaccaacttgccaattaagaaaggtgtttgtgcttaatcgtctctttcttttgcaggctatggcagctcttgcttcttccaaagaagctgattggaatgccatgagattgaggtcagtgtacaaaacacccattatttctccattctgacgattaatacattccctaggaattacctattcctctaagcaggttttatggtgattgcagtttttttcctgagtagatgatgttaggttgccctttattatggtgaaaatatactattaagacttaatgtaagctaaacgactagaaactgtgtgtggaggaaagcaaacatgaagtttaatttgaacagtagctttgcttgccaaaaattttagcttcatctaaaagcgttatgataaagccctggggaaggaaaaccagacgacttgcaccagttgcagtcttgatacctcaatggggtagtcttttaacctgatgaaagaacaagcaaacgaaaaaaagaatcccaaacagtataagcgcaacaagaaggaacaactcatgcatgttctaagtggatatctcccttttatttcttgcaaatcttttgatttagcctgattctgcatgatagtatgatgctatttcttcaagttatataaaccctcttgtgaaatgaaggcgatgcccttgaataggtttgtgagctttctcatcattggataaatgggctgaccctggtttactgaaaacatagtttgcatgtcgtatacggtatattgttattagttacatgtgggaatgtctttgctcttcaccagggaaaaagaattagctgccatcaagatcaaccctgctgatgttgaaattatcgctaacgagcttgaggtgaccaccttaaatcctcatcagatgattgttttataatgttttcaaatcctgttctaatatatatttgaacacacagttggacaagaagattgcagagagaacactacgggagcacaaaggcgatgctgtagctgcagtccggttcttgcttcgctgattcttacacattttgcaagatctatacaccatatgaagcagctgtagtttgctattgcttgctgctgagaggaatttctgtatccacaatgaaacgatcatatttggcatctatgtagaactttttttccatgatgttgcaaactggtctctgttgtcttcttgtaaaacttggttcactcaggagtttattgccgtttatccaaggtctttctataccttctcaagatgttctgattttttttggatatcctaagctctggttctgaatgactggaatgaccatagagcaaaagaatagctgatagattatccaagatgaagagaagatgacatttaattgtttcgtacttgtatgcttttattacaacaaaggtgaagtgccttcaaaggtaagaaacattcatctgtaccacatgccaaattgtatccatttgattgccctgcatcattggcacctgcctgtttgctaccacattgttgtgtactgacagcttcttgagtttggggctgcaactttgcaattcaatttctggaagactgtctgaaacgaagcattgagatatccaattctctatactctttgtattgcctagttgtcttctgtggaaatttgtgagttaactcatactcccttcgtttcgaaatgtttgacgccgttgactttttaatacatgtttgaccattcgtcttattcaaaaaatttaagtaattattaattatttttctatcatttgattcattgttaaatatatttttatgtaggcatataattttacatatttcacaaaagtttttgaataaaacgaacggtcaaacatgtgctaaaaagtcaacggtgtcaaatatttcgaaatggagggagtatataagtttagagagctgtttacgctcatctcggagagatcacctgatcaacaaatacttacgttgctctgacagttcaattttatcaagatgaccttaactcgaatttctgattaagattctttcctgacatgcgggcccaactcatggaccccttggcccttgtgcagcgagaccttcaccggccgtacgtggagggggataactccacgggagcatccacgtggcacgaggcttctgcctcccctgaccaaaaacacgtcgctttatacacgcgtcgccctcctattggccacgctcccgtatcccagtgcactattggacagcggccgtgggccatgccatcccacgtgtacacgcgcggctcgtcactccccgtgggccaggtttgtcagtgaaacatcctcccgtgcgggtaaccacaccgctccgccctttattaagcgcggtgcatttcgcgctcgctacccatctcattttctcaggtggttttctggttcagtggagaaaaaaaaaggttagaattagacttctttggaaggttctagaggtttctagataccgccgtcccggggggtgatggcgatccccagaaggtcggcggccgccgtcgctgccgtggtggcgctcgcgtccgtggccgctgtcgccggcgaggtcttcttccaggagaagttcgacggtgagtcgccggatctaacaacctgtgtcgtcgtgtaatgtggatccagtagactggtaatgcgtttgaatttttttcgttggttcgttggatgatgacgttgatctggtcagtttcttagcctgttcatgatgcatgatcccgttgtttccgtggaattcatcagtggcatttgcgacgaagcgagtctgaggaattctggagttcatgtgccatctcgtaaccgttactgttttggcctcgcgatccacagctttaggatgttcccgtttgcggtttcaaaaaaaagatgttcccgtttgcgtggcgcaccgtttttgcttcgcatgaatggatccatttagttttttttttttaacggaaggatccatttagtttcagtagtctcagtagcgatcgcgtgctttctacgcgttcatttctcagatctccggagaattcgaagggaaaataggatttcctttcgtgaaaaattaaggccggggttcagggtttattacttgattttttgagagattatttttttcctcttttccctgatcctgttggtggatatgtagaatattaaaattggttggtttctgaattctgaattgtgtgtgaaaacagatggatgggaggatcggtgggtcaaatctgagtggaagaaggatgacaacagggccggcgaatggaaccacacctccggcaagtggtacggcgacgccgacgacaagggtgaggatcgatgcacacaccacgctgctgatttcgttttttcttctttttttttttctgttcaggcatgtgcgaagttactctgcttctctgtgcaggtatccagacgtcagaggactacagattctacgccatttcggccaagtaccctgagttcagcagcaaggacaagaccctcgtgctgcagttctcggtgaagcacgagcagaagctcgactgcggcggcggctacgtgaaattgctcggtggcgacgttgaccagaagaagtttggtggcgagacgccgtacaggtgatggtttaatttgatcacttcgcattcccctctgtgtgctcatttcagagcgcaacatctttgattgatcagtttcttttgaaattgcagcatcatgtttggaccagatatctgcgggtatgccaccaagaaggttcacgctatccttacaaagaacggcaagaaccatctaatcaagaaggacgtgccatgcaagaccgatcaactgacgcacgtctacaccttgatcatccgtcctgacgccaaatacagcattctgatcgataacactgagaagcaaactggaagcatctatgatgattggaacattattcctccaaagaataagagggatcctgaagccaagaaggtaacttagagataattcactggttgttctgacttctgaataggctgtctatgctcttctatttttacagaggtcataacttatatggtaatatgttactgtttgcagccagaagactgggacgacaatgaatacattcctgatcctgaggacaagaagcctgaggttgctttcctttgtttgtgcaactttagatgatatttctgtctgaagattaattgagtttttactaataccactctactgagattctgcatgaaaatgggtggcaatactgcactgtatgttgtgagcttgctgctactcagatagcagcagagtacattgcactacccattttattttgagtaaatctaaccacactaccacagcacagcattataaatttctaaactgaactatatatactgttattttcccttgatgcttctctctgatggtttcttttacttatgaataattgtcgtttgaagggctatgatgatatccctaaggaaattactgacccagaagcaactaaggtatgtgttgccatttttattttaaatggacattttccattcttctcatacaagttcgatgagatgcatcaaccagtatgcgatttcacatcattttgtccaacatgcaacttcacattatgcaatctgtacagcctgaggactgggatgatgaggaagatggagaatggacagctccaaccattccaaaccctgagtacaagggaccatggaaccaaaaggtatgagtgtgactgaatagttcatttactctagacaagctaggttcagcatcacgattactcactaattgcatgaaattttgtgtgtttagaaacttaagaaccctaattacaagggcaaatggaaggcaccattgatccccaacccaggtatacaccaaacatattttttctagaaagaaacaaggtaatccagcgatttgtatatgcttttatcgctcatgtgaattcctttcttgtttgtgcagattacaaggatgatccttacatctacgcttttgatagtttgaaccacattggcattgagctgtggcaggttagtgctgaattccatgaaactgaaattaatttctgtagttctgttgaaacattaataattcaatgtattggtaacaggttaagtcgggaactttgtttgacaacattcttatcactgatgaccctgagtatgccaagaaatttgcagaagaaacctgggccaagcataaagatgtgtgttgtcttatctttggtgcacattactgttttattttgtttcagtttctagttgtgaagaattaaatcgtgatttgtctgtgtaggctgagaaagccgcctttgatgaagctgagaagaagaggcttgaggaggtaggcaggaaattttctttttctgagccatatcttgctgttgcttcttgtttgaactatagatgcagaaaataacctgtaatacatgacagaactaacaaaagcatttttcagctctaacttttaattgttccttcttgctaggaatctgcaaactctaaaatcgacgacagcgacgacgacgctagtgtaagctccagaccgcgctagatacagtatacactaaccttgtgctaaacaccatgccataatttgtatgtcaggatgatgaggatgaggcggacgatgacaaggctgatgtcgttgctgagcagaccaaggacaagggtgatgagaaaccgcaggacatcaaggtctctgctgatgagaagccaaagagcagcaaggatgattcttccgctgcgaagaaggacgagctttagatattttattattattagatgataatatgtcatgacgaagaggcaactgaatcaggtgttggtgctaaatatttcctaagcaggggatcagagaagaggagcagagaagcttgtgctagttttaactggtttctttacttgcttgcttgagggctgaacagtacacttgcttgtacgttgggcagcacaccatcatcagtctatacacatgcactggctttctatttataggcttgataaaccgatatgtaagaagcttcaggacctagctagagacttgtagtactactacattgtcaaacttcactggtactagtactactgtaaaatcacatcatgcatgtctacacactacactgttctagaaaatttatagagcaaggacttcaaccttgactttagtttcacgagtagtagagagggttagagagtaggctggtatgttctagaaataaattaactccaacaaactcccccttaatttatttcttgcaaactccgatgagctctctgtcgcggacaaatttttctttggataaagccttggtaaatatatctgccaactgctcatcagttcggcaaaattccaatttaacttcctggcgatcaactgcttcccggatataatgatacttgatagcaatatgtttcgtcctgtcatgactgactggattttcgctgatcgcaattgcagacttactgtcgcaataaattgtagtaggctgatattgcttctcgcccagatcttccataattctcctcaaccaaacaacttgtgaaacagcttttgatgctgctacatattctgcttcggctgaagataaagcgacaatattttgtttttttgtagaccaggagcacatacctgaaccaagtgagaaagcgtagcctgatgtgctcttcatatcgtcaagacatccagcccagtcactgtccgtgtagccaattaattttgattctttaactggcttataccatataccataatctgcggtccctttgatataccgcaaaactctctttgcagcggtaaaatttaattgacttgggctagacatatatcttgataataaacttgccgcaaacataatatccggtcgtgttgcggtcaaatataataaacttccaactaagcttctgtaaattgttggatctgccttatcagctccatctctagccttttgcttttcatttggcaacaagggggttgtaactgacttgcagttatccatcttaaatttcttcagaatattttcagcatatttcctttgtgatataaatattccttcatcactttgatgcacttccataccgagaaaatagtggagcaagcccagatcactcatttcatatgtatgcatcatatcttttttaaagtcttgcatcatcttctcactattgccagtatatatcaaatcgtcaacatagagtgagacgattaggatatccgtacctgttttgttgacatatagagtaggctcacttatgctcttggcaaatcctttctgaataaagtacttgtcaatttgactataccacgctctaggcgcttgctttaatccatataaagccttcttgagtctgaataccttattttctcccccttggactgaaaacccttcaggttgttcaacatagatttcttcatcaagataaccatttaagaaagccgatttaacatcaagttgatatatcttccacctcttttgagctgctagagcaattatggtacgaattgtctctagcctggcaacaggagcatatgtctcataataatcaatcccaggcttttgcttaaagccttttgccacaagtcttgccttgtatttctgaactgagccatctggatttaattttgtcttataaacccacttaactccaataacttctctgtccctaggacgatcaaccaactcccatgtattatttttctcaatcatatgaatctcatcttccatggcctttatccaattatcatgtttttctgcttcttggaaactttgtggctcaacaactgaataattgcaaaattcatgttgttctgaccctctttgttgagaagtagattctaataattcaaccatacttcttacccgtcttggagctgattccggtgtagaaatttgctcttcactgctcgggcttgaatctgaactagcacttgagcttgacattggacttgatggctgtggacttggagtatgatcttccacttcatgagtgccatgcatatgtggttggcctagtgtgatggtagtggttggcaataatggagtactagaggcttctggagacttccagttccatgtagcactctcatcaaaaatcgcatctctgctaatgataattttctttttctccaaattataaagtctatagcctttgataccatcagcatagccaacaaatatgcaccgatcacttttattatcaaattttactctcttttgtgctggcacttgagcatagcaaatgcaaccaaatactctcatatgaccaatgacaggctttttaccataccaagcttcaaaaggtgtacggtttgttactgccttggtaggacttctatttaaaatataaactgcagtattaactgcttcagcccagaaagatttaggcatacctttgtcttggagcatagaattggccatatcattgatcgtccgatttttccgttctgcaactccattttgttgagcactatagcctgccgttagctgtcttcggatgccagcattttcacaatatttctcaaattcttttgagatatattctcttccttgatcgctgcgcaatactttaatttttcgattactctgattttccaccatggccttgaattttttgaatatctccaaggctgcagatttttcttttagaaaatatacccagatcattcttgtataatcatcgataaatgtgataaagtaccaatttcctccttctgaaattgttggcactttaccaactatatcagcgtgcactagttccaatggtgcacttgctctccaagctccactgtggggaaaagaagcccggatttgttttccaaatacacaaccttcacatgggtcagacttgagagtaataaatggaaggccttgaaccataccttttgtcctgagtagcttcaatgctctgtaattaagatgacccattcttttgtgccataaatcggaaatatcaacttcacttctgagagccatttgagttgtatgattcatccttaatagaaaatttctattcttctccatatttattttagcgaccagacgattatttttacggtccaatattttgcaagaaaaatcttcaaaataaaccgcgtacccgtgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttgcatgatacgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatattttgcaatatggccctttcttttgcacttgttgcaggtcattttcttccagcacatatctgtagtatgactagatttttggcaaatgtcacaccacaaatttgaactggacgtacctttttctcttctctcttgaccatcttccttctgcctggaaaagccatttttctgaaaataaccacggtctcgcattggaaatccatttttttgaaaatttccgcgaaaccttgagttttgaggcctgaagctcaactttgactgaaatgcattttcaatagagctcccttcgcgctgaagctttctttcttcatgagattccaacgagtctttcgacaagtctttcgactcctcagtagcagcaacaatgtactcgtatttttcaggcagactgattaaaattttctccacaaccttctggtcgtttatatcttcaccatagaggcgcatctgattaacgatctcaataactcttgagaaatagtcttttaccttctctgactccttcattagcaaattctgaaattgtcttctcaaggtttgaagcttcaccgcaagtaccttctgagatccttgaaactcctccttcaacttgtcccatgcttccttggatttcttggcgccaataatacgtggaaatagactttccgcaactccttgttggatcaagaacaaggccttggcgtccgacatccgatcctctgccaaagactttttctgttccgccgtaagagtttctccagcggaatactcttgatagccattctcaacaatatcccacaatccttgagatagcagcagcgtccgcatcttgatgctccatatatcataattttctcctgcaaatacaggaaccatagactgcgccattgtggcgcccgaacttgaagccatacttgtagcttcaattgacaataccgatacgccgtgctactctgtcacgccctactcgaacctgggcgctctgataccagttgttggtgctaaatatttcctaagcaggggatcagagaagaggagcagagaagcttgtgctagttttaactggtttctttacttgcttgcttgaggactgaacagtacacttgcttgtacgttgggcagcacaccatcatcagtctatacacatgcactggctttctatttataggcttgataaactgatatgtaggaagcttcaggacctagctagagacttgtagtactactacattgtcaaacttcactggtactagtactactgtaaaatcacatcatgcatgtctacacactacactgttctagaaaatttatagagcaaggacttcaaccttgactttagtttcacgagtagtagagagggttagagagtaggctggtatgttctagaaataaattaactccaacatcaggaagttgccatttcttcctttgtgtgtgtgtttggtcagagtgattagaggaaagtccatgaatttttagcactactagagacattgctgagaggaaaaggagtaacgcaatctcttttttatctgataaatggaatatccaaaagtcattgagcagctagcgagttcgtctcataactctgcatccgggcggcatacctgaatcttaatgggacttacaaaatttcctactactattgagcaatcctttttattctgatctagtgaattcaattagacgcacagaaataatcaatctgtctgactaaacaacacatcgaggattagtgacagtaattacgagagttctgtacttctgttcatcgcaatgggaatctttacatctcgaggaccaaagctaggtagctagctactccctccgtttcacaatgtaaaatgtgggaaatgctagaatgacttacattatgaaacggagtaagtacgaataaacatctaacaagtcccatgaagttagtgttggacagctcgtcggaggaattctcagaggctcatccagccacagcggcgccgccttgttggtcaccggagaagatgatgtcatagaactccttgtccgagaggttcaccagctcagccgtggcactgtcgtaagcatggctggacgcagcagtagtggcagtgtcatcgtgttcctcgtactccgggcaagggccaggctcaacggcggcgacggcgacggcggcggcgtcggtttctggcgccggcccgaactcctccaacgccgacaagaagaagttggtccagcattgcggatccgagcgctcgtcgaacccgaggctcttgcagaactcctcgtccccctcgtgttcttgcacgaacgcctcgtgttcttgcacgaacgccgcgacgctgtccagctggtcagtgctcaggtagccgccctgatccggctcggatgctgcagcggcgtcgacgtcgacgtgttgctccgacgccggcagagttcgccgcggcgcgctgctcgctggcgcctcggggtggtcggactcctcctctgccttgcgcttgcgccggacgtcgacgacacgggcggcggcgcggccctcgacggtgacgacgcggcggaggacggcggcgagggcgcgccgtagcgcgacgtgcggggcgagcggtagaccttgcagagcgcgaggtggtcggagccggggaacgagaactccaccatgagccacccgggcttgacgacggcgcccaacgccgtcttgatcttgtacgagaacttctgcagcttgccgccggcggcgctgcccttgacgtccttggggcctccctccgcgtgccagcactcgccgcagccgccgccgacggtgcgagccttcctcgcgccgcggctgccgagaacgcgcactggggtgaacacgtaccacacccggccatcgccgtcgccggtgccgggcgccggggcgaggccggcgacgagctgatcgggtggggcggagtacacgtcggcgacgtggaagtaggaggtggcggcggagggcaggtcgtcgaggctggtccggacaaggtagctccggaggtagccgtcggtgagctggtcgtcgctgggggagaacaccaagcccttgccgatctcagccatggcgcgcggcgagagttggcacggacgtgaggaagaagaggtgaaggtgaagaaccctagctagggtttgacttcaggtgaagcgggtgtgtggatggccttcatatttataaggcgttgattttggtttctccaaaaggtttggaactcggtgttacactcggagtcggactcggatttgtgaaaatatggcgggaaacaaagggtggacgtaacgtggggaataaggaacacacaagctgttaattaacaaggttaaggcaaaggctgggctaccctctctccaccccgtggcagctggttttagaactagtggccatcttccaggtcttgcttgcctaagcatcttcgcgttggtttcgactccctggtactcctggtctcttggcagctgtggaagtaacggaactttaaggtttttgactataagctctctttggtctcaatggtgctagagtccatccactcatagggtcatctatggtctttagttggcgttgccgcttttaggaacttgttgggagtgtaacgtggctcggccccttcccgctgcctacttgcttagagtctatgttttagccaccgtagtttttctaagcttcatcttttcattttgttttttctcccttcctctggcataagctggtctggctgattgcgttgtgtaactataactattttcttctaatatattgacgtgttgcgcattcgtgaaaaaggttaaggcaaagaggtctcttacatgatgtaattgtttaagacaaggttaaggcaattaatacggagtggatgaggaagaggatgtacgcgtacaccaaagagtaagtataagtagttaagagaaaaagggaaaaaaagttatttacatcaagagtcatattattgtaaatttttactattgtcgatttgtaaattaggcgggaagagctgctgatctgttttgatcaaattagcaagtttatgaacttgtgcagatggctttgttcgctttgcgagtgaagactgaaagagtatcagcttaccatcattgacagtcgcaactgagtttaactaaagagtattagtttattattatttcaataactgaagtaaatctattagtacacccgttcacttatgcttgtacattgcaatctgactaccacgaacgcaatggcatacacaatttggtgccagaaacctgagttaattcgaaagttcagagtaattttaacacttcagaaatcattcacataagcgagaatcgaattacagcaaggtcaccattcactcttggataccgaaatacacagattaaacttgtttcgacatctcatgcatccttacagataaaatactatctggtagcgattacaaaagttattttcaatcacttccacgcagctttggatcaagaggtgcacaaaactcttgtcctggttccttagaaacaaatatatattgtaatccaggtgcatatactcttcgacctgaaagaaaccacaggtcacaaaaaaaggccgccatggatcattcatttctttgaggaacggaagcctccgaaacccatcatggcagcaacatcagggtctatgtcctcctcaggttcattctgggcagccagctctttctgaaaccatttgacatccagtttattatgaattctactgattttcacagccaacagaactgtaaattaaggaaagcagaaaatatcatgaattctactgaatttcacagccaacagaactgtgaactaaggaaatgtcagccatctgcatgcatggttgcaattacctttttctctttcttcttttctttgcgttggcgcttcctctcctcatcctcttgctgctgtttcaatattctctcatccaaatctgaaggtgtagaacacaaaaggagaatgtttagataatacttcctcataaggctccctttgcagctattccacataacagtttccttctcaagggcaaagataggggaaaataaatcttaaggacaaagatagaacaaaataaatttgatatttatttttgttgctttttctcaccttgttcactaaagctacctgggtctttcctcttcttaagtgactcaaaccttttctgaacctgcagccagaaagttacttaaggaaaaaaaaaacaggagaaaaagagtactgactacatatttcaagttcccgataggaatatcgagaagctaaatatgcaaccattggctcacttgtctcacatgaacaaatccataatgtagtacacatatgagtgagcaagacttgtaaacaattggaacaggattgttaattttcaattgcagatctgacaaataggctcagatattatacctgttcaagtgatgctctctcaacacgcatagacatgcccaatgctctctgatctgtcaaacattcaaaccacgaaacattattattaaaaggtttgatataccaactcagcctaaaccagaggtctcagaaagtcagaatacttacgtttcttgccatttatatggtccaaatagttagctgaatctttaacgacacattcacaaactttacaatagtaaccagcctgtcaggaagtagagttaaaagcaaaattttaggtgataaatttaacatgaaaaacatttaggcaatttctagaatcattgaaattgaaactagaattgttaataatgcagctatcgagaacagacatcatggacagatgaatcacaggctgaattctaaattttttttttctgataaaaactctgtttcaaaagcaaaatgaatgacagtaagtgaattccagagggcatgtaaataaataattaaagctcaatgaaaatactataacatgtcctgtgggatttctggacgaacctgttgactcaaaggtgcaattggagttaccacctggagaaaaacaacaaacataatcggttatgagctcaatcagaagggcattcatatttgtaaaaacagcttgttgatcataaaagaaaataatggtaagactacaagaacaaaaaatcgggagacataatcatgcagcatgaggaagcatggaaaatctatgctaaagcaacagaagaagacttattagaaagcaaagatgatctagcaaacctgagtcttgccaagacgggactcaaggtcaacttcatagtccctatgcttcaaaggttgcctttgcacaggagggcccttttctgtcatgtatagttgaaattaatttagctttacaagaaataaaatgcatccatccaaatctaactgaattgaagtacatagcactacatacccttgcctttccgcgcttcttcctgcatcagcaagagaaaaagaaagaacaaagttaacaacaggttgggcgaaggaagtattaagtatatatttttttagcttcgaaaatgattgtggaatgtaaaatgaggaccttctcctcccgctccctctgccgagctcgttccaagtactcctccttgtcaaatttcctccggaaagtgttatcgacaccaaccggctatgcatcaaaacaagcaaaaggtcagctcaaatgcaccacactgccttattttatgagtctctttgaagcatatataagtaacttacattgctagacatgttgctctgcccactgccaagcagctgctacctaagaagcacaagcagaagcagcaatgagaaacaggtataataacagaaaaaaaatctctccccctaaataactaggcgaagcggacccagggaatcacgacgacgagtgtgcctaggttgtgaaatcaagctgatctgagcattcgaatcatagaaaacatgcactgcatctttgaattgtgaaatcaacttgatctaggcctacaaatcacaaaaacaagcctgatctctgaaccctcactgacttcgatttcaatctatccatcagggagaggattagaggtagttacccgagtaaaaatgtgataacaaaaaactaacctggttggattcttggagagacggagaggattagaggagagcccttcctccttgctggtcgtggtcgcggccgccgcccccgctgccgcctagcgccacagcccgcttgccgagtcgcctctgggtgtaggccgtcggcgttagggggcggggggctcaggcctcacggtggccggtgggtgcggagctgcgccttctcgccgccggtagcccggtcgccggaaccctactttttttttccctttccttttttcctttttttctgtttttcttttgcaaagcgttagagactaaactgggcatgagctttgggcctttatgggctgtgcaagtgttagtgggcttctcagacctttctcagagtagcatttaggcccaaaaataatcgggatcctatgtgctcatgtgaattccgttggatcagaatcggacgactgctgttgaggttggcgtttttttttttctgaagagacctcaaaatattagagaaatccttctcatatttcaagagtgaggcaccatgggataagaaattgctttattcaactatgtcaaagcgcaaggaagaaactagactataatcgtctcatagatgtctgatgtctcatttgacagtactaagaaaccaccattgcaccagtaaattacaggtctaaacagacacagcacaactctgttcaggtaagaacaacatccatccaaagatgatgatgataacaagtgagaatttgagtatctatcagtacactcgtggattccattgctactagaaacatgtatctgactgaatctgatatgagatgcaaactgcaggccacagccgaggcttcctatggctccaccttggtcaccttctcccactgaccatctgatgcctccttccacagtgtgatatcgccggagccggccgccacggacagtatgtttccggtcagtgaccaggacaccctccatgccggagcctcgaagtcatgcatcaccttcccttcccatttgtcgccctctttccccttggtccagatgacaaccttaccgtcttcagaggcactggcgattgtaaactttgcgaggcccaaaacaggtgcccaggatacatctctaacgcagtccgtgtgcatgtcggagggcagaacgctatccagcttccagctgccattgacaaaagcccacaccttgacaacacagtcgaagccaccagagacgagcttctggacaagttcccctgagccaacaatggaaccgagtgcggttgctggagcccatgagactgccatcaccccaacagggtgtgcttgctcaattgttgtggagtcccatcctccatccgggcgcatggtcatgacagagatgctcccgtcggaagagccacaggcaaggcaaaggccaagctcatacggagcccaagcaatggagttgagtgaagacttgtggttgtcgaatacgtgagcctgagaccattgcccagctgcaccctccttccaaactacgacacggccatcgtagccgcaggatgcaagaatcgaaccaaacttgggatgggcccatgcaacacgccacacaggtccatagtgtccgctgagggttgcaagcagctgggatggcgcggatgcacctccaatgctgctgatctgcacggtggagtctgaggaggctgtggcaaggctcttcccgtagtagtcgatggcagaatcatggaccatgtccttgtggtcaagctctatcttgtttgacgacatgctgccaacttaatccagactcaaacttgaatccctcctttgtagtcctgattgtgattaaaatgaagtgacaagtcaattcaccaacacagaccagatggaacaatttaattgcagagaaatgaagtgacaagtcaattcaccaatacagaccagatggaacaatttaattgcagagaaatgaagtgactaagtcaattcaccaacacagaccagatggaacaatttaattgcagagaaaagcatccatctaagaaggaccttgcacaacagcacggacaatagaacatagaggcatcaatgccatcgtattagttcaattcattacacattagcttcccaatgattgttttcagccaacacctactgcaatataatcaacagaaggaacaaaactggcataaaaacgtatcaggctcactacatatatggggtaagacggttttgatatgtccatggatcacaactggtaattgcacattgcagccttagcttgctgcctgcagcttgcaggatcacaagaagagagattcacaggggcggatccaacttgggacatgagggttcagccaaacttttgggtgaacaaacaaactgttactttgtattaaggttaataaggctctgaaattaagaagaagaagaagagcttcttccagatctagaagagaagctagggttaacgaacgcaagcagagagatgaatcagaaagaggatgcggggatgctcacctcaccaggatcccctcccctgctcttctcgccagatggagatcggcgccccctcccctgttcggccgcgagatggctcaaggagcggaggagacgacgagatgggtgattttcttctacgccaagggaagggaagggggagatagtatactcgaggttttcactttaaaaatctttatgatgactccaccttttatctcaaaattttcacttaaaaaatatttatgatgaccccaccttttatctcaattttttttcaccctaaaactagctatactaccttttttttttatggacgtaactacacagctagtggtagctggttccactccatctataagagacaccatttacctatacttcaaatacaattttctattaaactactcatctgatctacgatctaattacaccgttgtgttcgtaataattaaatctttacaacaagatctcacatgattatattttgatgaaaaatcacaaattacttttatgatatgtctaaattatttttagatttcactaagttacttcttaaatatataaaagtaaattcagtgaagcctaaaagtaatttacatatattatagaagtaacttagaacaaaaacaaaggtaactttggcatgtcatttgaagtaaatacgttatagagataaaaacatgactctatgtagaaattaaattaatcagtacaaattatgaaattaactaaaaataataataaaagtaatcacctcggagcattataaatgtataggaagtattttaatcaaatctaaaagtaacttatatatatgataatttgttcaataaaaaaggcattaattaaagttactttccttttgttataagttacttctataatatatctaaattacttttagactttactgaatttacttttatatgtctaagaagtaacttagtgaaatctaaaagtaatttatacatatcataaaagtaatttgtgatttttcatcaaaatataatcatgtgaaatcttgttgtaaagatttaattattacgaatacaacggtgtaatcggattgtaaatcggatgagtaatttaagagaaaattttatttgtagcttagacgataggaatatttcccctacttgcttaatggattagtactatagtaaagtaagattcttcaagttaatacacatctggatagagttcgcttgttatgactaaatcgagagtactctcgatttagattttgcgtttttttttgtgtgtgatgacatgtcaacggtactcatagaaaaaaaatcaacaaactcggaactactcagaccaccggcaaccactatagctgccgcttcatgcaccaccactctttctccatgagacatgttttttcttctccccatcgtcatgcacgctattatcatggtcgtcattgaggctggggtgtcgggcttgaagaggctcagggaggctaaccactatagttgccgcttcacgcaccaccactctttctccatgagacatgttttttcttctcccccgccgtcatgcacgctattatcatggtcatcattaaggctaggggtgtcgagcttgaagaggctcagggaggcaggaacttacccggcgaagagcgaagatgctagatccaggctcctccttggattccccaactatcaaagaaaaaaagaaaaaacgagagagaagtgtggagagtgattgcataatcactggacttgaaggtggagcgatggtagagtcactagacttaacgtcattcttgcggtcacggccgagcccgtgctgcccccgatgctaatgcatatgagatctacactctcatcatctgtactctcatcatctatgataccccaccagattatttattaaccctaaatagaagcaagaaactgaaaggagaagctaaagatgcagtggaagttacttcaattgaccatggggtgaatggagaatggggacaatgtttttgcaaggattaacatgttacaggagggacagcatcacacagcagatggtagtaattattttatccccacaggtgctccaatcaaatggcacatgaacagttcaagaatggttcatcatgacagacatcgacggtcaatcatcagataaacaatgggcaggttagtagcaacattatcaatctttcgtgacaaaacatgcacagttgcatgaccgaactactaccaatttacaatttgtgagaccaacatatggaacaaaaaccttgtttgtggctgtcaaactggtatcattagtgggaaaagaacacctgctacaaagaagtgtcagacactagaagtagatcagcaaccatttcatcgatcaaggaaccaagcaactctgttgtaatgtcaatgccagattcgtatgactccaacttgaaatctacccagctccccagaggactactcatttctttgtacacgagttcatccaccatccactcctcagcaaccttcagatcagtcatctccgcatagatttcttcagctgtgagcttcttcagaattgccatccccaagaaccatgagccgtagccggcattgaaatagtatgcacatctcacactcagtatctcgtttacacattcgaagagcagcctccgattcattcggagtgttttgccctctgctacacccaccgccagccgaatatcgccatttaagtcttccagtagttgtagatccaggatatctgagttaatgaatcgctccaagcccgagcaaatttgaccattaagaggactggtgtttaatatttctcttatgaaatcaatctcctgtctgcaatccattcggcttgaactgctgctatctgatggggggatatccgtcgtagtcacagtgattgatgaggctgtgtcagaatactccgagaaagcgtcagcttccaggaatttactgaagcatgcagaattagacgttgttgcaccttccgttgagctaaatactttggttcctataaagagggaaaatatataagattttgaggaagacatacagctaatgctccagcaacaaccaagcacctgtatatttaccatttgcgcttctccagctctctgttgagctaccggtttcagttgaaacagaagcatcccatgttgaaaggggactgaggtgaaggcgctctatctccatttgatccatggcatcattatcatacttcacagattgagatgactggtgaaagagagggaatgttagcacaatgaccaattctcaaccagtcattgataaatttactcttttatatatttagacgcagtaatcattgtttaggagttacaataagtgtcccacttcagtatagcagcgagaagcttcaggtgtttcccttgattcatccgtgcattccaagtatgccagtttccaaaaggtaaaaaggcatatggaacaaaataaactaggaactacccaattatgcatgtaagaataatcaaaggcacaaaatgttgggtatacagccagggatttcctaacagaacacaatattataacctttaagaacaacatagaatccctaaactaattgttaataaaaatctagattattaacatcccaaaatatcaacaatatacacttttacaccaaaggtcatgcaggaaaagcatatggggtaaagacgtacagttggagctgatgtaatttacaaacattagcatggtggtcaaaatcattaatatgccaaatatgatagggttatgatatcaatctattgctcttatttctgaattctgatggacaacatattctttggacaaactttttgatgttatcaactgagaatcaaagtattctctgacttgaaaataaaagataaattaaccatatcagtttctgcatttatcgcagctacatgaagaaaagataatatgcctaattaactactccctccgttccaaaataagttcatttttcacctatcccacatataccaatacaacatcgaaaagactagaatagccctactttatcaaatcccaatacaattattccccactttatctactcccaatacatttatcccctactttcacaaactccgatgcaatgattattcaaaaataaacttattttgggacaaatgggggaggccaaaaatgaacttattatgggacggagggagtggttaatattttttccatgctcccaacaggtgaaacacagaatctgaataaccttttcaggtatttatcatatgctcacagcaatggaaatgacatgcataggagaaaaaggtgggcatgatagcaacagaattgcctgtgattccatacctgaccactctttgatgcaagatctgtctgggtgaaactgccttttccatccttataggattggacggactccctatcataatcagtagatgcaatgctcgatgtttcacatgctgattgtgaatcttccagaactgatgatggggcatatatccgaacatctttggctggcttacagtagggtgacctaaccccagaagtaagttctctcaacttctgctctaaaaggagacccaaataatcaccatcaattgaatcaaatttagcactcgatgtctcgcttgaatttggtactgagctcgcgtttttcataaactgtttttccactaaatgattgggtaggcgataaccagataatggtttatcaactggtgcggtgaatgtgaatgaaacaatatcagtgctaattttcttcttgttcatggaaaaaggtgattgctcatctattacaatattgtgccgaacacgcctttggcttctgtcagcaatatctttatcacttggacgggttttcactgaatgtatcctcccatctggtaatcttcctggcttggggattgatttggctgtagaattttgccttctatttgcatggccagttgaccgcaattccacgtttctgttaccttgagtattgttttcagacggtgtgccggcagtcccaacctttctcatagtgccatttattgaatgtgtgttgcttctttgccggttgggtgttggtggcttggaattcaccttgtgcttaaccatagcattttgctttctgttattttgcacaagcacattggacgaacttgccatgcccacttgattgttattcttcccttggttaatcccatttctctcaaccattctccgctcaggatcccgagttgcaagttttctgctaatcttgcttatatcttcccttccttgaacattagttgctctagaatctggtgatgatcgactgctggccttgacctttgggccaactggagcacctccatttgactgtgagaccacagaagcagaggtgttccctgaacttttcagacttccatccaaaggctttccagttggtagcctataagatgtcaagccatcatgcttcttcagtgcttcattcattcttggtggcctttgttggactatcgcaatctctctttggctgtatacacgaacagtatttgcatatccaacatcacgaactctgtaagggctaataacctcaactccagcccctataatcctagacgccgcctccattatatcagcagcatttctgctagatatatgattaggattcttcatgggggacaacttgttttgcgcaaccgacagtgtccttttggcaaatcttggtggcaatgcttccatcctaaaccggtcaataggactaccaggcatcttatgaggactaccgggcatcttatgaggactgccaacatagcttctgccaatgaactcatcatggatagtactgttctggggggactgctgcacagttaatggcatcgtataggatccagatgagcttgctgcgggcatggaatccagacccataagccttgctacaacagtggggcccctcctcacaagagcttcatcgtcaaccactgaagatgagcaactgtgctcactgctttccttcaaactcggtgcatcttcaaggaactgccaacaattatgcatacacaattacacataaataacacaaaaaaaactaaaaaactaataagattgctcgcatgaacacgcaccgaatttggtcgagtgcttggtgtgccaccatcagattccctgaaattttcagaaacccctgcaaaggaagtatcagtatgcaatcctaattcctccatccatttgagaaaaaaaggatgtatcgagtttatagcaatgactggactcctgtgccacattgacttacttggagccggagaatcgctcccatttccactgaccagccgcttcttggacttcttgccccaatcaaacaggctaaagaagccatgtccctttgaagtaggcttctccacatccatttccctttactcccctaaacctgcaaacaaaatagctcgcgtaaacacaacgaatgaaccaaagtaatacttagcttaatgcagctaaactagtaatcaagaaagagcccagtgatgagtcccccaaaacccaatctttacccccccaaatgtgacctagaaaacaaaacccaagaaacaatactactcaaactcagagaacaacgcctgcaatatacagcagcattccatcaatttacccgaaatgcaggtaatccccaactaagaacaccccccaagaaaccacaaggcagccctcgcccgtgtagaacaccgcaaagatccggccttctcctcccagctggagtcaacgccgccggattcaccaaagcagcgcccaaccggagccaaatcgccgcgaacaccactccggatcgagccgcattgagccgtagctcgtcgccctcgccggtaagctcccaaaccagcgactttttctcgtgcacaacacaacaaaaccacacctcttggacccagccgccgccgttgagggatccgcgccgccgtcacattaggtccggcgaggtggagaggtggcggaggtgggaggaggaggaggaggaggccgcggccgcggaatccattaatgcggctgcctgaggtgggcgaggaggaggagaagagagagagagagagagagattggagagaaaagaagccttttttttctctcacttgtcctctcttcttctcttgctgctcttctcctctctctctctctctctcgtctttatgacgaaaggtttattaaaaaggaaggaaatttggggaattttggggatcggtttggtcgttttcgtgatgtaacgagatttggcggttgggtttggatcatttgctcacaaattttggctctttgtgtgtgggggtgtttcgcctggtaaaataaaataaatgggttttttcggtgtgttggatccgctgaaacagatcatgtttaagagtaggacacgatgagcccagtggccagtacagttaacagatcatatatgtaccaaaaaatttatttcaaccagatggtcatgtccacggcatagaggagatggacagtgataaaagtacacctaacaatgaaatggaaggtcttgccaacacacgaattataaaaacaattatataaattggttttgggctattattgcagtgcacgaatttaatagtacaaatttcagtagatattgagttcgcgaaaaatcagtagatattggttcaattcccacaaaaaaaattctgaaaaatcatcctctcaaagaagaccttgattctcataaaaatcttctaaatatctatatgttccaaaaaagaccttactggtatatcattttactttattcagtttttttaatgaataactaaatagttgaatgattttgtaataattatttgagagtacaaatgaatgaagtaagcattaaaaagttgaaaaataaataaaaattgttttctaaaagtttgtataaaaagcatttttataaaaaaagcgtacaccgtttagaagcttggaaaattggccgttgttacattacacactttactaaagttttaaatgcttttaaaagggtaaaacgtagacacaccacggcatgtcgcttgcaccctaaaatgacaaggttgtttcacgaaatgggcgccgccggcgacggccacggccacggcggcggcggcggtgcaccgtagacgtcagtagttggtggtagtgtacaatcatgcgtacgcattatcgacggtcgccggctaaaaaagacgattcccgtcgccgtcttcatcattttcgtcgatttccgttgatgttgcagcttatcatcctgtccaaaccagttttttttttttacactctctttagttttactgcaaatccttcgtaggatacccacaagtacacaatcaccccaaccaacaatccgcatgaactgggctacggtttcagtcaaagtttggagtaaggtgctatctataaaacatgtacacctcaacaatagactagattaatagtaaaccacttcaatggtatatctacatgggtatctatagctctctaatccattgcctagtttttctctatagactatctccatgttagtagatagctttgctctctctcttcatttaatctcttccaagtaggaaaatatgctgacatggatctcttgtagagagcttatagataaccattgtgggtgccctaaaagggaaaaaaatatgtggttaagacgtacactttaacctgactgaacatttcaccaaccaacgaaagtgtagtactactctactacgtatggagagcatccaatccaatccatcctgctcttgttgtcttttgtcttctccacaagccaagcatccatacgagctagtgctggtacaggtcgcaattatgcaaagtgacaggagagattaatgcaaactaatcacactagcagcagtggtttcctttgcaagcagggcagagttaatgcgaggaggagttagctgctctgctcgagtttaagggtactgcaactctgcaagtcagcagctgcaagaacatcaccaagttcagctaagctcgtttggagatcagcatcagcttacactgacagagcttatgctgacaagtagtgacggattcgtctgcgttgatgtctcaacaacctgtaggccatcaattaccggtttttgcttaatctgcttgcgattttgtgagtgcttggatagaatagaatccaatgtaggacacgaatactttggcagtgtgtttgcttcgattcccttatctgacagacaacctgcaagattgtgcatatgtgtaggtgcttggtcgccattgcagatgcttttcttttcccccgggcaagcaaaggtccaagatttttatcttattattatcattttttaacaaaaaataatctgcaaagaggactgtactacatatatatcttcattgaaagaaataggagagaaatgagctaatttttgttttagagtgcactaaacagacattccaggatgagaaaattgtaccatttttgtttgttttgtgttacaattcctgaagtatactgaatattttggcacagcatcagcttcagtcagaagttgagattatcagatgtggtgggggaagttgttgtagctgaaaagcatacatagcagtggggtgattgtgtttttcactcttcccagtactttacaccagtagtacatcttttcatgaaaaataaacggaaaaattcgagcttttttgcagatttgagatctacagaacagaacataaccttttcacgttaacgaagtaacgcgaggtttagggggtgtttgggagagaggggctaacacccccttagtgcatatgcagtgcagcactctgaaaaaagatggcaggtagggtagtagtgctccttaagccgcgagagcacgcaacgagaaaactgacagcctcccatgtgattttacctgccaaacctcactttgatcagctatcagatgagatgaggaaagcctttgctgctgtgtgcttgtgtctggctcaagcgagtagcaaattcagattctatagtttttttttctctctctgaaacttttcttttagatggactgaatgctctgaaagactcaaaactattgcacgtttacatgaccaatggcatggtttttaaggccctgtaatctgaaactagtacacgttgacatagagacgattaagttgggaacacgttggtcagaagtacggagttgcaaacactactcctatgctgcataatatagcaacttgtaccatttaaaatctatcttaaaatataacaacctcgcgtctcaactaattagagcaggatcttattttagctattcctttactatctcatctcaatcaatcacgactatttctcatttaatttcacatatcttcttaatctccacgaaaaaaaactccagaaacatttacacgagtattttgggaatagtatgtactaatcgagacactttaccgatttgaagggcgcaaaactgaagatgagatttgcaaaatgcaatgggtcaacaccacctgttcttgtaccaggaggctactatgagggacgcatcagcaacgagatctgaaccgtggctgtcccattgtctgcctgcttgaggcaaagcaatcagagattcagagaggcaggctgcccctccactctgcttgcagtaaacgataaatgcaacagaggcccactcatccaagatcagatcgtcttgggccacctctctctgcggcccaaactaaaagagaacggtggccaaacatcttgctgggcctcacgcggtggaataagaaataagttcatctgaggtcccttaacttgttaacgaatctgattttcgtccttcaaccggaaaaccagatacgacaggtcccttaactatcaaaactggtgtagatgaggtccctcggcggttttgatgacagttttagctgacgtgacgcctatgtggctaatttgactcggtatttgtcccacgtggcattgacgtggcgcttacatggcaattccatccctgaaaaataataaaaaccatgggcccacatgtcagttaaaaaaaagtgggcccccacaagtcagtgctctctctctctctctctcactcttcttatctggacccttgccgtcgacttcactccgaggcgttcgggctgccgccgctcgtcccagccctcgacccggccgtcaacatgagcagccttgccgccggcgcatgcttcgcctccgccggcgccggctacgacaatgccacctctgatcttttcgttagccttccattagagcaaaacgatagctagcttagctacattttcatggtgttcttgggtgacatcacacatgacatccatggagtaattttgtgaggtcgcgtcgtgcagtcggtgctgccgatgtggaaggagctggactacttcaaggagtacgcggcgaggcttcaaagcttccggggggacgacgacgcggcggcggcggcgacgctgtcggaggcgctctacatcgtcagcatgggcaccaaagacttcctcgagaactactacgccatggcgcgcgcccaagcggcggagtactccacggcggtggcgtacggcgactacctcctcggcatcggcgcatcgccgagtcgtactcgttcgtccgcgagctgcacgcgctcggtgcccgcaaggtcgaccttaacggcctcccgcccatgggctgcctcccgctggagcgcgccacggggagcggcggcgcgtgtaccgacgagaaaaacaccgtcgtcgagcgcttcaacgccggcctccaggacatgatcgcgaggctcaacgatgagctcggcgacggcgagatgatcgtgtatggcgacgtgtacaggtcggtggccgccggcggcgtacggggtggagaacgtaggcaacaacaccgtgcccacgcgggtcaaccggcggcggctcacctgtgccatctgcttcgacatgttcgcccccggtaggatgaggtcggcggggtgctcccatagtcccactacaactgcatcgcttcggtgcccggacctgtcctgctcggtcgccggcggaggcgagcgcagcgaccgttcctgaggagggcgcgggggcggaaggcggtgctggagaacggccaccggaggccgaggcaagggggaagcggcggcggcggcgggaacatgcggaggcggcggaggcaggcacggcaggcgacaaggagagggcagcggcagccggcggtaggcccatgggggcgggagtggaggaggccgcgcctacgctatccgcatctccgccggtgagaggagagaggaaaggggagagttgtgaagataggtgagatggggagagaggaggaagaagaggaggggattgagatgagaagagtgagtgagagagagctgatatgtgggacccacttggggcccaccagtttttttaactgacatgtgggcccatggttttttattattttcagtgatagaattgacacgtaagcgccacgtcaaatgccacgtaggtgccacgtcagccaaaaccaccatcaaactgccgagggacctcatctgcaccggttttaatagttgagggaccattgtatctggtttttcggttgaaggatgaaaatcggattcattgacaagttaagggaactcagataagcttattccgtggaataactaatccacgggcttgctctcttactgggccggtcttatcggatcatcagatcaaacgagcactaatacttagattagatggaaatcgaatgatatggatttggtctcccgtctcactgccgtgtgggccccaccgcccactaaccaccccgaggcatctgcgccgctgtcgtttcgccggtaatctcgctgcgttttggtcatcaaaagccctaacaaaaacctccccacctgcggccgccgctcgcgtcccatctctccctctctcctcccacccatggccgccgccgccgaccgcctcctccacctcctccgcgccgcgcctgcttccccggcccccgccgccgtcccgtcgtcccgcacccgagccaccttctaccaccagccgcggagcctccgcctggcggcaggggcatccggtatgcgccgcgttgccgtggcctgcagctccgcgggcgcgggcgggagcggggtcgagggcgatgaggaggggatgacgtacaagggcgccggcgtggatatcgacgccgggacggagctcgtccgccgcatcggcaggttggctccagcgataggcggcttcggtggcctcttccccttcggtactatactactacccatctccttgtttgtattaagtagattggttttttttttttttgcggggaagtagattggggtttagtttgctcgtcattaatgggtgtgtgtttgggagggttctgtgatatgtattggtagttcttaccccaggtgaccaatttcttgttgctggaaccgatggagtcgggacgaagctcaagcttgcgtttgaaactggtatccatgacacaattgggattgatctggtatgtgttcactttgctagatgagtattttatttcatccctttgagtttgattgactcaaatgatttttaattctcatgttaggtggctatgagtgttaatgacattgtgacttcgggtgcaaaaccactgttcttcctagactactatgctacgagcaagctcgacgttgatctagcagagaaggtattgttgacgctattttgtttgctgaaaacagttatgccggctaatcctctcttatctacatctgcttataaagtcataattattctgttcaaaacttttattttctcaactacataggttatcaaggggattgtcgatggatgccggcaatcagattgtgctctgctaggaggagaggtgaagttccctaactagaacccatgttttagcagtggaatacttcaatctttgtaccaatgaatacagaatatatgtatcataattgttcatctgtcttgcaatggtttgtgactactttacttcatacgaataaattttcaattatgcttacagactgatcattagaccattttctaactagcaagcactagcttcaacaagtgaatctttgtaaatgttgatatggtattcagcttagttcacatggtggatcttgtttttcatcatactttggtttgtaaatgctttgagaatacttaactatgatatatgagcataagtacaaagttaacataatgttttgactctgttatgtgcagcaacatactaataaaaaacaattgcatttatcattgatccatttgtcatgcagacagcagaaatgcctgatttctataaagaaggtgaatatgatctaagtggctttgctgtgggtgctgttaagaaggataaggtcatcgatggtaaaaatatcatggagggagatatcatcattggtcttccttctagtggggttcattctaacgggttctcccttgctagaaggtattgcatctatccaattcgagttgttttgatccaaatagatggttgacgcatgctcttttcttttgatgttgatacttgacaacccgtcctcctgttgaattatgtgtcattaatggtacctacaaaatttcatatttttttagagtactggagaaaagtggactttcgttgaatgaccagctccccagaaatgatggcatgataactactgttggtgaagctctcatggcaccaactgttatctatgttaagcaggtagctttgctgatatatgtttcatatttagcatatatgtatatgcaagtttctaattaaattgttgaaaatgaaaaggtgctcgagattattaacaagggtggtgtaaaaggaatagcccatattactggtggtggcttcaccgataatatcccaagagtatttccttctggacttggggcaaagatttttactgcagcatgggaagtgccacctgtattcaggtggattcaagaggtaagggttaacagtccacgagcatgtcatgtgtattcttgtaaccccagtgaagttattcgactgtgttgtactgaaaatcattatagtattgtgtatctgttctgaattcctctggtggaagttatatatataatcagccatatttgaactcggtagaaactttaaagattatgataggaagccctaattagagactgggtttttcttttggtccccagttttcatgcactgtgctgcgctgcctatttggtccttatcattttctccgggtgtttgtaggttggaaaaattgaagatgcagagatgaggcgcacgttcaacatgggaattggaatggtccttgtggtaagcaaagaagcagctgatggaattctcgaaggtacccatggaccgaaccacgcatatcgcattggagaggtgatcagtggtgaaggagtccactacgtctgatctaattaatgatctttataatgctttgagtagtttgaggtttgttcatccgacaggcaaaccagcctaatttttgtaatcgcataacataaagggggccaagtcctggagcaacagtgagtttagtcctgtaagataagaaaacatggggcgtactccttttagttccacatgagaacttgcccccaaacggcagaacctattatttggacttgcatctacgagaggtgtcatcttattaaaatgttcttgcataccaactctagatatcctgatgtgtctcaccatcgaggcgttgcatttctatactcgttataagcatccagaaaaatcgcattaatgcaaaaaaaaaaactttttacgtaattacctgctacatgatctcagcaacaatactcaagcatacatgttattattcgaagttcttgcatccattaccacaagaaaacactcaaaaaaacgtaaagcaaaaaaaaaaaagaatctggatcgaaaaccttggctttacaagcgtcaaaatggcataggataggataggatcaccggttgatatcgccgtcgccgccgtaaggtgtccggccgccgtccggcgagtcaccagcggcggacgaagcggtccttgatccaccggaacccccggcggagcgacgccttgaccctggcctcgacggcgtaggccttgtacgccgccaccctccgccggcgcttcgcctccgggtcgccggaccaccacggcgtcgacgacgacgaggccaccgtcctctcgtcgccgtcgcgcggcggcgccgacccgccccggaactcctcgagatccctcatgcgttccgtctctctctttgagtgcgcgtttgccggcaacgacgacgagcgaggagaggagcttttggcagctcgcatatataggggagaaaatcagggagagtttgaggccggccatgacggcctcaacgcaatactctccccgtctcccagattagccctgaaattgtcgtcgtcgactagtgcttggcacagctcgtggaattattagcctttgcaaccctcaaaaaaacaatggttgacaaattgattaggatttgcattgcatggagatttctatgtgtttcttctcaggtagtagatggcacgccgtcacgttggttttcatacgtgcaacatgttgcagttaggagttttgacagttaaattcacatggtgcttctggtaatctgcttgaaatatggcaaagttgcagacttgcagctcaaatatatttttttttcttttggtgtgtgattgccagtagtggaggagcagtcagcaagcgcgccgtcccggccgtagctgtgatttggtgggcatttccgtgtgctcggctcttggctggatggaacaagtcgccctccatccaattacaaccagatatcagtttgtttccgcagcatatgtaacactcagaaagtgagaacctcttttttttttcttggaatgtacaaggcacaggtgcaaactgatctatcatctcactatgttgatcaaaagtaaccgagataaaaaaaacaatttacatgcaaacacatgatgttgtctaattctaacaaaaaaatctttttttttttgctctttctctttttttccccctcttaagttctacaagtctccaattttcctttccatctttactctcccacaaagggttacctacaccgctacaccagacaacttattggagacaggaaaaaagttagcatgtaggctgatacaacccccgtacaagagggcattcatcatcatatcatcatactctatgtgccataggcagatgtgctcaaggcagctgaaaattcagacggcaatgtttcactaacaaacatttacagtcatctccacgtaccggaacgggagacgaaaaaacggaaatctggatgctctacttgtacgcagctgagccagttgccagcctcctccatcagcgaggtgacacgctgtccttgggtcccatcggatgcccaaatggagctgcgaagtttgtaagatgccagtccaaaggcaggcaaagatagcttgccagttgcatttgcgcaagggctgatgccaccaaaaccagggcatgctggtgtagtgctatcgctatctgcaagaatgggaatgttaagcaatctatgcagtatgtaacatataagttgcatctaggtacaaactatttacaccttcataattcattaggcattagaaggtatttacccttagaaggtgttgctaggcaatggaatgtcaagaaacaggcatcaaggtcttccaacgtcggccctgttggaattctatatatggggtacctgcaatgggaagcacgaggatgaaaccagtaatgtatagaatcatagcaacaccatattagcagtgatgctcttctacacagattgtatgtcgtgctgaatttcagcacagtaggcatgcctgttgttaggcattgcaactggtaggcatcctctgcgcgggccagcacagttggcaaatgtcattattctcaccgttgcaacaacatcattctagtacttataaaacaaaaacgatgtccacagaaaaggaagtgcaatattgtggcactaaaactagaagctatcagacaataagacatgaggtgagctcatggcggatagtctaatatagtaatatgaccattttttaagcggaaacaacatgaaaacattgacttcaaaatacttcttgaatcccaacagtttgacaacaagggacacatcttatcaactgaatgaggacatctcacaattggaacatggaagtagaacttgaagaaataaaataaccataccatgcaacagacatccaactggatggcagcagatcacagcttttgaatgccttcagagctggaaatctactagcaagaattgatacctgaagttcatgcagagtatgattatgtggctatgtgcataaatgtttgtaataagcatgggtgtaaacaaaaactcaccttgtctgtcagaggttctctacaaaacgggggatccctctccatatactgaaagattggagaacttgcagatgcataaccatcagcatcatcagttcgcaaactaccatttgccatcccatgtgtagcttccacggatgagactcttaatcggtcaacatcagtttcactgctactctcgctgctagcatccaggtattccccatcactttcatccccaaggcgccttaagtaagcgagaaaaataagtagagaaagttatatgctatcaaggaatcaccaagataatgaaagcaacactactgaacaggtaagctgttcctaactatcttcatggtggtcactatgcctaagtagaggtcatctaatgataaagccataaattcacagctcgccactctttcagtttaacacagatttatttatttttcttcatttatacatatgtttgtccaccaagacttattgcaaaagcaagttcctgaaacttcaggaaggcatgagataattccatctattagaacccaggaaaaccaaccgaagaaataaagttgaggaattctgtgtctaccctgtgcttgtctaataacatccaatgcataaattatttatttacatataatttggcacggctgtaacaaactgatatactggagtaatttcttattagcccagtagaatttgataagtcctgcaaacatatgaacactaaaaagcctaaataaactgaagtgaaaccaaagatacaaacaaagtgaccagctagacatgttgccatattgatggtttttctttcacaatggttgacctagtgaaggtttttcttccaaaaaggagaaattctaaaaatcaaaacttggcattggagataaagattgctacctggttcttgaaacagatcttgatggatctgcatacaactggatagcagacagatatggcacgtaatactgtgttacagagtcactgccatttagcaacaggggaacgccagctccataagcactccactccctgaaagattcccaaagatcttcaaggcagaaatatggtgatgtatttgtacaatcaccagtcctccacattttcaagcttgtctgcagaagaacaaaggtattacaaccaaaaacagcgtaactagaaccacggcaagatagctcgttacttcaataaaaagctgtttatctcatcagaacattgtacaaacatcactgcacgactcaataatctctcacaaaactgattctaatgttgttacatcctaaatctgattggcatgaacacaaaaccacagggtatgaattgtttatagatgaaaattatagctactgcagtaattaggaagttaggagctcaagaaagacacaattttccatctaggattatcctgcaaaaaatatgcaaagccccccgatagtgcttagagcatagatatagcaacaagcagtgggcaaccacagttttattgagttttaggtgacacctccatgtgttcagaaaaaaaaatcataatataaaaatccttcacttctcaaggcaacaacacttgaaaatagtttgcaccaaacaaaacaaggatcctcttcctaatttaaagaaaacttgctactacacatccacgattactatcatcaagcgtcttaaatggctggtgactatcaatcagatcttaaaatcagcagtcaagcgcaaattcagaaacatgagcccttctgttgatcaccactagaatgctcaacaagaatagttgattttcccctgaactacagtatcgaactatttcatcgatcctacaccaatgagtagcattttccctttgtagtcacgacgcactagctacacttaaaaacatattaattaaaaatggaaacagaagtatagatatcaaaattcgctcgttcttcctcatatcacccaacataacatgtctaagtttccgaaattcgcatgctgcactcctaaaataccttgggcaggtattggaagggcacggagggagtggtggaggtgagaaacctctccaaattcccactctcctccaccgccgtcacattcacgtcagccgcggtggtcgtggcagtcgctgtggatgccacggaaggcttggacgacgtcgacgaggagtcgtccgaatccaccctgctatccccgtccgtcagcacacccgcgcccaccgccgccgcagccaccaccgccggtggcgccgcggcggccgccttgtgcctccccgaccgcggggacggcgacggggacagtgaaggggacgtggggctccgcagccgctgctgctgctggcggcgggaatggggaggcaggtagaatcgttcgacgctgttgcgggaggaggaggaggtggcgccgccggaggaccccgccatggcggcggcgggaggggaagggggatccggttagggttttcggggggatttggggattgggatgcttagggttagggttttggtggctttttcccctttttttagaggagggtttggatctgaagcgaggagcggaggggaggaggaaggaggcgcaacgcaagagcggagcggacgcacgcagccacactcctctccactgtgctgtctgcctgtcttgtgtttgcttcttcgcctcccgtcgctggccctacttccattttccgggagcattgtttctcccgttttttttttctctataccgtgtgatagtgtcgaaatcaaaggaatttctaatgcgttcttcctagtggtttggttcttgggatttttcgtagcatgtcacaaaacatagggaaaaatatcttttaaataaaagcaacggcaatacagagctctaccatggatgaataaagaatggtgttataaacgctcttctgattacggtgatagaaatgagagaatcatattaggagttagcatagaaattcctatgagacgaaacgaggatgtggcagcaaggataatatcatggtaccttatggagtcatagcttcctctcttttgatttcgttagcagacctgaatatcgagtaatggctacctaacaagacggtatcgagattgaagatgggtgcgatgaggaagacgactgttaccgatttgtgggacccatataaataagaagagagatatttaaaagtggtggctaagttatttcaaagcggtatagcccggaaaataaggagttgacaaaagcgacgtagccatcaattgaacatttggcttgattgtcttgccgcgtggatggtgtaacgtgctcaattgtcatagattttaccgtatttatgtgacatcaaacatacgtacatgtgccactgctatctagacatcagcacttgtattttttttgcgtcttgttcacaaacccatcttcttcgacaatggtaatcgcaaccaaagcaagtttttgtcaaataatagaagaggaataacacaacaatactagggagtagggataagaaaaagtctgtggtaagagctgtgacatcatcgaagccattggctagataatatgtaggacatgataaagacattagaatgacacatatcttttttgaaaaatcccagcaacaaaaatcagaatagtaaagtcatacaaggcggcaaccaacggtaataaagaacaaagatagcatagatagatgttggaggtacaataagcatcttgtgtagcatagccaatgccagacgttaagaactaaggcatgtcattaggataggagcaacagtgatgaaacatgagcagagtggtcatgtggggaagcactataaagtgtaatatgttagtcacattcacatctctcgtagaatagtaataatcaccacttaagtagtacgaaagtatggatttcactgggagtagaaaaatattttgcgaactaacatatcataaaaagttagtcgtagaaaaaaatttaatcctaacttataaggtggaaacatcaattgaaatcgatggtcccatacatactacttaaatatggtttagattttgaataatcagattcctacgaaaaagaattctatatagttaagtggaacgaagaaacaactctccttattgtaatacataagaatcgcattcacttgttaaaattttgaaggatttttaacatgagattcaacatgttaaaagatatcttttgtttttccgtgctccaattaaacagttattcctgtattttttatgctttttttcattcacgggattcaagatgctaaggcactgaaattttacaatttttccatattcatgatttcctatgttccaaaaattccgtgtctccaagaaacggctaacgcatacttgtaatcagtagcaaatccttaacaatagttacataatttagctatattttgatactacccaaaaaaatcgatgaggatcacccgataccacaatgttagacatttacccaaaggtaaaagtatgttgtcaacataaatagtactccctccatcacataatgtttgacgcagttaactttttaaaacatgtttgaccgttcgtcttattaaaaaattaagtaattattaattcttttcctatcatttgatttattgttaaatatacttttatgtatacatatagttttacacatttcacaaaagtttttgaataagacgaacggtcaaacatattttaaaaagtcaacggcgtcaaacatttagggaaagagggagtattacaataccattatgtttttttttacattacaataccagtgtgttgtcaacataagagcaagtttaatagaatagctaactattagctctaattcatctatagccaatctaatagtttattcaaacaatatttatctataaacatatactaaaccattaacatatgatctcacttttcatacacaccttgtgttggagtccatagtagtatgttttccttctctcttttttttctctcctctacatatgtttaatagttgacttatagcctgctattgcacttgttctaattcaagtcttcatatactgccatgatttaccagaagcagggggagctttcgggaaaaagaaaagagatgatcacagccagcaagttccaagcaccagtgcacgaccacacgaccatcggagaccgtgagcagtaaaaacagatttcacccaccgcacggggagtgccgccgtcaaagtggctgtccatcgccccatcgccagcggtaaaaaaagccgcgaatacgggcgacccatgccaatggcacacacagacacagtcactcacacggatggacggcgacacgttcatgtggccggccacctctcgcatgcatcgccttgcctctcacttgcccatcctttcacctcgttcctttccaaatccatgcaaaatctcacccggagaaagcaacggtctccgcctcccccctgcttcacagtttgtttccatatttggtactcctactcctaccaggagattcttcgatggatgcatcatcatcacttggaatgtagcactaacaacaatgccactcactccctcacttgtcaccatctcggacacagcaaaggggtgtgtgtgagttgtttttcttcttattcttccacaaataatgaggtatccacaacatcagcaaaaatcatgagctcttgctgtcttgcatgacaacaaaatggaacaaaccaaccaccaggatcacaaagatgctcacaaaaacataatcagcaccactgttattagtattagtgacaccaatccatatcatttcttcaacaagacaaggaaagtactaagcagcaatcaaagaatgatccatccattattgtggcaaccctctcctctcaaaggagaaaacacaccaaacacctcttgtcaaagcctagaacatcacaacaccatcccatccattcctagtaaaagctactactgctgctagtacggagtagaggatagtagtaacagcacaacagcgaagaccctgatcacgcctgatggagaaacacaggaacacctgggtgcttgacttttccccttccaggaaattgcacggatgttgacctgactatttgggctcacaacacctgaaaatagaatgatctactagttgccatatcattgctcaaaaccaagagctaaacatagcaaaacccaacagatctactagtatacaaagcaataaacggaaacaaaccatccatgatcacatcattaacaacagatcaatcaacagatacaacaccagcacatcatagatccgagcagcacaacagccacgggagaacaaaccacaagttgagctgaataatcaaccatgctgtcatcatcagcggtaagtaaatcagtcaacactgtgtgcagatcatgcaataagagacacctgggaggcaaagattcttcagctgaaaaactgcattacttggtgcagatccaggagctaatctcttgcaaagaacaagagaaagaagatggatcataagctctttcttacattgcaacgttacacgctctactaaaaacactactagtaacattacagctaggcaagaacaagtaacagtaacaggaagaacagcagctactacatcatcatcatcattattaacttggcttccactttgatcgaactaattagctggaaaaactaagcaggggagaagaaaaaaaagggtagagatctgtctagtctctcccggttgagatcatgcatgttaagcaagcaaatcactctttcccatggctgcctcctttcctctgcttctctctctcttgctgttgctaggtgggtaggtaggtagggtggtggttcaggcgtagatgactccggaggagagggccatgaggaggatggccgccttctcctcctcgccgaggcgtctcctccgccgcatccgccgccgctgcttcaggaccacctccttcccgaaccccaccatgcggagctccatggtcacctcctcccctctctccctcttgctcttcttcttctcctgccgctccgcgccgccctcgccggcgtcgagccccagcgcctcccgtctcttcttccggtaccggatcccgcacgcgttgcacagcgactggatcaaagcaaaaaaaaaaacacagatcgggcggatcaaccaccgaaaacccaggcgaaaaaaatgcacagatcgagaaagggaagagcaggaggagcagatcggatctcatctcaccttggggccggaggggccgccgcgccagagcggagtcttggtggtgtggcagtcggtgcacgccttgggctcgccggaggccgtgcgctcgtccggatctatcgacccactcccctgcaacccacagatcgagcgtcaaaaaaccacccagccaaggcgccattccagccacagatcgagccccccaagaacccacggatcggaagcttcaccttctcgaccgacgaggaatccatctccggcgccaggatcggcggatctaacaccccggaagccgcagcactccccctcctcccacacctccgctcagccgccgctccgcaacacccgcgcacaccgcgccgcagacacggctggtgctctgccgccgccgctcgatccgcgggcagatctccactccacggatctactactaccagagagagcaatctagctagcaagctagggttagcaccggctactgggagggagcagtaggggttaaggggcgggagaagcaaggaggaggagaagaagagggaatggtggtggtggaggatgaggtggtgagggtgagaagaaaaagggggagggatttggatttagatctcaaaatggaggagggaagaggggagcgagtggagggaaacagaaaaccatggagggaaagctggtgaaattgggcgcgtttatgtatgcactacacacacactctactctagggttgtttctgttctgtctgaggggtttgtttggtttggttgagtgatgatgatctatggaaggttttagaacaaccaggatcatcgtccatcacctgaaggccacgtgtgttagtgtgtctaataattttcacttgtgctagcacatggtttatttgataggctcgtgttttactatgctgttgtagtgttttatttgaagatatttgttgggcctataaacgatagtgaagttgttaatattgatatagattatttaacggctagcgacatgatatgaacagaaataagctacttataaatttatacatatacagatatgatttacaagcgtctatttaaaatatacttaatatagtacaaacaatagaaatatgcatataacttttttctaaaatcaacataaatcaatcaaattcatcatgaacttttttatggacaatggtcacagtaaaaaacaaatgccatctactggagtagtagtatgagagttactctgacgattctttttcttcttcttcttcggctatgtttagttccacgctaaaattagaagtttaaagagattgaaacgatgtgagaaaaattaaaacatagtatagaaaaatttgatgtgagaggttaaaagtttgaaaacagatccttcttcttcttcttgtgtcgcaagcaagcaagacaagccatctatagctcgtacgaggctataccaggcctaaccaggccgcggcggcggcagttctcatctcgtctcggcgagtccactccaacactccacttcactcccctccaggcgtggcgcgcgcgtgtgcggcgtaaaggcgtcgaccgttgccgctggcacgcccacacacgcgcgcggccgcaccgcatcaggccgacactagaacccaaaaaggcggcagcagcagcagcaaagcctccatccgctgcgcggctccgcgcaccggacacccaaccgccccggcgcctcgcgccgtcacgcgcgcccacgtggtccccccacccccgcgccgctgtttgctgctttgcgaaaatttacgagcccgacccggacgcatccgcgggaattccccccgcctctgcgcgcgtcgtctgcattgccgcgggaggtgaaatgaccgctttgccctcaccctctttgaccggtcagaacggcccggccaatctctgctcgggctcggcccagtgagaccttctagaaagtctctctctttgatgggcctaactaggagcacatggtactaggcccagcccatgggcagcaagaacatctcgggggtataaaccctagccgctcgtgccaccgaattcctccggctccgagcaaaaaccctcgtcttcctactccgatcgagaccgcgtcgccgtctccgagatcgccatggccggcggcggcgacctccagagcccgaagaagcggaagcgtgatgcggcggggaagcccaagacgctggcgaaggggggagacgacgggaagaagcggaagaggccctcagatgccaacatggcgcaaggcggcggcggcggcgaggtcaaggtgaagaaggagccggttactgccaaggagaagcgcctggctgctaaggtatcgttgttgctcgtccgctcggtaaattttaatcatctctggagctggagcatgggttcgaggcattagcgctgaacttggtgtggtgtggattggtcaggaaatggcagagtcaaggaagaagaagaggaaacggaattacagcctcgagaaggtaaatttggtccctgtacgatctatttcaacatgccgggaaattcatgcctattgacttatgagccagagtatgattccaggaccaactctcataatgctaggcaattggaacaatggtgtgttcagggttttattttttttaagatatattctcaccaatatattctcacatatagagcttatatgttcacgaatttcattagaagagtttaattttcgctgcattagttgaacattgaataaggggaacctactattttcatggtcatgtgttatatccaatcttgatcttcactcttggaactatatgacatgaatgcaaaactgtaatttgattctggtacccttgtcactggtggggatacttagcttcacgagaatagctacattgtcatatttctctctactaacagtaagcattgggtgtcaaatttatgttggtttcattcgaatctagtttactgattgcatttaaatattgtcaggagcttactgtactatgggaaaagatgcgatgccacaatgtgagcagcacggagagatctaagtatgcattacatcattgtcatgactcgtatctttgagatcttacagtgacaaatcaatttattatattgatttttttctcaaaatatccaggctggtaagtgaggctctccgtaaaatggatgggaaatattcagaaattgctggttcccacgtaactgcacgtgttttacaagtaagatgatcaatcgatcatattcatttgtatatcaacatgttacatggttttgatgttctttttcctggtgttgatgagcattgtttcttttggcagacatgcgtgaagttgtgctcacaatcagaaagggatgcgatttttgaagccctacagccagatttgctaactctctctctcaagaaatatgctgttttccttgtaaagaagctcattaagcgaggtaaaagctctgttgggttcatacatgataatatttctttatggttggatatgccattggctccattaacatgcctgtatttgtgattgcagccactaaaaagcagtttgaatggttcatctcttctcttcacggtcgtgttgctaaacttcttcgtcatactataggagcttcaggtatatattacttgttattgtaagagatggcataaaacttgctattttattatcatttgttaggaaccttaagagttgatagttgtgtgcaattcatgtgaatttgtttgtattttatctgtacatgataaagtaaatgataatttaatgttatgccaattctttttctttcagtcgttgactttgcatatcaactggcaacaccgcctcagaaaagaaggttgctattggaattgtattctactgagctccagctgttcactgacctgactggacagaaaacccacaggtcattgcactaaactaactcatgtttctgttttcaaatttccttgctcttttgattgttctatatgctttctgaaaaaaagattcgttttcactatagatcaaacaactgtctgcggtaacaggctactgcaatttgctaacttaaactccctttttcagtttgttagagacaatttccaaccttggattacaaaaatcatctgtactgcagcatatgactaccgtgatttatccgatcttggagaaaggtatcgttgaatatcctatagtgcacacggctgtattggagtattttacaatcgctgacaaggtaatgctatccatttattgtgtagcctatctacagtctaaacatgcctttgttggcatatcctttccttttggtttgtctttatcacactgtcctataatgcttgattttgcagacctcggccactgatgtgattcgacaatttatcccccttcttacacaaggatcatctgccattgatggagatgagccatcggttgcccctgaattacaaaagaaactgaaagctaagaaaaaaaggttgacagagccacttcttgttcggattatgaacaccagagaaggattaaaaataggagttagttgcctcaagcatggaagtgcaaaggtaggttatatttttttttctctgagactattattttatgttgactccataccttttcttatgggacactgaagtagcatgccaaatgactacccattacatagtccttcctctgtttttttcttagtgtggagattatcctcataattaaaatgtattcggcttccatgtaagattccgttaactttgtgttgaacttcaggataggaagaagatcattaaaagtttgaaggggcacattatgaagcttgctcttagtgattatggatgcattgtaagtatgccagtgtttacatttgcagttaccgcttggtgaaaacaacattatgaataaaattgttatatgtgaaagaacttttttgctaccgaagatttcagtttattttgtgctcaaatgatttatactctactgatatgtcatcttttccctttcagttacttgttgccattctttccgttgttgatgacacaaagcttgttaccaaggttagctagctccagtcttctatgcacctgttctgagtattgtgctgtgataaatatcgtatggagcatttatataacacttttgtttgatttgatagatcgtaattcaagagctcgccaaacatttgaagcaacttatttttgacaaggtgaaaaggaaaactgagcttctgatatttttcaaaataaatccacaatgcactaatagtaatgaagcttcttgttggtacagaatggaagacgtccattgctgcaactacttcaccctaattgttcacgctatctgcctccagctgatctggcttgtctgaactatcgtgtgccttctcttatttcaaaggcaagctagctattctgtttagtattttaaggagaacatagtgaagtgctgtgttataaatattccacttttggttaggatgaagcttccgagagtgctgcagaagatatcccagagaataaggtggatgttgcaactaataaggagcaagatggttcagaaagcatgcagagtgcgtctgacagcaaaaaggacccatttcaacggcgacatgaattgttgatcaaaagtgaacttgccgaggtgacatttattcagtgctatgtttattcaaatacagtgttaaaaggatgcaccttttcacattgattactgcagtagggtacaatatgatttctttggtgctcgtttagtcgcaagcagtagccagtcacagtatgtatagctacatgcccaccatgtcctaaaccccataataccaacatgcacagcattttgtgtgctcacgaatattattatataaatgatggcaaaatggtccattagggattttcctatgcaaggtttcaagtatgtaactggaaaacaacacttacaataagggtctactgtattttcttgtgtgcccactattttgcccaattagtgctgacgtgacaactaacataagttaatcgtgatgaatttactagccttgctcataggcctttctttttgtgattattagatataatatctagatgccatcgtggcagcatagagttacttgtgactcaaagtattgaatatgctttatgtggatttaatataatgcagaccttcctgatcttttctcaggtgctcatccagactctcattgagaatgtcggggagttacttcgaacaaattttggcaaagatgtattgcatgaggtgaactacttttgtccttgcagatggtgaaacctgctttttattatatgctaacaatttttcatgtcataacctcattggcatggcatgatctttggctggtactcttctttccgtgaatatcggtcacttgtttactgaatcatgtatcagggaaatcatgatttgaataagttgcaccaagaataccctttcgtagtatatcaggcacaaacgagttagtgaaatacgatacacagtcataatctggaatattgaagcaacgtgtctttgccaatctgcggtgcttgattgttgtcattgtataaataatgtttcataagtgccactggtgtcactctgatatgttgacatttgcaaatctgaaggttgcggttggtggagaagataatattctggagggcatcactgacaggatccacagcttgcacaatgcaatagcttctgatgcagcacgtccaaaggcagaagatactgaacatgcctttgataactatcattccagccgtctaatcagaagacttatacttgaatctccagcatttgctgccatcctatggaaaaaagctcttgaaggcaaatgcaagacatgggctgatgggcacaggtacctcgatttttattgatatgaccctctcgcctcttctcatgttttccaggagtcacatatagatatgttctattcatcggatatttataaaattcaatcgttgattggaatttgacaccagtccctttaggtcatattccggtggcattgtctaatttatcatgcatactgtaaatttctgatattctctcagcttgcttgttctgcctgatgaacattttggttttgatttcttgatatttttattcagttccaaggtggtcgcagcattccttgaatcgcccgattccaaggtaagggatcttgcaaaagctgagctgcagccgctggttgatcgtggcattctgaaaatctcagaccataaagcagtcgaaaaatgagttttgcacctgacttccaagcatctacagcaatacgagaaatcgacagacgaacatccgtgcttctgtgttggatgttttttttgtaacatgagtatgttctgcggagcaattttgtcacctgttaaaagagtgtagctactgctgtcaccagtgagtgagtattaactctccgtaatgttatgtacctttacagtaaaattgcatttattttggtatgactgcaagatacgaattctccggccgtgtttgttctgcataggaatgcgattgataattttattgacaactgacctgaacaaatcttggagaaaacggatgccttaatcatagagttgtcatttttaatactagaaaacgatttttgcaaaacacttacaaatgcttcaaaacctgggcagtatttagagcagtatttagagcaggtacaatagtaaactattagccagctataaacatattttaatgagataaaaaagataagagataagagcagcggactgtagatatgtagctagctgcagcacgaacttcaagacgcagtgtgtatatgataggtgggatcgtatattaatagtatagttagctattagattgactatagatgaattggagctagcagtggacagtggactatattattaaacttcttttagtgaatttcactgttttcctcttcttgttgccgtaaaatgaactaaagaaagctaagcaatctgaaaatgtaaacgattctttgagagagaatggaagctaataaatctgcaatgtcactagcaggagttcgtccgtcaccaatgacgctttgttcttgcggcgcgctccggcgcggttctgatctgatacaccggcgactcgccggcgccgctgccgcaccatctctggttccgatcggcggcgaggttctcctcgaaccggcagaactccgcggcgaacgccggcggcgggggcgggcgggtgtccgggtagccggggaaccgcagccggtcggaggggtcgaagagcgggaacgactggcgccgccgggcgccaccgccggcgttggccttgaggcagctgtcgatgacgcggcactcgtcccggagccggttntgcacctcccgcagcgcctgcgccgcaacgggaatcctcctcccccagcagcagccgccgcggtgcttcccgtgctgcgcgccgccggtggccgtcgccgccgccggcgtcctcctctccgcgcggtgcctgaacctgtcgtggcacgcggcgcagtagctcgcgcccgctcgtcgtcgaaggctcgccggcgagccccgtcagtgaggcacgcgtgcgcctgcacacgttacacgatttgatcgtcgcatcaaaagcagaaaccgcaacgaaacgaaacggtttttgcagaattagtatactattacgaggcagtaaaaactgtagcaaatcaccacgtttaatcactgttacgttaaccacgaggattcaaagtttcaaatcgatttgaaaacgccgctctgtgggcgaccaccgctgcagtaaccgatggtggcggcgatcgaaaattgaccatatctccaagaagaggagcccaatgcaatgcaaccacccactaaattgaaagcaagaaaaaaggcaaagattccaagccatcattaggaagaagaagcatgcggaggcagagattaccaacctcggagacgatcttgaatgcgacctccgcctttgcgtgcgtgttcttgtccgggtgaagctgcagcgctgcatgcaaaccaaaccaaatcaaatcgaaccaaatcaaaatcaggtaatccgattcagggcattgcattgcgtcgcacgcaccgagctggcggtagcggcgcctgacggcgtcctcggtggcggcgtcggcgacggcgaggacgaggtaccagtcgacgaagggcggggatcgctgccggcgccggtgcgtgcacgcggagaacgccgccgacgccgcgcacacctccctcaccgcctgcgccttgctaccgccgccgccgtccgccattgccattgcccccaccgcgtcactcgatccgcttcacctccacggccatgcacattcgatcgatcgatcgatcggccgcagtgagagccgagccgagcagtgcaggcgtcgcggcgagatgctaccagttatagtaaccgtgtccacttcgtctctgcgtgtgaggagtggagtggcgagacggtaccgttcaaagcagcgatgagaggagatctcgaggggggaattcaacagcgcaaattgcggccaagcgacaaaaatcagaatagggaaataaaaaaaacaaaatgatttgatttaacacggatcaattaaattcatcacatactactagagaaatatttatcctgttttttaataatatatcttattatcatattactctctctaataataagtatttgataattatgataagatttggtgaaacttctacaattccgatcatcgataatttctttctcatattgttggttcaaagattaaataaattatgtacgtatatttgacttaaaaaagactatcgtaatttaataggtccatttatggatctatatgctttgattggaaccaaaagatctagaaattacagtcttaatagattttgaaaatttattctaataaaaacttcaccaaattttctactccttccgtttcatattataagttgtttgacttttttcttaacaattttttttagatttgactaagtttatagaaaaaaaatagcaatattaatgatatcaaattagctccattatatttaactttgaatatattttgataccatgtttgttttgtattgaaaatgttattatattttactacaaacttaatcaaacttttttaaaaaagatttaaaaaaaagtcaaacgacttataatatgaaacgaagggaatacttaacatctcatttatgggagtatcttttatggtaccacatgttagtctctctatattatcttccgatgctctccttgctcgaatgagtacatgttgtatggacagagggttgcagggatcaaacaagtgcagctcgccgacgagatttggtgtttgtcctgttgctgtaaacgtccaatgttttaggttggccatggcgatcaaagtcctgatgacaccgaatactgatctggaaatggaaatgcagagctgtgatcattcagatttcagagtttcgcatctctgatgatcgtcatctgaatggaaccagtccctgtttcttggactaaacttctcacataatccagttgcgccaaacattcagctggatgattggctttcaggttccgattgttcacactgtcactacgattggaagtactcgtagtataataatcaacaaacaataacagtatattatggtcttacagtttcagataataaactccggttgtcagtcagtcgccatttcaacgagactgaaccagaaggttcatactgaaccaaacatttctcaataatctgaactgtatttctgtaacatttgtcagccaggcaggattagtttttccttgagccgtgagaccctgacaccagtggctatgtcgaattctcgatcgattggcaaggctagtactctactgctacttgacaaatgaattcagtcaaaagagagagttgcttcgagactttcaaccagaagcactgtatcaagttaggctgctaatgcatcggttgccgatgcaagaattttgtccagtatacttggatcaccacagaatgccaataaaagaataatattttcaatgagcaatgaaatactattttcattttgcaaagacctgaagaacgactgaacacactagctaaacacgaaccctatcttttcaacgttccaatttgcgacgccaaacacaagcaacaaagaatccaaagctgatcttggaacagtgtaaaaattttacacacccaaccaattgctaatatgagagagcctttggagtaattgtggctgttcacagctaaactcaaatctgatgctagaataataaagaagacatattgattattgaagcgtagctcgcctgcagcagcaatcagacagagctaaactgctataaacagtttggtggctgcagaatgcggctaagattttcgagcttcatgttgcgatgatactcgaaagatcatacggatatcctcccagcaccatctggccgtccgtagcttgatccaacggctcggagagaaggagatcttcttcttggaaaaaaaaaacattcacgtgccactgcatgtgggccccacagctcagggctccaaactctcggcatcttcccacgagggtgccagcatcatcactcaccagtcaccacggagtaaaacccacggcctcattgtccttggcgccctcttacatgtgggcccagtggtagaagcgggcccacatgtcggtgtgtgtggggagtaatgggtgagaaaaaacccgtggtttttttttcttcttggcagcaatcatttcggtggggccatgtcgagctgaccaattggcgcttccatgtgatccacgctgtcatcccgggcccaccagctctcccttgtcgataagcatccggagctcgctgctgttcttgtttctaattgctggtttctaccagggccttttagcaaaaggggacaaataattaatcctactagcattttgtgatcttgagatccactgttttgtttggatgattgaccgagcacgaacgtaaaaaagactgtgaggaaagcaaattgtactgtacttatattcaataaatccatttttagagatcgttttacaatgcgaaattgcgaaccgagagccagaacattccttgaaaattagtagacctatgaaacttagggaaaatgcttccctttttttgtttggggaaaagaaaatggatcaatccggtaaataacatcgcgcctgcaatggataatttatcgtggtgatgtcaaataaaaatggaatagcgtttggggttatgtcgaatttcctttcattcaatctctatcgtaattggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttcgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaagtagtattaaatggaaaaaaaaccaatcacacagtctgcatatagattacgagacgaatcatttaagcctaatttgtgctatgatttgacaatgtggtgctacaaacctacagtaaacatttgctaatgacagattaattagacttaataaattcgtctcgcagtttcttagcagaatctgtaatttgttttgttattaggctaagtttaatatttcaaacgtttatccatgtatccaatgtgataactaaacctaaaatttttcccaaactaaaccgtgccttattttaaaaaccacctcacttcacttggggggcaagttgcaagtctcaagtttacaaatccacccctttcacaaacaaaccgaagcttcttctccacttcgtcccacacttcaacgcctcgcgatcgatcgccccaaatccccgccgccgccgccgccgccgcgaatcgccggatgcccgccgccgtcgccgccgcgggggcggcggcagcctcgggcaccgcgctgctcgcctacatactcctcgcatgctgccggccgcagccggcgccggaggccggcgaggaggaggaggaggagtcgcggctgttgtcgtccggggcggaggcgcgggggagggaggcgggggatggcggcgaggaggaggaggagtggccgtacaggccgccgtcaacgtgctgcgaggcggcggcggtggccgcgcgcacggcgcggcgcacgtgggacctcaccgtcgggcgctggggcctccacggcatcgccttcgggatcaagcgccacatgaagcgccaggtccgcgagatttttcgcatttcacctcgtgattcctcgctcttgtgcgcgattactgcgatgctgccagtattcagttcttctgttcgtttctgtgtctgcgctttgcgtttcttacttgcaaattgaggatcatttcgctcgatggctttaacgatagcgactgatcacgatgttctaactgcgctcaaatcgcactgagcggcggaacgtgtagttgctttgcttcgagtggactttttcttcgttttagttttactcttgctgaaaattttggtgtaaaaggcaggatttatgactatttcaaggtttgacttgatttgacttgcaagtaagactgcttttgcctttttatttgggaaataaaggctcaatgttgggtcagtggcttacaatagcttcacctctaccactaattcaatacattcctcgtacttgcaatgtcagatcatacttaaattctgtgcgggacttaagatcgttgatgtaaatatgggtaaatctcatggatccgtaaggtcggattcatggattttttcagagtcaagctggtcatggtggtcaaggtctcctctagatgttgatctgaagtgagaaacgtttccaactgttctgaacttctgataaccaatcgatatgcgttttatacagagctggttattttgttgcgcatgtgtgaatttgctagaagaacaactaataaaattggaccagaattctgttgtcttgctaaaactaaaatggttgctcaaagaagaggaaacaggacgcactcaacattcagttcaatataatgtactctgtttatctgcagatgttctttgcaaagctattcaatgcatcaaaactcaataagatgtacttcccgtgagtgaagagaagctggctatccgatgttctgatgaatcagcataactagcattttgttctttaagacgtaaattcggcggtagtagattgtttgctgaagcaattcagttatgcagattataatcagcttggttctgtatagctgtcttgaacatattacatagtcaatggtgtggaatcatattgtgactgtattttttcctgtttgtgtgctctagggtgatttgcagcatgagtatagtggaaatgattgccttcaactaaaaggtcacgacgcacacactgaagtagcttatctacttgagcacttgaagatttgcatgttctactcaaagaaaacattttcagcgtttcttcagtttggtgggtacaatcaagaagacattcttattcacaaggctagggcgagggtgagtaagtatcactgtattcctcttatctcatgcttaaggtactcacatttacaatttgtatttgttcctccacattttgactcactcttaactatcaacttgatgcagcttatgcaaccttctttcgcgcttgtgtgtgacaaaaaatccaagtgctttctgcttttcattcggggtgctatcagtactaaggagcgcctaacagccgcaactgctgctgaggttccttttcaccatatagttttaagtgaaggacaaatcagcaacgtggttttaggatatgcacattgtgggatgcttgctgcagctcgttggattgctaaccttgccaagccccatcttcacaaggcagtacaagaattccctgattatcaaataaaggtatttcttattagtgctatgcatggatgaagtgactacaatttataggtgtagccgctgcagtgcgctgtgatctatatacatgaccttatttgaaataatttgtttttgataaatatcactgagacagttaagaagcgtaatcagatctctccttttgtcttttatgtcatgtttatttttgtgaagatttctgacccaaattatgtctccttatttgtcatttgtactaggtcattgggcattcaatgggagcaggtatcggagcaattctgacatacattcttcatgagcatcatgagttctcatcgtgcacgtgtctggcatttgctcctcgtaagtgacttattcatgatttacatctttaaagccacactttgcttagtttttgcattgtgccttcgagatattatatggctttatgattatcaggtgttttcttatattattttcctgagttgtaactttgttctgtttcagtacttaatgggtgacaaaagttgttttggcactatgttctcatgatctcatccatgccaactgtttggttgaacgttcttgtgtacaatttgcattattggacagtgatggagaattagccattgttttatacagatatgatagaattgcattgacttgcaagatttattttattaggctacaagttaatccaggaactgagacagttatactattttctagatttaagagaggaaatgctttcagatttttaaagggttcctgttttgtatagctgcctgtatgtcatgggagctggcggagtcgggcaaagaatttgtcacttctctcatcaacagaaatgatgtggtcccggccttttcaaaagtttctgctgagaacctgcgagctgaggtactctgaatttctgatggccagtgtcttatgtgtcagcataataaaatcagaccttcactagtatgaacttcttttgtaattaacaaggaaacattttaagaacttagcaaagtgttaatacattaatttcttgtgatatttcaagaaatatgtgatgcaatggagatcttagcttcaaacttgaaatgttaacctcattggcatactggacagtggccatataaaatttctgataaattgtgaaaacgaccatatacctgattcccaacagtgttctatcatcactgatttttttgtctctactgcaggtaatggtatcatcaaagctagatgatgagcaggatcaagctcactttagcttatttacggcaataagtaagcgtgtagctttcataaagtctcatatgctgtcagtatctcatccaacagagaagaacacagatcctgattctagcatatctgaggtaatacctcttaggcactttaatttctactatttaaatgattgcttctgtcacttgtcactggatcctaaactagcacaatgataattttgcgtccttaagccacatgtgaacccagcacgagtattaatttgattacccagcggttttaatgactgttaacagctgatccagcgatcctttctagcatccaatcccaatcaacaccgataacactgtggcgggcatgctaatattatctgttagtatactaggtagtaggcatatctttggtacggatgattttccttccattggccatacaagcatcacatctattacaaaagggcaaaatgagaatttccatcatgcacagttcctgcttctccgtgcagtgtaccttccaaaaatttacagaagcaaagtaactcttgggtttactgattagtgccaacgtgagtacagaagcaaagcaacgagaggattgacgattttctgacaccctatttattctgtcaatgcagcccttgctcaaacatgtccccgaaatcacgcagcctgtaacaaatgggctaagcacagactgcaaccagcatcaaacggacctcgttgctaatacagagcaggacttttcagctgtatcagttgttacctctgaagaaaagattgtactatctagcaacgataatgttatcagtacaaagtctgttgctggatcaggctttgcagcacaaggggatgtgaacatcaatggatcactggacactgaacaagaacaatcatccttgacagggcaggaggaaccagaatcactgaagcagaactgtgatatcaaagacaagctgaaagaaccgctaccaacctgcagttcgcgccagtttttccctcctggaagaattattcacatggttgcaatggcctcacctgacccaaatcctggtgagggatccagcagcaatgagatcattagcatttatgaaacgccaagagatttgtatgggaaaataaggctagctccaaacatgataaaggagcattacatgcctagttacataagcacaatggaatcattattggaacagctgctcaaagacgataatgtagatacaataacaaatgatttgtaaattatgtaaaaactcaataaattattaatccaattctttgcaaattgcattgttctaaaacaatttccatatgcctgcatgttatttctgtcccaatgctactctgtatatataccactaaagctaaatttgcatggtcaaagttggaaccattccgttgaccggatgacgtggacatcctccgtacggttggtctctcatgcatgcagctgtaaatcctctcggcctcacgctctatatcatcactttcaagtgttttcatgaaaacgaaaatttagctcgccatcacgcagatcgacatggctgctgcttctctccgtctggtcgtcgtcgccgccgccgtcgcgatctccctccggggcgccgccgccacggcggtgaccgtggaggacgcgtgccggcacacgaggcacgaggcgtactgcgtgaaggcgctgtcggcgaggccggagagcagggcggcggcgttggacatgccggcgctggcggaggcggcgctgtcgatggcggcggagagcggggcggcggcgacgtcgttcgtgaggaacctggcgaagatgcccggcggcatgccgccggagtgcctggaagggtgcgtggcgaagttccaggaggcggtggcggagctgaggcggtccgaggcggcgatggaggtgcgccatgacgccgccggcgccaaggcgtgggtgacggaggccagggcggacggcgagacgtgcatggacgagtgccggatgacggagggcggcgccgccccggagatcgccgacaggatcgacgagctcgccaagctctgctccatcgccctcgccctcaccaatgcgtccatgagcaaacatccgtagcaaatcatcgtgtataacaaaaacgagatttggagggggagacctctatccaaacatttattaaaaagaaattatgagcgtgttaaagattgaacacgagatctcggaatcgggattgaaaccatataccctttaccactgtactatcatgtgcatttcatgtatcctcgtgtatatatacgaccaccaaattctctcttgttatattcatgacttgagcacgtctcattgcaacgtttcaaatttccaacaaaatttatgttggacacatcaggctatgtaaatctgccaaatttcaatttcaagagtaaatattgtatttatcatgcattagcttgtgaaatagatggtatcacctatcacgtaacagaccaaacgggctaaaaccggtgacgaatgtggtacgattcgattggtttggaattttggatgctgagtgagattcacaaaaggccagaaagggctgagtacttagaatcatcatttttacagttttcacacaaaatcaatttaaatcctacaaaaactatcccaaaatcctataatccagatgagccgaatattcttggatgggccgtggagactattgcagcccacagtcgcccgtcccactttcggaataagttcatctgaggtccataaacttgtcaacgaatccgattttagtccttaaccccaaaaccagatacaacgggtccctcaactatcaaaactggtacagataaggtccttctgtggtttagatggcagttttggctgacaaggcgcctgcgtggctattttgactcggtcttcatcggacatggcactgacgtgacgcttatgtggcaattcgatatagaaaaataataaaacccgtgggacccacatgtcagttacacaaaaaataattaaaaaatagtggggcccacgtgagccccacatgtcatcctcaccctacccttcttcctcatctctccctatctcccctctcctctctttccacgcgccattggacggggaggttcggcggccggtggcggcggcagcgacgcaagagaaggggcggccggctgggttcctcaagggcgacgacaacctggacgacgacgacgacgactgcggtggcgggagcgttgggtgaagggggcggagcggggcggccggcgcacgcctattaacagtgaaatttggtaatcggcaaagacgtcatcggcttagaatcattatctgctgcagcatctcggaatcagccgatgggagttatcaagtcgccaatagtcggattcctgctatattcggttaaggaaatcaatctactaaaggatacttatccctaagtgaccgagtttaaagaggatgcggcatggcagtttatctattaattaggaatagtttgttagtttccttttatctttaggaaagtgtgtccgataaggactttatattttccttttatctttaggttagtttctttcttgtccgacaagggcttgtatcaacccatgggtataaatatgtacacccggggtctatgtaatctatctccacgatcgatacaattcggcgcatcgccaccccttttaccttttctactttattttatcgtctggcgggacttggcacccgacgcggggctgcatcggtgttcgatctccggcttcgatctccggcgaaggggtaagtccaatgtttcgccggtccaggcaattgtatcatttatgtcggcgtcgttcaaggctgcactagtacattcgacctcttggattgctctggtttggatgatatatttgcctacctatttatcatatgtctctgttaatctagtcttagcatatcaatttagctctatcggctgcttctcgttttagggtttttgccggtattagctaaatcgtgtttctagattagattagcttagacatctaccaccctgaaaactcagtcaacggcttgattgtctagatataatgtttcttttcatacttagtgctgcatcagttaagtttgatctactaagtcgtgcttagaaccataatctctagcctgcttcttgattgccaataagggtatcatcggggttttagccggtgagttatctggacgttgcatcggctcataaggattgtatatacatataagttggatttagcgatgacaacaaaggtttcactgtttaatctaatcttgtggatttcatgacatcggacctccagccgatgtgtgctttaaacctcggatcgatgcttatttatcatatcattgctagccgattggtttataccggattatattgcaatattatattatcatcagccgattgcctttatatcatcatctacattggacatatagccgatttatcaaaaccctatcgctatcggctggtatcggcatcggctattatcgactatcggctggaactactctatcggcttgtcagccgatcggttgttttgatctactatttgcatatcttgtcagttgcaggatcaaactgactggcacgcccgcatctcaccaacctttggacctgcacaggagttaagcagatctcctaggccggtgtgttcgattttttcgtcaacaacgccggattcctcaagggtggcgacgacctggacgacgacgacgacaactgcggcggcatggaagcccacgtgatcctcccatgaggaacccgcgcgtgcgccggccgccccttctcttgcgccctccccttctcttgtgccgccgccaccgctgtgccgccggccgccgaacctccccgttccgtggcacttggagagacaggagaggggagagagatgaagagcggggagatagggagagatgaggaagaaggatagggtgaggatgacacgtgggccccaccattttctaattatttttttgtgtaactaacatgtgggtcccacaggttttattatttttctggatcgaattgccacgtaagcgccacgtcagtgccacatccgatgaagatcgagtcaaaaatagctacgtaggcgccacgttagtcaaaaccgccatctaaaccgccgatggaccttatctgcaccggtttttatagtcgagggacccgttgtatctggttttggggttcaaggacgaaaattggattcgttgacaagttcagggacctcagatgaacttattcccccactttttcgatccccctggcatattcggcccaagataacccgatacaaaaaaagcccaagagtgtgtgtgtgtgtgagagagagagtgagtctgatttgcttcctccgcgaaccggtcgtcttctccagcgagacagccgccgcagaaatgggtgggagtcagctcagcctcaactcacttccgctaattcgctgcatgcaagctctcccacgtccatggcggatcccgcccgcgcatctctcgccatggcagcattagcacgcctcgctcacaaaacgctcccgaccacacgaacccaactcccgctccccaccaccatatatcgctcgccgcggtgcctccacccatgatcctccatcgacgacaatggcggcgacacgcggctccgtgcggctcctcctcctgatcctcctcctccgccccgccgcggcggggagcccactgatgatgacgtgcgccaagacgccgcacccggacgtgtgcatcaccgtgctgggcgccatcccggagtgcaggaacaccggcgacccgcgcgtcctcgccgagaacgccgtccgctccgccgccaccatcggcgcggcggcgggcacgttcgcgcgcgcggagctcgacatcgtgaaggacaccgacatgtggcagtgcctggacgagtgcgcgcaggacatcgaggaggccgtctcccacctcgacgacaccgagggcggcgtcgtcgacctcgacgccaagttcaaggacgtgcggctgttcatggacgtcgccgagagggacacgtggtcgtgcgaggagagctgccgggacgcgccggactccaccgtcaaggccaccctgctcgacaagaacgaggcgttcgagaagttcatgcgggtcaccggcgcgctcatcgagatggtcatcggaacggccggcgagccggcgccggagccgtcagctgatgaacactcggacgaactaataccggatgtccagttatgatcaattcataatgtactaatcgctcatgtgacttctcatctccatttttgatcgatcgtgttcaggtattttgattaggttaattaagggcccgttcaatttgacgtcattttcaaccataccattttttttaaagttgtcaaaaaaatgtctacgtttagtttgctactaaatttgataaatatataagaaatcctgccaaaatttggacaacattatcatcttgccaaaattttgatattgccaaaatttggtaagatttattttggctacaatctgaacaggcactaattaattaattagctcttctaattcgttgaatgttttgtttaaccatcaataaagtggttgattcgttcattagctaactaataaatcatcagattataatctttctttgtcatatatgcatctctctctctcccctctctaagcttgagtattctatagtgtcacct

SEQ ID NO: 74863 - DNA, 5056 bp, Oryza sativa
tggctcggctcggcctggcttgggcgcggcttgggccgagcggccggcccaggaggagtggagggaggggaggcccgggagagagaggggaggggagggagctgggctgggagggggagagaagaggtgggccgggaggaggaggagaggcctgggagaggagggaaagagagggaggagagggagactttgggctgggcttggcccaaaggaggaaggaggatttatttttagtttttctttttagtaaactttgataattgtttttgttgcttaataattatttccggtgctctgaaaattgaagtaaaatttgagggctctttttagaccacggagaatttaacaaaaattctccggaccacattcgaatttttcttgtacgtattttagtgattgccaatttcttttcgaattttaattaattctattattccttttagaaaatgatttttaatttcgggatgaatttatcaggacgtgacacattacttgatataatagcttgatgattatattgttctcacccttgtttttgccgaagccaggagtttaatcatataaattagtttcattccaacttagttcccaagtgtagattagatagatggtttaattctatagcaaaatattagagttggctcatcctattgcttctacagtaatagttagccaaaatcttgtaaatacccaattattttatgtaaacaaatcttcattggagccttaatcaaatgtatgcgatgaagattcagattgatgaacctgtatcaatctactgattcaggggatgattatcacgcccggaatttctatccaaaattccaaacgcttacatgtgcgttaaaccctcgtccaggaatcagccgaggcacacaataacaaattgataatagagtactatcaaataactaattaatatgcgcagaataaattattacagaggtggatagttcctctcaaagaacaaagttctacgcagcggaaaaaaaaacaaaagactaaaccaggaatataccattccaaaccaggagtcaatttagtcatcacagtattttcattaataatgagtaatgtgagactaatcacgaaaaacattgttagacccacccataaccgcgggcacggctattcgaatagttttactctgattagagatgtaccactgtacccacaagacacaactctacaacatgtcaccatgcacctcagtaccaccacggtaccttggaaaagaactgtgacaatacctctcatacaacacaactcaccacagtgcaccgttcgtggatcataatctccccctcataaccagaggcaacgaactccccagcgacccccacggacttctcgctgcttcacagtctggcaccccgtaatgaatcatgctatacaaaaggtaaagccgttgctcacgctggcttgtggttggcacggtaaatgtttcacaacagtagctcgtcaaccagtccttaattgttatgagcacgaccatcaaaaccatgtactcacaacccacctttcatcaggtttatgtatcaattaattatcataacacgattaaccatcgtaagctaccactaaatataaccataagtaatatcgtaatatgattaaccccattgatgagctaatgtttctaagcatggctaagcaattatacctatatagcacttagctgaaccaaaccaatatataaggtccaagctattcaatttattacccataggaaaataaagtcattgtcggccattaaataactgggaaaggctcaccacccgacgacattcgaaaataatgcataagttgaaataaaacattagctttaaacatgttcaacatgctaaaagcgctgtttgggatctgtgtgacttgccttgagcttcttcaaacacttctgaaccttcctcagcgtaaacgctctcctcgggaatgtcggaaactaaagcaaataaaccaaatcaacaaacagtacaaaaacaagcataaacagtacatgtggatatttttaacatgtagatcttgattttagatgaatttagcaacttgaaccacttgaatttgagttacgatgatttagttatgaatttccgaagtttaatcgatttttaactaatagaaaaaactaataaaaaggatttatgacatcatcgatgacaacatcgctggccatggcacggctccacgcgaccactagcgatagagagctcggttgggctatccaaggacacctacgcgaagaggacgacgacacgaactcaccggtgcaagaaactacgccggacaacgacgtacggcgaccggcgatgaggacaaacggcggcgcggctcgactcgacgacggcggcggcgttccagcggcttgcgacgacggcgaaggggcagccgaggtactcctccaccgtgcaaacccggcggcggcgacggacagcgacggcggcgacgctagcggtggcgcggcgcgactggagagtcgccggcgacggcggcgccgctacgaacaacggcgggactcgggacttggggcaaacggaagaggacgactaggggatgctttatataggcttggattagagagatcggactccaaccgagaggaatcgagccgggaaaaactagggttagttaggagagataaactcaaaacgaattcgatttggtttatctgggcaaaattgatctccgaaactctaggggaaagggagaggataaggaggagatgatttcccctcaagcaaccggactcgggggcgaccggttgaggttgaatcggaggagagacggcggtgctcgggctcggctcggcccggccggaggtaggggatgaccctgacatgtgggccccatatgtcggcggctagaggagaggagggacggctaggcttggattgggccggcgtggctgcacggccgcgcgcgagggacagggatgttgggccggaaacagcctaggggaggattttaaagactttttcaattaaaataattcgtgaaatgatgtttcatttattaaaaatacttcccttgctcaaataattcccagaaaaatctagaaaatagataagcaagcaaagtatttaataaaattttatctagctcaattttgtgttgaaatttttcctagattattagagtttaacttgtaggtttttaaaataatttctaaaaatgcattaaaaattgaattattaaattaggcgattttcagggcgtgacaaacctaccccccttaaacggaatctcgtcctcgagattcagaagaactggcaaaaagatgaggatgagctgacttcaattcatcctcccgctcccaagtggcttcttcttctgaatgattgctccactaaaacttacagaaccgtatgacgcgattctgggtgtttctctcactcacctccaaaattctgactggcttctcaacataagttaaatcttcttgaatctctaaacgctcaggatctgcttcctcggtaggtacactcaaacatttcttcaactgcgacacatgggaaacgatcatgtattccctccattgacagaggcaactctacttgataagctacttcacctctccgactcacaatcttaaaaggtcccacaaaacgcggtgccaatttctctttggtctgaaaacgatgaactccccgcagcggcgtaacccgtaggtatacataatccccttcttcgaaagtcaaatccctacgacgattgtctgcatagctcttttgacgcgactgagcaactcgcaacctttcttggataatcttcactttttcttctgcctctcgcaatacatctgtcccaaaaacttgacgctcaccagtttgatcccaaaggagcggtgtacggcacttacgaccatacaatgctttgtatggagccatttgaagactagcttgataactgttgttatacgagaattcagcatacgacagattcttatcccaacttccaccgacatctagaacacaggctctcaacatgtcttctagaatttaatttactctttttgtctgaccgtcagtttgagggtgataggcagcactgaaattcaaacgagtacccatcccttcttgtaagttctgccaaaacttcgaagtaaactgactacctctgtctaacactattttcttgggaacgccatgtaaacatacaactcttgccatatatagctctgcgagcttatttcccatgtaggttgttttgacgggtatgaaatgagcaactttagtacgcctgtcaaccactacccaaatagaatcatgtcctaccgatgttctgggtagaccggtgataaaatccattcctatttcctcccatttccactctggaatcttcaacggttgcagcagaccggctggcttctgatgctccgccttgactcgctgacacacatcgcatagagccacatattctgctatctctcgtcgcatgctggcccactagaattgttgcttcaggtcttgatacatcttagtgctcccgggatgaatggaatacaaagtttcatgggcttctttcatgatagtatcctttagctccttattatcgggcacgcaatttctttctcctagccacacagttccttgctcatcctctatatagccgatggctttacctcttctcatgttctttttgatttcttggatatcaggatcattcatttgagcctctctaacttgatcaaaaagagtaggctgagcttctaaagcggcaacaaaacctttgttgactattcccaagttcaacttttcaaattcctcacataactcccaaggtaggtgtcgaccttctaacatcttacaagtagcttttcttgttgagagcatctgctacaacatttgctttacctggatgataatccttgatcaactctaacccccgtcgttgacgcatgttcaaatcaggttgagtgaaaatgtacttcaaacttttgtgatccgtatacatctccgtacggttaccaaaaaggtaatgacgccaaatcttcaatgcatgaactcagatgccaactttaggtcatgtgttggatagttattctcgtgggggcgtaact

SEQ ID NO: 74864 - DNA, 3277 bp, Oryza sativa
tcctgcagcccaacatagaagcccatgcaaaaaataaaaggagaatacatgtgtacacttcccggcgaaaaaaaattccccagcgagaatacatgtgtacacagcattccttgtatgaaagaagacaagtcataaaaacaaaaacagttttatttgcttggcaatgtctagatgttaaatcagttttttttaaaaaaaaaaatcatgatacgcatatgaaacccaacctatcatatgatcattgtataaaaactaggtaacccaatttggaccattcgtgaaggaaaaggtattttaaacggttatatggtcaggacataaggcggggaggctctttgtgtagttcactagttcaggttgtaaaatatgtcaaattatttgcaggcatcaataatactagacacaagtggcatgaactacaattacatatgactttatgtgacattaattagttggttcacaaaattcaaaaatagcataatcaaaatggaagttgccaggaacatagtagcaaaattaggcatgaaaagtaacataaagaggcataaatggcaatgaaacactagctatcaaatgcataagaaaacattactaaccaataaaaacattccattcatctgtcaataattcctaagcaagaaggcatgttgtctaactggtagaagctgcccttcagataaaaaaaatactttacagtatgtttggataaaaatcctaaagaaatgttatccacgtttgcttcgctgccccaggttaataaaggtaaaaagaacaacaatgtatttctttttgcagaatatcatgatccaatataaaattaaagatgtgattacaaccttggagaaaaaagatccacacagctctggtgctcggtaccaccttgttgcaatataatcctaaaaacagaaaaatcaattagctgatgatataaatcttaagagtaatgagctgcatagtgtgtagtgggcgtgaaatgacgtaccgtccagaagatggcggttggagtatcactaaaagctacccttgcaaggccgaaatcacatattttgagcttacaatcagcattcgccaagatattttttggtttgagatctcgatgaaatacatttgctgcaaaaagctatcaaaagatgcatcagtcaggaattagagtcacaaataggatggactgataaataggaatcacacaaacatagaacactgagtacagaaaaaagattaatctgttagtagtcctcgtcttattattcctttcctgaatggtgcgtttgtatttttcagcctttcatataacaaaagtactaaattggtcaaactgacttcttagaataatttagaaaaaaagaggggatgggggatgagcacatgcattatttacagcatcattagaagcaaagcaagatagatgtttctatcatggtataaaatgaatagggaaatcctattcaatcacaatcaggttaataaaaaaacctaaagaacagaactaacttagtcacaaaagggtgcttcatgtgaagggtatgtctatcaggaacaacgaatgctggaatgtgtcaaatatatgtaaacacttgtgcttgcctttgttcttctgcttttgaaaacaaactaagttgtctgaccaaagccaacaaacaaccagggtaagaagatgaagaaaccagagaatatgaaattccttgtttattacagcccaaacctcggtttgcaccatggcagatgtgtatcagataacaaatccagttcaattggaagatgttagctagttgttcgacttttcacaaagggcagcaagcatagcctcttccctaggaaaagtatttgttatattgtattgccagaaggtaagaaccatggtcaatagcatgtacagatagaagatgaggttgcagttacatgcattatactttcaggatgccatgaataattttttggatggttaaactacccaatgcctcaggctgtaccatcctggcacaaattcagtgtatccacaacttgggaagcaaaggaagacaacaagattctgttgatgcccgctatggaagcttgctaacacttcagattttataaactctacatcaaagggcgccagggggcatctagtcatcccacaagaatgatccacatttcaggagaattttggggtactgctggtttatttgtactaaagcaaccacagttccataagattgttttcattatatagtttgtgcagataaactgtaggttcccaaaaaagcacaaatgctgaaggaacaatcccagaataatctgctagtagaaaaatagtttggttgttatctggcaacagttataacatggtggcaattgtccttagcaaatttatttatttaaatagaacattcttcacagcaggctactgaaagaaatgcaaaagaaccatctttcatgtgaaaataaatcaattacctgtgtgtatatatttcagtcctcggagcaactgatacaagaaaaactggtagtgttcaggagtcaagtcatcgttggcctttataacttggtgcaaatcagactccatgagttcaaaaacaacgtagatatccttgaattctctccttgatggaggaagtagaatatgcttaatttccacgatatccggatgtcgcaggagtctaagcaacttgatctcgcgaagtatccgtgttgcatcggacacatgctcaaagatgtcattgattttcttgatagcaactttatcaccggtgtgagtgtccaaagcagagcaaaccacaccataactcccttttcctataacctcttctatcttgtacctgtttccctcaccgtactcggtgaaaaaatccatctcagaaggtgtctgaatcataaaaagacaaaatggatcagaatcagactagttcttttagtatgacaaaagaatttttttagtatgagaaaaaaaatcctttgttcaattaggtcaaccatcctaaaggcattagctaaatcatactgtatgaaagcggtttcatcggaaacaacataccatgtcaatcatgtatgatgcaaaacagcaagcgttactttttttatggggataaataacatcaagtgatattcttttttatttcaaaaactgcttaggggtcagaaccgcatgattcaacgatgtgtatggatgggggccatacgtacgcatatctccaagtccaggataacaagatgcaaatttatgtactgcataaatcagataaaaatatgaacatacaagacaataacttgaggtcaattaacagtcgccaaggaaagt

SEQ ID NO: 74865 - DNA, 5810 bp, Oryza sativa
acctccgccaccccgaacgccgtcgcgctccgcgccagcgtccccacgttgtgccgcttcgccacgttgtgcaccaccaccacgctctccaccgccgccgccgccgccgccgccatggccgccactcttttctcctttattttccttttttttttgcttttaattcgctctttttttctcgctgtgatgtgaagaagggtggaaatggactagggaaaatactacgcgtgagccattccactgacatgtggggttcacctggagggtccatggaaaggaagacaccgtgccttcgtcgtaggccagagatcgtctgaaaattgaagacaatgaagctcttgatgctgctgcgttgagtgtttatgatgcaaactctcatttgcaacgcaggaaatttcacagtatttcatataagaaatttcataggaatctgtttgtttatttaccaccaaaattgggagaagagctcttggaacacaatgaggtcaatggcgaatcagacaaagccacatagtacaaccagacttattaacatcatccatgaaccgaaacctcagttcagtgaggattccaggataaatggaatagctcagaagcatcaaaattcaaacacattttgatactcttacctgacaagaactagttctgattgcctgcaatgctcagcgaaaaaaagataaaccaaaaggaaaagcattcagaagacaacgctctgtacatcatgtataaccaacacccatcccattatccattatctctgcggggttttgattgatgtgcgaccaaccatgtatattattctcaaagtttaaccactctcaccaccactcattattccatccaatcttccatccatccatccaaggcaagctcagcaaatcaatcaaaaaaaacaaataaaaagagaaaacaaaatggtgtatatgaagaagtctagcaaccggcgaggcgggcgcacaccctgcgctggatgggggtccggcacgatgggcactccttcatcccttgcttgtcatggaggtcattgcatttcgcgcagaccacctggtgcgcgcaagggaggaagacgaccgacatctcctcgctcaggcacatgacgcactcccggtcacgctgtatgtcgtcaaaatcgaaatcctggggtaccgctgctatattggccaaaatttgagcgctgccattctttctcccttcagaaaggcgcaacgcgttggttctgttgtctgctccccacttgggaggggcaccaaccctcaacgagtccaaggataccttcagctgcgaaatctgctgctcgagagcacgtatctggctcttgtatctttgcgtatcgttctccgctttgagatgcaggaagttctcttccgacctcagtgatgtctcaatctgatccctctctttcttctctaagcttacacgggcaattgcctcaatctttccagcctcttcttgcctccaccttgcctggaagtattgaagatcatagaaagaccaaagatatacaagtttagtgaagacagcaatgtaaagggatgaatgaatgaatgatgttgtagagagccgcggcacaagaaggagggacgcattaaaaaaagcaaaattataatatttacagaacagtcttacctaacccacaatattaatcatcactgagcttctacttcagcaaaaacatggtatttgcaatcaactcaatatgaattcatgaaagtaatgaaatgtagactgcaagcgcataagttccatttttatgaatcctctagcagaaactaacaacatagccaaatgacagattttgtccaaaaaccatgatagtgcactcaagacagtttaaagcagtctactctatccaaagcaacaattcctatcattgatcattgccacgactcacttacaaaatatttttcatgatttccgccttaagcagaaatatgtacctggcgtctgaaagacagtgaagataaggaaggttatcattgcatggcatattcgacaaatttaagattggcaaagtgcagatgtgccagtgaataaatagcattgtttttgtacattcaagctttggaacttattgaataccatttataaagatatatcatcacatgaaatctttatttaacattgtcaacatttgacaaatcactaactagtacttgactggaaggataaaatgcaataccatgtaaagttcacaattagtatttccttaaaaagttgtgtaaaacattgcaacgtattcatgatatacaaagcatgctagagttgtcttaattaggacatccaatttagctaccaaaatttctaccttttgggcatccccaaccccttaggagtgagattcaggaaagtaaattaaaaaaaaatgtcacatgaagcttaactaacaataaaaccatgacatgtgcatatctgttaattgcccagaaacatcaccatatattaaagaaaatactgcataaatggagacatcaccgtctattaacttctttgacaagctctaagcactgttaaaaatactgttatccatatattttacaagcttctcactctctcagtgccaccttacatcagatttattcaaagagctactacacccaaaagagtaagaactaggtcaactgtttatctatacacaattaaagtcaactattctaagtggcaatgcaattctaacaactcaagattgttcagatatttcaattttacagaaaccacatgaattaaaggttgatcatatataactaatatgattcaattgtataaacttcccttcaaaagattatgaagaggtaaagataaaggctaaaccaataaatacctggatttgatccttctgctctttagcatgatgaagttgctggtggacctgagatagcttgttcctttgagcagcaagatcctcttgcaacagggctctttcagattcccaatgctgagaccttttatgactgttctcatccttctttgaaagctccaaaatatttgttgcagacactagtgcatgccgctttgcagcttccatctgtatcctgagctgttcattctcggcttcacgtctacgagcagaagattctgccttttccagctgggtgttcgccctagaaatcgcagattccatctctaaaagcttcttccgagtgctctcttccagattgtgcctctcttcttggaggcggtccgcttcttccttctctttcctaagtgaatgaagctcttccttctccttggcaagtcgacgagtgacttgcatcaccttctgctgagcccagtctgtccaatccctcatatgtgcttgcaactctttctgccgctggacaagaatcaagaccatttcatccttcttatcttgtgggatccaaaccttctgatcctcatcatatgataaattgattttgctgctagagtccataccctctgtattggcatcatgattcgaagatggagcaggactgtcatttgaggacggcaatggcaacgacaatgagagatctgtgctagcagctggtaatgggttcaagttactactcagcttggcatcaaatgatggattggagggaagggcagcaccagtaaaagaaaggtcaggtggtacttccggtcccttcatgcttgcagaaaaccctttgcctactttggatgaggccttcaaactgctagtagtagaatctgaaaacgacctgcacttcctgtccagcactgcgctacccaaagagctatgcttgcttgacctaagagatcctttagaacccagtgctcgggaactcttatcaaaactcatcaacttctgccgatgcaaggaatcccgcttagaactccccctcttactagggattggcttatcatctttcacaggttgtgtcgcagcagcaacgaatggttgctcctctgaatgatcaggcacaggatttgagttttcttttggcttaagattcgggatttcactctgcgccttacctgagacagagggtttactgctcggtacattcaggtttgctggtgttgcggatgaatcagccttggcagtattgtaagaattgggtggcactggggtaagttttccacgaaaagtgacgccagtctgtgggttggtaatagatactgataaatccgaacttggattattaggttcatagtttccaacaactggctgggcaatcacttgcgtatccactgctgggagggaagccggattgtagtccatggcacaggcattggccacattcatatccgacataagcaagcagaacatcacatcacctgtagtgtagaacggctgagcctgattgaccaacgcaatcatgccaccgagcactgcctgctcaatcttcctcatgtcttcctcggaggcgccctcactcaacatgtccccctcggtcttgagcacctcgaccgccgcctcgccgaacccagcaaggctctccctccaattgtactgcgtggcagcccgcaggacggcggcacgcgcggtgggctcggagtaacccatcgcgatgatcacacctacggcattgtcgaacgtcgcgtccaggcccttgagaaggatctcctcgagcagcgcctcgttggggtcattccaattcacatatctctggcactccagtagctcctccgccgtggggtgaatatccttgcaatcgcacgagcccgggatgaggtccaggttgacgccctcggcggccaccgcggcggcggccgccgccgccgcgatggctgccttctccggcgacatgaactcgaagcccacgcagtcggccgtcagtgggtactccagcccgaatgaccccagctcggcggacggcggctcggcgcggtacttgcgcttgttccggctcgccgccttctcctgcgccgccgccgctggccccaacggtggatgcgccgcgagagtggacatcacgatagatagctgctgcaaaaaaaaaaaaatccccccgacccaacaacaaattcatcagagaaatcacaccgcgcaatctcaatatagcacaagaaaacaaacaaaaaaattccccggatacggagaatttgcgactcacctctggttccttcctgcgcgtgcgtgcaccgaatcagggaagagagagagatagaaaaaaaaataaaccctgaaaaaacaaagagaggggaaaaatgattcagtaacaatcgggaagcaccaccgaatcaagaaccaggagaaactccccggcgcgcccccaccgcccagtgcccaggatcagatggggggaggaggggctgttcttgatccgatcgggtgtgggcggggggaggtgcgacccgggagacgggggcagcggatcgaggcgcgtacccgggggggggggggtcgtcggcggggatcgaagcggagtcgatcagaggagtggagaagagagagagagagtatggctagagagagagaggaggaggaggaagaagaagaagggggaaggaggaggaaggagatgaggagaaggaggcgcttgtctctcctcttctctaggcctgatggatggagagagagagagcacacacagcacagcagttacggttgaattttttttttaccatttcttttctctcgttttctgctgggtgctgaccccaccaatggttaggtgccacgtgtaccgtgttcttcgggtgagggctgacgtggccggtggcggtcgatgtggaataaaccagggaagggagatatgtgttgttcttggttatggaatgcgagatgtttggagatggttaggttggttttgctttgtttggtgaatggattgttgtttttatttagcatgggttttactagtgatagattagcattcagtgattac

SEQ ID NO: 74866 - DNA, 9716 bp, Oryza sativa
tatatagttttgtgttaacagcctcttcttccaactcagtaatctcaagaacaatcaaattcaaatacaatctcagaaaaatagaagaggaattgagatggaagaagtagaggaagcttctagaagtggtagtgaagaggaacacgagagagagtaagagagggatagagatcgacggggttcaaccgaaccaagccgccgccgccgccgtggccgaagccgccgatgtctcatctgttcgatgcctcgagcagggctgctgctgccttttgtatcctttcttcagtctccatgggctgggcttgtagtatggctaacatagcccatgtacaacccaattgagttcctaacaatcccctcttcttagaattcggcttgtcctcaagccgatgcaaaatattgcagatgtatgtgaaccatctagaattccaatagtcatcttcctgaagaacaaactgatgggtgctaagattgttgcttcgatataactcctttggagcaaaattgcatgcttttgattgatcgttttttgcccagcactcttttggcatccacctttgattggtttggctcttttcatagcactggtccttcctagtcatgccaagcaacttagtatcccatatagccatactgttatatgtaagatatttttttgaaattgcacataagtgtagtccagccttgaaactagatcctctgctcccatggacaacgacaataacactaagtagaaatttccatgtcctgtgtatgagcaggcactgcaattgcttgtgtgtcataagattcagcagcccaattgacttacaaatattcagtgcatgtgcatcaagtacttgagtagaagctgaatatttcagaacatgtgtgttcatctcaagtatagaagtgtcaaaactgctgatcatatttacctcttgcaataagttcttcaccataattttaatttggaaagtcctctcattccttatcagttcaagcaatttcctcatggacccacatcttgctccagcctctgaaacatgtagtatatgtgaaccattcccgatgccaagctcatgcctgacaaatgctcttgctggcctgacaactgtatgcctgtcttggtcactgtacacagtaccagcccacccaaacttaaccatctcatggcaaactagaatggccaaagcttcaagacatgtaaggccaacaatatgccccagatgatagcagtgcactagagaccaactattcaacagaattatgtcaattgaggtcctgttgtctcttggattccaaggtttgcataagatttgttcttgcccattaatatgctcctgcaggctagatactgcaaccattgtgcaactttcctgattcaacaaattccactgctccatcctagcacatagactcattcccactctagttttccagcacttgcattgcgcagcctgaacaaaagtatttctacaatttgtttgatttggtggaggccatggcttcaactcaccacggtgcaaattaatatccttcagctcagtgagaatcattacattaccttgacataccaatgcaagacaacttacttcggtaggtggcagccaaggtggcaaatgatgtacccttgaccaattgagtttgaattctggaccagccataggctgcaaatcccatccattaatcactccatcacaggttggaggtggccatggtggcatcaaacctacacttgtccaaaaggaatcgagtacataccatgggatgtgccacacctcccctcctctaaccacaccacctgaccagggaggtggccaaggatctctcttgggatgccccaccagcaacttcttgatagctttgaggcatttcatcaaacactcagtgggcatcagcttggcaaggtccatttcagcgatcaaccatggcgacaagacttcggatgatgcatcaggtaatacaacaccctcaggcacacccatcatgatctggcatgtgaccctggcgtggtctgcaccacccttgacatcaaggccaactgtcgaacagttggcgggcatcgccttggtactatcaggggtgtcaatgttggtgctgccagtggtgccgtcaatagctaccaactccattgatgacacgacaagggtggcgcaagtaaccacagtagccacagtgtgatcaggcttggtgtcggagctggaacatatcgtcgaacacttggtgggcgtgaccttgggaaggtccttggcggcaatgtaggggacaggatccttgtcctcgacgtccccaagctcgaaggcaaccatcggggcaggtacctcgcggatgtgacttgaattcactgccacccaagtgaagttgtggttgtggcattccatcaaacagttggtgggcgctaaagaaggtgggtgccataggtgtcaaatatgatgcagcgttgaaaatggcggtggttcccttagtgtcagcaatcgtctcctgggaagccttgctctgacgagcctctatgtcgtccaacttttgaaaattttgattaagcttgtcctctggccggcgctggcctgccatttgttcaaacttctccaatatccgatccaaagcttcatctaaccatttctcctctttattcatggtggtattgatgagaacgggctgtgatatcctctgatcttccttggacatcccaggttggcttggcattccatcgagcagttggtgggcgatgcttggatgaaaaccttcccaactcaattcttgctccatcttgcatggctgcctccccaacacctccatgacaaaaatcccagtgaaccgaacggctctgataccagattgttaacagcctcttcttccaactcagtaatctcaagaacaatcaaattcaaatacaatctcagaaaaatagaagaggaattgagatggaagaagtagaggaagcttctagaagtggtagtgaagaggaacacgagagagagtaagagagggatagagatcgacggggttcaaccgaaccaagccgccgccgccgccgtggccgaagccgccgatgtctcatatgttcgatgcctcgagcagggctgctgctgccttttgtatcctttcttcagtctccatgggctgggcttgtagtatggctaacatagcccatgtacaacccaattgagttcctaacattttgttacagtcaccaaccactggaaactaagctaatacagtcaccaacgacaggcagcaccaaccaagaagttcagggaatttcaccaaaataaaaggcgaaatcctaaatagaggcttgctgcttgggttcctaatcatgttctagttgagatcacgcgggagttgttactgtaacaaaatcggtgagcagataatactggtgcctagtggcgaatcgggtcagaacaaactcacattgttgtggctgttatcgagctccatggataatccagccttggtctgattcgcctccccgtgtgatggagtcgatgcggagcaggaggggatgggcgcagaaagagaaagcatcctcgagcgctcggcgacggcgagaccctgagggcgccttgaggctgataagagcggcggcgggtggtcggcaggcgccggtgttgaggagagcggcgccggcggccgccgcggcgagctctcgccggcaatggaggagaatccgaaaaggaaattggattagtgaccttacgttagatattaattacggatctgccactcggttttccggtgggccatagagaggcaagcttatatgggctgggctggctgtggatatatcacaacttcatgaaaagaaaaaagtctgatttgacttcctcaaccattggccgccgaatcttattcgtatccatggactgcaaattaggaataattaggctgtgtttgagggaggggggattgagaagattgggaagatacgtaaaacgaggtgaaccattatcgtatgattaattgagtattaactattttaaatttcaaaaatggactaatatgattttttaaagcaattttcatatagaatttttttttgtaaaatacacaccgtttagtagtttgggaagcgtgcgcacggaaaacgagtcacaatctcccccaatctcttttgaaagaacgcagccttagtattagtagcttctttggacttagctattggtttgtcggaaaagacatttaaaattgtgaagtgtaaatgatctacgaaatagtggtttaggttatcctgatttggcatactagaaaagcaaaactgcaactgctacgatgctgaaataatgattaagattgcaataattcattaaacaaacaatccgtgccgagaaggatgaactcatgcatactgagatgttcatcaaccaatcgcccaaattatgtcttcagcaagtacagcgtcacttgctctctgtccaaattatcatacaaactcatcaatcacgtcagggatccgcgatctacatttggtaaccgcggcttgtgattgattatctggcatcttcggcaccatctctgaattttctgtgtctatggaggttcagacatgacagtggccgtgtttagttggatcaaagtttggattttggttgaaatcagagatgatgtgactgaaaagttgtatgtgtataataggttgatgtgatgaaaaagaactgaaatttggatccaaactttggatctaaacacagccggtgtcactcactcagggtgtgtttagttcgcaaaaatttttaggtgtcatatcgaacgtttaactggatatttgaaggagtttacggaaacaaatgaaaaaactaatttcataactcgtctggaaacgtgtgacgaatttattaagcctaattaatccgccattagcacatgtgggttactgtagcacttatagctaatcatagactaattaggctcaaaagattcgtctcgctatttccatacaaactgtgcaactagtttttttaatctatatttaatgctctatgcatgtgtccatagattcgatatgacgttcttaagaaaaaaaaattgggaactaacaaggcctcactgtggtcacaccaaatccaattcaatgaccgagcaaagtcagaatcactcgccctccaattcaacatctcaaagattgcaaccctgcaatctccggtggtcgccggagctagcgacgccgtcggtggtggtggtggggctccggcgagcagaacgcactaaagaagctacacaactagctccacttttagtagttgtgtgctcagctcactttgatcacttcgtcactgcgcccctttttctctgacggcattgtagcttcttcacatgcattgcactcctctttctcatcctaataatcctagggccttgtctccttcctcctgtccatgcatgcaaatcatgttctgttctgttcgccattgacgatcgatttatcgagagggccaccaagcttctttatcttttttccaagctcgtgcctttcaacgaaagttcagagaacacgatcagtggagcgaaaacaactctcccactctgaccaatcatcggaaaagttcatttttttgatacattaaaaaaaaactagcttaatgatggctttatgatcttatgaaagttactctgaaacctgaaagggggtttgattcctatgtatctatgattgccactgattagctttcgattctttgcttttgtggctgtgtctgaaaagtgttgcaaagatatatcttccaaagctagtagcttcagaaaacacatgacaacgaaggttttttgtttaaaaaaaagttgcaaattgcgatgagccaaactaactttctaagagaaattaaatgaagagccaaaattgagctgaaactaatgaggattccgtagtgaactgtacaccattagtccattacacctaccgctcattcaaagttgcagagacaagaaacacggcaagagagcttttcgattgcttgcatcagaaaccggaggtaggtgtggtcaaccccatattgacaggaagattgttgctccctccgtcccataatttaagggattttaagtttttcttatactgtatgaacactcgtcttattcaaaaaaattagaaatattatttattttttgacttactttattatcaaaagtactttaagcacaacctttcgtttttttatatttgtataaattttttgaataaaacgagtggtcaaacagtgcaagcaaaaacttaaaatcccttatattatgggacggagtgataagtagaaagtaaagtgaccattagttcggtaaaaaaaatgaaactattaatgatttaaagttcagtaaaaaaatgaaccattaatgaattgacagtagagtacgagtagaaaaggtaagggcatccaatcatccacgtgcttgtgcagttagtgcgttgatccataatatcaaagactacagtagtacctgaactgtcccaaatatcataccagtagaagatctgctctcttttttttctttgtaaagatttcttgtatcggtccatgctattctagatgtagattttggtacatgcttgagctgctcgtgattaatgctgaaaaatgtttgttgtaacaatgtacaagttacttaaacctatattggccttagttttgaaatcacaattaaatacggaaatgtctaggataaccgggttttggtgtatatatgcagagcatgaattcattttacaatcaaagtatattgccaataaaatcctatttattttactataaccaaaattattacttcgttcgattccaaataaattgttggttttgactttgagttgtcgaccaatagtatttgaataatctaaatatctagcatcaaaattgtataattagacggggttgtttagattgcaaccaaaataaaccttactaaattttagcaatgccaaaattttggtaatattgccaaaattttggtaggatttcttatatatttatcaaagtttgacaagaaactaaatggatacacatatttgataactttactctaaaaaaaatggtatggtttgaaatgacatcaatctaaacaagcacgtaatctaaagtactttagtaatatcttatatacaaatctatttactcttaaattgcttaaaacataaaagttaaattgcatctatttgggtcaaagccaataattatcacaatccttcaacatcaacaaggctagtacttaatcaattatatctcatatgaactatataatgatattgaatcatgtaagaaacctatcgattctccaccatcgtcaacgtcaggtcccaactgcctctcaacacaactgcagaaatgacaggttcgttcactggcacacaactgcagaagtgagctggagtacacatttctgctgtgacctggtctctatgcgatgctgaaaggaagcaaagaggcaatgcaatgcatctgcatgcattgggattggacttgggagtagtcggagatgagccactgagacagccaggttgcctccgttcgaacgttccgttaagactgcttcttgcctttccaaaatcagctgtaacactttgcaactgtagtgccattatgcttaatgctttccagcatattgtgtctttgttctctttgctcttttttttttaatcttctgaaatgtgtttcatgcggtgtgttatacggctttttttagtgatggataaaccccggccgctgtgtcagaatgtggtcttgttcctaggttcagagcattccactgcacaattatggataagggctcctttgggtgtgtttagttcacaccaaaattagaagtttggttgaaattggaacgatgtgacggaaaagttgaaagtgtgtgtgtagaaaagttttgatgtgataaaaaagttggaagtttgaagaaaaattttgaaactaaaaatttatttataggagtggcaaagaattttgttaggatttaaatttatatggtttttttccctaaatgtttctttggttcatagaaaatgaacgaaactttatatacgattgtattcctatgcttaacatttcataggaaaattatcgagatgtgtgatttttttaataaatttttctttgtttcttccatggtaccaacaaagggctcttatatatcattccctatgttctggattctggtaggattcgagaaccatacgacttcgattttcgtgttgttcaaatcctgcgaatcaaggggcctaaatgatggctgtgaactttgctttgttattgttcctaaaatattatagtgcgatgatgcaatacaagccgtttttttgacaaattgacccttttcaaaaacttatttcgaaactaacccctgccaaaaacttcaaccaaaaataggccgtcgcctcagcgccaaacacattggcgctgacgttggccgtgttagcgccaacgggactggcgctgacattgtgccaccgtggcggccggggccgatccccagctgacgtggcagctacctcagcgccaaccggactggcgctgaggtgggacttggccgccaaggcccagaccagcaagccttctggatggcttgcaggctgggacctcagcgccagccaaaatggcgctgaccttgggaaactcagcgcaagccaacctggcgctgaggtgggacttggccgtttcggccttggcccagaccagcaagccttctggatggcttgcgggctgggacctcagcgtcagcaaaaatggcgctgaccttgggaaactcagcgccagtcaacctggcgctgaggtgggacttggccgtttcggccttggcccagaccagcaagccttctggatggcttgcgggctaggacctcagcgccagccataatggcgctgactgtgggaaactcagcgccagtcaacctggcgctgaggtgggacttggccgtttcggccttggcccagcccagcaagccttctggatggcttgcgggctaggacctcagcgccagccataatggcgctgactgtgggaaactcagcgccagtcaacctggcgctgaggtggtacttggccgtttcggccgtggcccagcccagcaagccttctggatggcttgcgggctaggacctcagcgccagccataatggcgctgactgtgggaaactcagcgccagtcaacctcagagtcagggaacagaatactgccgaagatgtacagcacgtacgccctacagtatcgctgtactgtagcctcatctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggatgtaccggtcgtcgaacagtatgtgggccgtgtgacctcttactcgaagggtcttcaagcgctgcatcaatag

SEQ ID NO: 74867 - DNA, 20212 bp, Oryza sativa
ctcgccgggcggatcacgctccctcatcattggtatcaggggcggagacgcgagcggtgagcctccccgccgttgggagagatcttcacttgccaaactcaattctcagcatgtcgtggaggcggctggagctcgccgcgctctgcgcctacgcgctggggttctacctcgtcgtgatccggaagtcgcttcgcctctctcatggtatccaatcgtctcagattccaaaatcttccattgctgttaattttggaactgcttcgcatcacattatcgcttggtttgtgcagattactctgggaggttgtacggcctacgagcaggctcactcgctggccatctgaacgtgtgttaaattcctcccattcctttatcagtgttctagttttatctgaagattgaggagctacgcatctgatttccttgcattctgtcgttgcaggacttgtccgatgcacaatggagaaatttccgggggaacttacctgttcttaccattgtgatgggtgcatttctgatgttggcgaatatgcttcgctactgctacagcttgaagggaagaggggcctctttggtgtggcttctcctgtctgtcacctatttatgctatctacatggtgcttggtaggaaactgaccaatgcttttcgcttgttcttctccaatatttgtaaagtttctgacatatctatctctatggcagtgttagtttcattctcctaatagcattgattaactactccatagtgaaggtcagtgctagcatctttgatcaaaactactgttgatttcagttgtcttagtcgttgtttttctgttttccttttttttttgcataaatatatagataggcaatgccacaaacaaaagtacatggagcaaaacagaatgcttttttgttcatattcttgttataggtattagaggtagcatatttgtcaatcgagcatatgtttgtggatgtgcacaatgtatgtgtatgtttaacggatgcaactttctcaacgtgatatagaaaactgaagactactccacaggtgcatatgatatcaagcacataaaagataagaaacatagtacacatcaactaaagaagagacactgtgataacaggaatgccagatcaatggattttttaagtcattattcaagggaaaactaagactctatgttggtaaaattcatttgggatgaattttcggtttatgtattgattccaaatgtttcattcatcaactagaactggtcaacacaactattacaatattgttggactgagtggttaaacatctagtcaggttggttgaaaatggtgtcctcagttaaggaattcaagttaacatgctgtttattatgtgattattgtcaacctgtaagtggtaccttagttgtaagcaatcattccgactgtagtgttgacatcactgttcgattttctctgttctaattgattatgggtttaagttttgcttttgaccatagtattctctcttgcagctattttctcgatataaatattgtgttgggctcatttggagcttcaacttagctgtccttatacttaaccgagtctatgaaggctattcattctcattgtttgggtgagctgttctgaagctgctctatctgtatgatgcaattcctttcagtgaggttccttttctttttaatttttgtgacgtttgattttcttatcgaaataggcaacagcttgcttttctagacaatcatcggggtacatttcggtggcacatttgcttcaattttggtatagttctccttttgtcatcttgatttggttgaaatcatgtttatacgaatagcttttgatgtttactatgtagaaatctataaacgtgttctccttatgccccatttgatttgtctggcagttgtattacgaatgataagctttggatgcgattactgctggtcactccggtcttctcagtttgatcataaggtattatatttcctgatgacttgtctttttgtaccacattatctgtacttcattattggaacatcagatgctttaaatcacagaaacatagttttaaaagcacacattacatccctgttggtccataagatctgacactcttaacaaatctgatcttgtgttttcttattcatcttggtacattttcaaaacaatatgtctacttgtcttgttttaaatgttattggataaattataaagttatatctgatatatgttgtgtacctcatgggaaactgataagtttatgaacaactcttgtagagatctgtacctgtaaattagtaaatttatttttgaccatacctctgtcttgtcagtactgcactgtactgaaatgagttgccttggtacagaagcatatgcagcgatgccaagtttgttattctggcaaaacatgctactttgctttgcaggtacttatattttcatacttcccttgtcccaataaaaatactgttgttgatagtgctgctctaatgtggtactgattcatggtagtgtcttacagccattgttggttttaccattttggaagcattacgacggtatccctttagtttccagcaaaataagtgttgacacagcacagaatgaaactagtggttttgttgaaagatgttgataattactaagcgtaaatgaatggttaacatttctgctgataccaggttgaactgttctgagttgttagttgcaatataaatattttctgagttacttgtaatgtaggtcttgagtcttgacattagtgtatcttatttacctttgtttatggtattatcatttgaaatttgcagctttgatagtgactcttgtatcctacaagaccttcctttacaaagcatactatattcactcttatatttgttgatagaattttgcattgttcttggcaggagagagcgctcattggtgacaaatacacattactaacatatttatgctacttgacatatgctccactctacatcgctggacctattgtaagctacaatgcatttgcagcccaggttggtctgtttcttatagataatgattcaatgcagctgaatcggttagatgaacttcaagctaaaagcagcagaaataaatattaattttaagaaaatgaaaggaagaaggggagagaactaccatttaaattaaaagatgtcaaaattgaacagaaacaaatattgctttcatgaatgtttctctctatttttcatttacaggtcgtgctttatgaaatgaagatgatatcaaatttgacatgattctttggctatagtagagctaaaacaatactttcataaaagctgaacatgtgacaatgacatcatatattaatgcatttttgacctgtgcgcctgtcaattttatgtacaatgcattgccgtgacttagggatttatttcatgcgaagggttagcgtgggggacttgatcctgatccaaactctgaccttggcttaggtgtagacttaactttgagctaatttctttctttcccttcttatactcattaattgacaagtgacatcctttatgcactgtgaggttctgtaaacaaatcttgactagaaatgaactggtgtatttccaaacaattttttaactaggatagcgagtgattataacaacttgtctctaagttgatgtggttgagggaccagcctttccctacatcaggcactaatctatttttaacgtctaattagatcagggccctttgccactgccatcttagtctaatctacaaaaatagacacaacatttacatccttctttaatatatttggaagtcattaaaaggaatttctgaatggtccttaacaggttaatctattatctgccatagttgttaacaacgaatttcagctctgaaaggtaataatataaaagatattagcaatttatgtgtagtgaacagtaaaagggcactagctattatgaatttgctttccctgtctataaatgagtaatgcctttgtttcttccttttttgttttgcaaaaatatctttgagcttgttataaacgatcttaaatggtactgaccattgggtgactttaggaactatataaggtagtaagttttattagttggatatagtgtagaaatatcttgacaaatactaacctgttcttgttgtagcgatcttgcagttagatgcaccccagaaaaattattcagttgcacaaatatcttggtatggggtgaggtggatcctaagtttccttcttatggaagctatgacacattttttccactacaacgcctttgtagttaggtacatgcttatctttatatagtataatcaatccattctttttttactatattctgattaattattcttttgacagccgattatggcagcaattatcgccatttgagatcttcatcattagttatggggtaagattatgttgtacatactgcattttctagtatatactccggtttttccttcagagttgtcagttatggaatttttcttgcatcattttcaacaatatgtagcagttgatattaccattttattacttattatgtttttattcaagattgaatacaagttttcgtgatctcctgtatgaatacgtgtcctgacttgcaatactgtatatttgtttccaaagttgtctgcctaggttgttttctactttaatgcgttaacttgcatgcttaccatatccacggtcctgttgctattcttaactaacatactgtagcttcttttttcaacttggtataccttgttgttggggttaataatcatcaataagcattgactatcaaaactttcttatgcaggtgctgaactttatgtggttgaaattcttcctgatttggcgctacttcaggttttggtcactggtaatttgaacatttaaaatcaatattgattcatcatgcaccctgcatgctttaccttttgatacaagggaacattgtcaataaaacaactgtgttctcatatccgcactgttttatgtaatgttttttgtgttttatgctgagtgtttcattgcaggtaggaggagttgagacgcctgaaaatatgccaaggtgtataaataattgtcatgatctggagagtttctggaaaagctggcatgcttcttttaacagatggttggtcaggtttgtgttaaagtagctgctttaagtactaatttatgaattcatctgtgctaccatgcatatatttcattttgaagttttggggttaaaactttattctgttcatagcctcacttctttaacatatgctcaagaaacgcatgcaaaaaactgtcatatgtccgcttagacagagtttaggcctatcaacattattacataacccatgcttacacagagttggtatgtgtgcataccaatgtgcatctgtagtcaatccataagtattaatagtcgataaaattaagtttaactttctttgacatatgtctttcttgttgcaggtatctgtacattcctcttgggggtgctcaaagaaaactacttagtatctgggtggtattcacgtttgtagcagtttggcatgacctggaatggtaagttctgtaaaatttataattgttatttttgtttggcaacagctaggttttatgatgacttacgatgtcaatttgattgcattctcataaacaggaaacttatttcatgggcatggttaacatgcttatttttcgtccctgaaatattggtcaagtctctatccaacaagttccaggtaaagttcccttgtgtgatttgataagacttcataacctaaaggataaagcagcatttctttttctgttgttgcattcatttgcttagttgcaagaaacaaacttaagtattttttgtatggaaatttgtgagatggtaaagttgttttactaccatgttaagttactccctttgtttggaaaaataaaccagtctgtacagcttgagtttggaaaggaatactagatacttctaatttaaggtacaaacaagaacaacagcatggcaaccatatatactccaaactaataagtttttgttttctcatgcattgatggattcttcatcatgcttgtttgatgtcgatggaaatttcatatgattagtagctaatgtatttaaaaatgtagccaagaagtgcccttgggttgttcattcaccgggagttaagtgcaattgctggtgctgtgacaataagctgccttatggtacgtcttttttttgggggggtatttgaattcatatttaaatgtattcaaccgattattctcttacttcgctactggtttactacaattaaagattcctggcaccaaatctcctaggaaaaagtatgcatgcaacagcatttgttgtcaacaaagattcttttagagtaattcatatatcattaaatctaggattttcagtcttacactagatgggtcacatccttgttccgcattgatactgatatgctccactcatgcaggtggcaaaccttgtcggttatgttgtaggaccctccggcattaaacttctcatgtcacgaatgcttgggaaggatggtgagttgcgaattcacatccattatttcatagtgaatttcattcagtcatacggcctcttcagctgacgcctgtgtctattttgcagcccttcctgtccttgccttcatatttatctcattctatgtgggagttaaggtgattcctttgctaattactttctttttgacgctacaaaataaaggtgattccttgtctcacagctggtaaacttttgcagcttatgtttcatatacgtgacgcacatgagaatcaagggtgataactgataagtcgacggggaagaactcccactgtaaaatgtagacaagcagctgcgatgagacgctgtcaagactcaagacaaataggcttacctcttcttttatgggatttgtttgacacgaacgaaaagctcctctgaccgccgagctttggctcttctgtaatgtagggcttattgattggggtagtgaagataatagagcacaaatggaaatggtactacgagctctgtttttaagagtggaaatgcagggcacactccattggattgaaggaatttcaattctcagacaattttcctatgagctcttttggaacaaagcaatatcactggcaaaaatcctatggagatttgcttcctatggctcaattccataacagtctaagcatgagctcatacctcacgttttcgttttccttcgagaagtcgtatgcattctcttcctttctttctctagcatctctctcccacaaaacaatttcttctaaaattcatatgttttgttttctacaagccatccacacacaaactcttaaattcctatattttggagcgtataagattttattcctacgttttatttgttcttgtgttttatagaaatcgtactttccaaaggagccataagaggctcgtgttcaaattactcttttaggccttatgaaattcctatcattcccaatggggcatctaggtaaagtaacaatagttcaactggttaggttactggatgaagcatgttcatttttgttcaagctatatacttaatatgggtgtttgtatttatggctttattcttttattggtagaaataaagtgacagaaaaaggagacatctctttcgctctcatcgtttagagatccaaacattaattgaagaaaagggaaaaaaataagtccaagtagaaataggatttaaaatacctgaaatcctctctcaaaagattaaaaagagttttccaatttcaatcttccacatcaatgcttgacaccaaaaagattcaagagcgatgatttgctctatgattgataaaccttcataaatggtagaaaaataaaaaaaaaatcattcttaactacttgaaagccaatgacgaaaatttatcaatgataaaagccttaaaacctagtttaaaattgagttttaaaattcaaattccgatttcaactgataagctaacaagcaaaaggtagagcctaatttagctataaaacaatatcgtaaaatggtactctctccgtttcataatataagactttctagcattgcctatattcatatagatgttaatgaatctagacatgtggacaatgctaaaaagtcttacattatgaaacgggggaagtagtacatactaattggatagttttcgttgaatagcaaatgatttggcaattctgtcttttttggcctttcaaaatacctgtctacagaaaccagaaacaagaactagtgatcactacctctaaaaatacccagatacttagcctttaaacctgatgaaaaatcatgaggccggttcagctactgggcggtttgattcgtacggcaaaagcggctcgggttggctatttaattcttctcgcagatcaagaaattgtggatcagaatcctctacctttttaagtcacgtgactttatcactgacatgtgagccagatagatctagacccacgtgtcaataacaaaggcatggtgaggatagatgatctacatctgaaatggttcgccatcgctaactcagaaaactcaagtcatccccttcgacgagacatcgccgacatcccgtgaggttgccatctgcaggccacgtcagctcgccacgccacgccatgccgtcgcctgcgccaaccttgggagtcgagccgcgtggacagccaagagccgacgccgccgtcctcaagaaaaagcaacctcggcgcatcgtggcaccgcgccgatgtgcaagaatgtcggtcgcgacatcagtacggttagctgctgaggtcatagactccgaggaacgccaacagcaacccaccccattgtggcctgcgggcgccacacgccgccgacgtcttcaagaaacaatagccgcaaactcggcgcgctgtggcaccgcaccggtgtgtaagaacatcgacctcccccgccgaggctttcaactccgaggaacgctgagcgccgccacagccgctgacaggccggcgtgcgccagttaccaccccgctgaggacgctgaactaccattgaatcaaaaaaggacgtttgagattcattcacatcaccatgagtagcatttttactcatggtgatgtgaatgaatctcagacgtccatttttcgatccatcggtagtttataagttttcactgcatatgtggtttgcactatatatttttcccatcttttcttctctatctctatatgaccatgcaaaaatatgtttttaattcttttttgcaatgtgactgacatgtgggtcccactgcaatgcatgtgccatcataccatgtcacatcagcggatgaagggaattagagcctatttgaacctatatgacaccaatgacaagtttgaagaaaaaaaaatacatttttggagtttacagaattacatgacacatccacactagtttttaaataccgtctgtatactttaatctatttttttcatcagtggtcctgttcttttctccaataagagttggatgaagattaaaattttcgtggcacgcttttcaaactgctaaatggtgtgttttgtgcgaaaactttctatatgaaagttgctctaaaatatcatattaatctattttttaagtttgtaatacttaaaaaatcaatcaatcatacgctaataccatctcattttatgtaaaaaaacttaatcttcatctttagaagaaaagaacacaatatatattatcagaaaaactacctaatggcatcccgtggagacggaatagtagtactgccttatctcctcttcccctctctctgtgtctcttcccctccactcgctctctctctctctcttcccctccactcgatctctctgtgactatcacccatgagcacggaggcggcgacggcgacgatggcgacagcaacgacggtgatggcggcaacaacgacgacgatggcggcggtgccgtcaccactagcccccgcggatgacctggacgacagccggcggggctcccgaccaccacgggcgacggctgtcgtcgagaagcctccccatcaatctcctcaagccgctcctcctcttcgtcgttcttgtcgctggcttcctcgccgttgccgccctcctcttccttggcggtgctagcgcctcctacggtcggggagcggtggacgcggccaccgggggcgagcgcttgcacaacatgagcgacgaggagctgctctaggcggcgtcgatggagccacgatttcggcggtttggagcgaggcacgacgacgagcgacggaatggcacaaggtaggcaccagatctatcgcctcctcttcctcttcctcttcctccgccgccgccccgctgctcgacctccccgacccgcgactcctcctcctcctcctcctctctcttgggatatcacgctgatacccaggtaccaaggcatgatacctaggtaccagctcgatacccagggtaccaggtatcagtcgataccaaggtatcaaggcctgatacccaggtaccaagccctgatacctaggtatcagctcgatatccagggtaccaggtatcagtcaatacccaggtaccaaggcctgatacctaggtatcagctcgatacccaaggtactaggtatcagtcgataccagggtaccagctaataccagtgtattagataccacctcgataccttacccaaggtaccagggaggattggataaggtggaatcacatgatagcgtgggtctccccacgaaattgacgatgcatattaaatctctcaggattttagttgtcccgtgactaacaagagtaacggaatcccgtggggtagcagccctcatatattattctgtctggggaagctatgtgagaaaaatttataacttcgcaagccacctaatatgcaccactccactagtttttacaaaaccagctaatttcgagctgcaccacctccgggttgaccaacccagccgcccgccaatggcgaccgccgccgccgacgagctcgcgctgcggcggctggacgacgccacccgcgacgcccggaggcttcagctcgagaccctccgcgccatcctcgccgagaatgccggcgccgcctacctccgccggtacatcccctccgacggcggcgcccaccacctcctccgctccaccgacctcgccgcggcggccgacgaattccgcctcctcgtccccgtcacctcctacgacgactacgccgagtccatccgccgcgtcgcggatggcgacgctgcccccgacgagctctcgccgcgccccctcctctgcttcttcctcaggtgatccacctctcctcctttccactcttcacttccatcagaatttctccaccaatccatggctgatccgatcgacgtgcagctctgggacgagctcgctgcggccgaagctgataccctacttggattcgccgggggcgagggccgccaccgccgccgtgatgcaggccaactccgccctcgtcagaaggtgttcgacgccgacctcctcagccttcaccatgtttcacactgatcagggctctgatctgatctgattctttcaggctgttccctccacggccggcggtgagcaaggcgctgtggttcttgtacgccggcgaggtcaggaagacgaagggtggatacgaggccatggcggcgacggcgtggggcatccggagcagcggcatccggggagcctcgccggtgatgtccgcctgcgtcagccccgccgaggtcatcctcggcgccgaccaccagcagcagatgtactgccacctcctctgcggcctccgccgatgggacgccgtcgactgcatccgcgcgccgtacgccgccgccctggcgcgcgccctccgcctcctccagtccaagtggcgtcaactctgcgatgacctcgagtgcgggacagtctgcgccgacgtcgtcaccgacgcggcgatgagaggcgccgtccaggacggagtgctcgccgggccatgccccgagctcgccggccgcgtccgccgaatctgcgagagggatgactggcgcggcgtgctgcgccaactgtggccggacgcgaggtacatctcctgcgtcacgacggggaccatggagcagtacttcccggcgatcaagcacttcgccggcgaggcgttgccggtgctcggaacggactacctcgcctccgagtgcgccatcggcatcaacctggagcgcacgtcgccgcctgaggaaaccacctacgtgctcctccccagggcggcatacttcgagttcatcccgttcgacatggacgccgccggccgcggcgccgccgcggcagagccggtggacatcgccggcgtggaggccggcaagacgtacgagttggtggccaccacgttccgtgggctgtaccggtacaaagtcggcgacgtcgtgaagatcgccggcttccaccactcctcccctcggcttcagttcgtgacccgcgcgccgccgccgcaagaacacggcgaggtgctcaccgagagggacgtcatggccgccatggacaccttccagctcatgctaaaggacggcggcgaggttatcgaatttgcggcgttcatcattgacggcgacggaggccagcggcggcggcgatgcgcgacgatcgccgtcgaggtgagcaatggaagcaagctgctcgaccatgagaggtcagccgccttcctcaggcgatgcaccgcgccgctcgagggctgcctcggcggagcgtacaggctgagcagagccaccggcgacgtcgcgccgctggaggtcgccgtggtgaggcccggcacgttcgacaggctcgccgaggccgcgatccgcggcggcgctccggcgaaccagtacaagccgcccaagatcgtcaggcaccggcacctcgtcgatgtgctgcaatcctccgtggtgtgcagcagcagctcaatcactgaaccagctgctcactagcatctgtctcattgtgtcactgaaccagcggcagtttcttgatcgtgagtccaattccggcactgacaaggtgttcatctccgattcgattctgaattttcagcactggggaggtttcagtctccgattcgatctacaagaagaatccctcaccctttataaggatcacccaagctagagggaatcgtcggtcggttgctctcgtttggtcagcgctgatttcagaaattcagacttgcgtccccgcaaaaaaaaaaaaaaagaaaagaaattcagacttgtgcagttcagaagcagaagagatggaagctgcatcatcatcgggagctctgccattgccgttgccattgctcgtccatgatcttggaacccgtagcgatgactcgcagacgcaattcagcatctgcaaccaagcactcagcactgcagccatcgagctactgagagatttcaggtgcttcgagactccacaaggctgggtactcactctgaatcctgcgtcactgcaaaccttcctatggcgacctcaggacagcaagaagatcgatctcccaacggcgaaacagaacttccctagaagcggcaagtgcctcctctccggcaacccaatctcgtcgtcgtcagattgcgccgtgttggtactagatcttgacaccccagcgatgctagtctgcaagatcggaggcagtgaatgggattctttcagctacgagctctccatggtcagcaagaacaacaagaccctggaggttcacatggccaagcttcagggcatcgatgctgttgccggcaaggtgtactacacattctcaggagacgctctcggagtaatcgagttcagcctggaggtaaaactctctaccatggatgtcgacatggttgaattgcctgccagtatgccaaacttctcgacagtcatgcggcgagctgtttcttgtggtcgtcttcttcctcggccacaacctgcacaggatcgcggaggtggcggtgtacaagatggatttctcggggccatcagagtggtgcaaggtggacgggatcggtgacagtgtgtttcttctcggtggagatttcatcggagcttctaattttggagcgtcgtgctcggctagtgaccatggtttgtccgggaattgcatcaattttgtgaacaatattgccgctgaggagaattttgttcatgtcatcgacttggagaaagggactgaagaagtgcttcggcctttcagacacaaaggatacccgctgccgctgcgtccacccttctggctattaaccacccatgattgatatcttttccttgtagaatttgcacctcacttgtcatatttgttaaagtaggtttacagttaaatttgtcatttttgttacgaattatagaaatcgaatttaaatttatgtctgtggagttatatattttatataaatctattttattttttttaagaaaataataactatgtagttggcaatttggcatacaaggaaaaaaaaacaatttcacctcctaagtaacaacaaaaattcgtaccatagggacatagggtcactgacattgaacaacaatataaaagtttatcttaaatcataattaacaggtgaggatatgtttagtagaacttcaactctcagatctacctaaagctcaaccaaacggttcagcttaaaaaaactagagagctagatggaacgttctgaaaaaatgtactagcgtcgtggtgaagcggggaaaggcagcttaaatttctgaggaaatttctgttgatcagacgagttctgcaacaggagccaaggaaatagtcctcaacaatattcagataaaactagaagactgacagaagagagaacgcatgcaacaacaagtaaatcatctgcgtcgtcacgtcacgggtgcacgtagacgccgacggcgtcgagcagccacccagaccgcgcgaagaagccgacgacgcggccgccgcccttcaccggcacgcggaacgccgcgccgccgacctcctcgccgaacggcccgtgcgtcttcccggcgctggtgacgaacgccagcgacctgacgacgcacgcgtgggggccccacggcccgagcgtcccggagacctccgtgacgcgctccgcctcgccgagcttcaccttgtgcttctccccgccggagccgccccacggcccggcggcgtgcttcgcgccgtcgatggcagcgtaggtgaaggacagcgcgtcgatggcgccgccgctcctgacctcgatgctcaccaggcggtgcggcgccgcgccggcgccgagggcgatgtcctgcgggtcgccgccgtcgccgccccatggaccgatcttggcgagcccctccatctccctcctgcacgacgcggacgaacaccttgcaacacacctatctactcctatatactactcacgtacacagcgcacgaacaccccttggtatctccgaggcgattaatggattgaatttttcagtaaatgcattgaattcaaaccaaatcgtactattggttatcgagcaccagaggccggtttgaatgaattaatgcggaattttgaacggcgccttcagttttcgatgtgacttttgagctgccacgttactccctcattcccaaattaatcatcatataataaatttaaaatttcttaaattgatcatcatataaccgcatagatatggattttatcataatacaattagtacagcatgggagaatgtgtgaatgtgtgcatgctaaggtatactccctccattccataatgatcagcatatttcattgtggcatcaagaccaaggagagatcctctacccgttttctatttaatccttgtaattaatctccatattaatcggcttggagaaacgaaacgacgttactgccgctgcatgattgcacaggcaaggaatgttccatgctgcatgcagctcgaaaatcgcatggcctactcgatctccgtgataactagttaatccatccaacatgcacatgctaccagcgataatatgctgatcaaatcggaatatctccactttcgttatgtgctgattattatggaatggagggagtaattggtatggtgttttaatttatgcatgcactgtgagagaatgtgtacatggtgtcttggttgatgtgatttagacaaattatccttggtctcggtagataaacatactccctctgtccataattatagaggattttggtctttagatttgtctaaaattatggacgactttgcttctcccaataggatgagtacaaccgtcattagtaatcgaactcccatcctttgtagtatgcttatgctaaattaaattattgattggaatccaataaaccattttaatattaattggttgcatgcatgtatatgattcctttcttttgtcacatagtggataagttaattcttcctctatcttgatgaaaaacaagtcttagacatttaaatggaagaagtactatgtttaagcaggtagattataaaaactaaatgtagaaatgaattgttttgtttcacttgatagaaagtaaaacaaacaattttatctctaggtacataatctttccgtcccaaaataaactaatttttagagtttaaattttatctctaaataagctaatttatgtatttttttatatatacctttagtccacaaaatcaataggtttattccttcagtatgtcttgctgcacctacctactccctccataaaaaaaaatcaaactagtattagatggagcctttcctaatacaactaatttgaacatactcatatctaaattcattgtactagaaaatatctcgtccgatattaggttagccattttgggacaaatggagtacgtactaatgctatacttgtacttcaaccatttcaaaatataaggcataatttttttttaagatgtttcataatataaggcatgcgtgcatgcatgtaattaactagcgtctactattaaattttaacctattcattctcaagatctctaattttattgtattaggatgattcaaacaataaggtaataataattattatttttttgtctttaggtaaaaatgtgattatgccttattctttgaaatagaaaaaaaattatattttatgcattgaaaagcgagcagtcgagtctttaatgtgacaaagcaagtacaaataacgaacaccagaacaccagagaatgcaatagaggatcagcaccagcttggctaggttgaatgatagtgcgaggctagctagggtcaacgccaacgccaacgccaacgccaatggttcagggcaggtaattgcactgcaaacatagtactgtactgctcgtttcaaaatgtaataattttcaactataaacttagtcagttgtttgtctaaattcataactataaatgattatattttagaatagagatagtactattttaaccatataatggtcctagaaacataaaactagtgatgttaaactgtatgaatttatagaagagtatagtagatgggcctggtgtgtcattaggtccctgaactcctaaaatgcatttttaggtcccttgctatgtatgtcatataggtccaaacgagttctaacccgttccatgcgctgacgtggcaatgccacggtgacgtctacgtgtcagtggaatccacatgtcaaacatatataaaaattaaaattaaaaaccatattttctcctcttaggtagacagaaaaaagataaaaattataaggtagagaggagaaaatatgtttttctaattatattttattctatgtgactagcacgtgagtccaactaacacgtatacactatcgtggcatgccacgtcagcgcatgaaggggttggagctcgtttggacctatataacacccaaaaaaagtttaaggacccaaaaatacattttgagagtttagggacctaaatgacacacccgtttagacctatatgacaccaaaacaagtttaaggacccaaaaatacattttgagagtttagggatctagatgacacacccgcacaagtttgaggaccgctcgtgcacttcactctttatagaaattaattgtcaaagatataaatttttgacttagaacaaagcttgaacaccaaagtaatttgaaacatagtagttcaaatactagagctgaattacaggctaaaggagggaaaatacttgaaatgcaattaagttttacaagttacagcaatgtcagatagtagtacatagttgcagctcctagctctgcaaagggaacaatgttcctgagaacgaaatactaaagcaatgtccaacattgtgctgtttacatgatccttcttcggatttacttggaaaataaattgaatagcagcatcagtcaggtcagtaaagagtcccttgttttctcagcaagaaaatgttacagtccacttgttgcttccagtttccactatacccccttcgaactgaatcatgtgatgtccaattccatgagatcttgtttgtgtaccagatcattcagaggttgagctatgaagaaatgaagaaacaggcagcctaatccactagggcttgcagtacaattctactgtttttatcatggaaaagcccccaagaaacaatacaagtctgtacagaatgacatgttttaaatgtctaagaatttactacatagaacaataaacccatgctgatgctgtggtaataactagcgttttcgctggtgcgctgcagaaatttaccagtggccactccgaccatcgacggtagcaggcagtttgttcgccacatatggcttcggtggaccggtttggctggaatcgatcctttcaacatcacctgtttcactcttgcaggtctggtttcttctggggtatgagctccccagaggaacactgctgtttggagcaattgctgggttccgaacaacccttcgctgctcatattgttgctcagcagcggatgtcgaacagttaccgtatactcaacaccgaaccaactgctatacacaggtcttgcagcagcacctggaagataggtaacgtgcaaaatctatcttgagtcacacaatgtatgaaagatataatggaggatacaagtttaattgcaggttaaagtcaaatggtaaggacagatgctaaccttgagggattctgcttgcaccgactgaagcagaatcgtgtgattttagattgttgtttatgattaaacacctggaaagatccttagtgacactggatgtgctttgtggccggtaatatgaatagacaacacaaggcctgtcgatacaatagtagatagtcaagaatcaagtatatattcaactggagctacaagttccatcggttaatccatgtcatataaaataaaataaaataaatatcttaccttggtaatgagttatgttgtctctcaggtggagctgctgttgatcccttggcataatgttcttcaaggtatgcaaactgttttttaaaatggtctactgcactgtaaacataatagagtaattgatcttagttctttgaattatctcaagtttttgtcgtgcctaatcgatttcgagcaacaaatagagcaattaaaataagtaatcactacttaatacggtgcatcaacaaaacagtcaattcgcataaatatttgttatttaattgttaacctggacatatagcatgttcaacaacatacaactggcctggcagttcaacaataagatcactaaattgtctcagaaattataataggaacaactcagttgaagattttaaagcaatggaataaaaataaacttggcatgactacacaccttgggtacatgaaaccagtggactcagttccctcaaggaactccctcagcatctttggatgatactccagaatttctctatatatgagttcccttatatcttccttagtaattctccgcctctcgaactcaaactctagctttgtgataggttgagcagaaggctctctatcaacattggctatgttcttgaaataaggatcagcaagcgcctgaaaatgtggctgctacattagctgctgacacttgagataacacaccaaaaaaaaaaaaagatgcaaggttgatgctaatactgacaatacctcctcagcacttggccgatcttttggatcaaaagctaacattctctctaacaaccgcattgcaagtggatctgcatttgggaacttctgtgtaaatggtataggttttttccgcctcatactgttcaagtaacgtcttgccttctcatttctaatctgttgcataagtgaatgtagatataagcattataggatttt

SEQ ID NO: 74868 - DNA, 3792 bp, Oryza sativa
aagaaggaggggggagagagagagaggacagagagggcgaatggtagggggggactcgggatcgcggtattatgagggggggcgcgtttcggtcaggtcggtttgggtttggggttgcgttgcatcgggttcgcccgggtcaaccgcggtggatcgggtggagggagttgggccgtgtacctacacgcggcggcggcccaattttgtactggagatgggccaccggcatttggtgagtccagctacgtctctagatcggcctgtgggtgtactgggacggaaactatctttgttgggttagatgggcttcaatagtcactaggaataagtctattttttgtctatcctatcttgctgagtactgggaccgaaactatctttcttgggttagatgggcttcaatagtcactaggagtaagtctactttgcgttcatcatctcttgctcctgattgaattgtctccctctatcgtaaaactagatataacgctttccacgtcttgggaaaccggtgcaaatcgatttctatggtggtttttggaaacggtttctaccgacatcacaaattgaccacaattgactcattgagtgagttagcaggggttagtttttccttccttccaattttacgtcggcctataagtacgggaccgaaacaaatattgtcaatgggcttcaatagccgctatgaaggcacattgaggtgaacactaaagcccgttcctccgtcagggcaatttaccactccttccgtttaatactttaagacgtaactttttccttgcaagtctagctagttttagagaaatatagcaacttttataacatcaaaatagtttttcgctacatcaaaaattaaatatattttatactttatttgtctggtgttgaaaatatcactactatgttttctataattcggtcatacttaacattgattaagaacaaagttaaagtcttataatatataacggatggagtaattatcatcgcaaaaaatcacgtcaattagacctagactttaacatagtaccattttttacaggcaacggtgttttgtatttttttttattgcgatacttttaaattttctctactcctaataattatatgtctggttactcacccaccttacaatgctcgtattatttgcttcttagcagtgtaaactaatgttgcttcttatgagtttcaccgtctttaccactacaccagtccttcgtcctaatagtcatctccaccacgttggtattgtttacaccaatattatcccctacaaccattaccccacacccctagaagcaatctcaaccttaccgaccccatttcgcctacctttccctaggagatccattactggcttcttacatattcatcacgctgtcattaatcgcttgcctaaactagcggaataatcggttcccaatctcctattgatatctttgaccttataagttatttgccatcaccattaataacttggaggtaaaggataccttacaatagttagttgttttcaaattgagatttgcttagacattccctaaacatataggctgcgttcgatactccaacaagaattggatgaaattttgaatactcgtaacatgtttttcaaactgctaaacggtgtattttcgtgtgaaaactttacatatgaaagttgctctaaaatatcggattaatcaaattttcaagtttgtaataattaaaactcaattaatcacatgttattaccacctcattttacgtgaagcacttaatctttatctttatcttaatcttcatcttcatcttcaggagattcaaacagccattcccgtcgcatatgagattaagatcataggtttgcctcaagttacaaccgataaatctaacgcctctttgggggaaaaaactgcatatggtacatgaaaagatatatgttcttttatttattttgctcactccttcgctttccgaaatgccttcgtcagtaaaaaggggaaacaatgccttgagcgcccggcgtgcaacggtgtttgtgaacttcactctacggcttcaaatccggcgttttccacacaacaccctgtgtgatctgacggcatccaacgttttccattcggctggatgaaaacgaactggtcagttcatcctgacagatacatttgcaccaatcgatgcctgggtcactcaagtctctcttcagattaagtaccttcgaagattgccaactcggttgcttctcatatatcctttcgatgttgttcacacgtattccttgcccatgtcaccaaaatctcaaaacaattcgaattagtgtacataataactgcagtttatctaacaaaaaatgcaactagatttcataactgtacatgtacttcgctatcaacaaacagtgcacgcttcggttcttgtctgttggaatagagaaatcagaactgcagaaagccaatcggtttgcactaacctgggctacatgattttccaagtcagcacttagtatatactgttaatataaccgggtcaagatggcacgaggcggctgcattgatcagcaatacagtgaccgttgagatgattgttttttttaataaaaaaaacagatatagttattaagatgataatttcatccttacaagaaactgtctaaccaatcgggatttcgtgagctgagaagttgctgcactgatttaaacaaattgagtctacatcttcgagtcatgaacaagcaaacagcatagaccaaaaaactcacaggaaactataacccatatggatcactatcaaaatctccctgctaataaatttcatgcttatcatagggataatgtgccttcgtgttaagtagccaggcacgtacatgtgtgtcgatctccttaattaattgccacatttcaatcgaaacaagctactattctcttcaagcaactaacctccaaattcatcatggatttctttacacccaagtggcctataaaatcacgagaattcgatcagcttagaaccatttaaaaggaggaggtagccaatggaagaaggcatcaaggaggagacgaaggcagcagcagcagcgagctcaggtcagacgacggcggcggcggcgacgagcaagagcaacagcaccaccgtgggcgacatggcggacacgacgttcaagagcatcggcgacgtgctgaagctgctgccgacggcgacggtgatcgtgtacgaggtgctgaccccgatcgtcaccaacaccggcgactgccacgtggcgaacaaggtcgtcacgccggtgatcctggtgctctgcgccttcttctgcgcgttctcgcagttcacggacagctacgtcggcgccgacggcaaggtgaggtacgggctggtgacggcgagggggctgctgccgttcagcggcggcggcggcgccgacggcggggacgccgccggcagggacttctccaagtacaggctgcggttcggcgacttcgtccacgccttcttctccgtggcggtgttcgccgcggtggcgctgctcgccgacgccaacacggtgtcgtgcttctacccgtcgctcaaggaccagcagaagaaggtggtcatggcgctccccgtcgtcgtcggcgcgctcgccagcgtcgtcttcgtcgtgttcccgtccacccgccacgggatcggctacccgccggcgaagcccgccacggcgtcgctggcgtcgctgtaggcggcgagcccgattagtcgatttgcattgccatgcaggcatgtgcttcctttttatgggttgtgtttttttaaatatttgcacgtgtgcatatgtgttct

SEQ ID NO: 74869 - DNA, 6353 bp, Oryza sativa
  unsure (1)..(6353): unsure at all n locations
agtcgatttcagtgagaggaggaaaaggcataaatctctagtgaacattgcagatgatgccagcattccaatgtggacaccagaaaaagtaagggctggggtttcttcatatagcaaggatgagaatgaagacgatgccgaagatgaatccacacaagtgttttgcaggggggcagttttacatggaagacccttagaaggaaaaggtcaagccacttctccaattcctcagattcaaaagggcgctcggcattctaatcttgggattcaggaatgttgttgccctgatgcatttgtttgaatcctctcctttgagaaaggagtgctcctggatagaaattaacagggggtatttagggtacatttaagcttacaaattttaggattagtggtattgtatggatttcttggtattaaattgtgtccatcagaactaaaacatcgtagttggctttctggtataaagtagatgtactgttcgtctcgccgtgatatatccagtggcagagtggctttctggtgtgaagaattatactgttggtcgtgttttgggagtggtgtttattggtaatctatcgagcgatcggtgttaatctagctaggtttctgcaatggatcatatccatggttgtgcgctctgtgcggccggatgatcgcattaaatattcatcatttttgcgcgagcaatttatacatacgatgaaaccaggaaagttaaataaatttggactataaggtgctccctctacattctggactgaggatatcaaagcaagtttatttgtttatcctatatgaatgtgacatctttctggtttgaaaatcgttggcactctacacgtcctggtgcctaactgcctatgtctaatgcatggaatttagaaatgtcaatagaattattggcattagtttcttgatgattatgttcaagagatacacttacaaataagatataaatgatagtctgtatttatatagttggaaaaaaattagcatcttcaattgaggtgctaaatttggctctccaaatcttcgttccgccgttctcaccaaaatattgttttttttttggtccactccaacagactcttttacgttaattggatttgcatgtcaacttgcatattagcgggacttgtacatgagaggaagggaaagagagagtatgggtagggaaacaaaaatagaatggtcagggtggctaaatttgggcactaaaaaaattgttgttgtttttgtcatgttggctaatactccctctctccgtactcgtaaagtaagtcgttttggacagccacacggtctccaaaactcaaatttgacttcttgtttctataaaaatatttattgaaaagtgatatatgtatatttttatgaaagtatttttcaagacaaatctattcatataatttttacatttccaaactcaacagcttgagagttattcatgattttatattttcaaggtttgacttaaacattgtcctaaacgactttctttacgagtacgaagggagtatttcttaagatagagtgagacggcttgaagcatttattacattcaaataagtaggcacaaaaagtatcttcgatattttgcctactcgaaaattaccgcacatcttaaataaatataaatacagagtaataatttagagggatagatagtgagagggagaagaaattaaaattttactgccccgtttcagactatagttgtttagattttagtcaaaatcaaattgctctaaatttaattaactttgtagacaaattcagtaatataatatttacgacaccaaattaatttcattaaatctataaaatatattttgagtaacttgcatattgggtctatattttttacttggactagaggcaatctaacctttccactatgaaccacctaattttacaatcgatttcagtttggacctccgtttcctcaagcttcctctccctccccacttctccatgttgcaggaacatcaccggtgaaagaccctatccggcaccaccgctgcactcagcatcatccctcacaacctccattcttgacatcgagcctccgtagcaccgacgcggcgttcgacctcaagtcctattggtatcggcgctggcgcaataacatccgtcagccaagctagcaccacctgtgtgccccatggctttggtccttgtcttgagctcgagctccaccggtcggcaccatgctacacctcgagctccgccagcnnnnnnnnnnnnnnnnnnnnnnnctgtccctgcaatggccaaggccaatggagaatttcttttctgctttctttctgaccgcaagtgaaaatctaggtgggggagatatcgagatgccactcaagcttgcaatgctggggagctccggcgtgagtgctgcagcggcggtggactggtggttgctcaacctactcggcaaacctgctcatggtagggaaagctgaaggtagaagaacatgcccatggtgaaccatttggtaatttttcttggtccaagttgaaaatgtcagcttatctctggtccaaagtgcgatagtggtaaaacaatgtgaccctatgtacaatttactcatatatttttataatgtatttgtcttatgttaaatatattactactctttttataaacttggagtagcttaactttgaccaaagtcaaaacgacttatagagtttgtttgggggagtttctagctgctgcagcttctcccagaatcaaaagctcccccaaacggtgcagcttttggttcagattatgagaagctggagttacagaatctagaaaaataaattgaagccagaagttgagaaacctagttttttcagattctcggaagttggctaacaaacaagtgtttatcataatcttaagctccttcaaacaaccccataatctgaaaatagatagaatatatggctctgaattccattatattgttggaatctactactccactacacgcaaattttggattaactgagatcattatttgtgtattgccctttcactagaagctactgacaggtaggcctcgctcttccatggcctggccccacatgtcaaccacctgtaattcctcctctcctaatgaatcaacccaatggcccacttgtcagtgaccctgttcccatcctaaccgcagaaaccctaactccccacaaagccttcctcccaaaccctccgcctccgccttccccttcccgctctctctctctctcccacgtgagcgcgaggcggcggcggcggcggcgcgaggtgagcggggcaccagcggcggcggaggagatggggaaggcctcgaaggggtcgcggagagggaagaaggcgtggcgcgccaacatcagcaccgacgacatcgaggacttcttcgagaagcagacgcgcgacgcgcacgccggggccgccgccatcccgtccctgccctccgactccctcttcttcgtcgacaagccggcctccgccgcgtccacctcctccgccgccgacgccgccgcggcggatgtcgcccccaaaggtaaaatcacaaggcacgtggggtcgagcgtgtggatgttgctgggtgatagactcccgagtcttctacctcgtggttcgggttgtggtagtagtttcgaatcgacgctaaagtttgtgttcttggaatgcttaatgtgaaaaatcgcttcatatagtcgcgtcaagctggttctatcaccatttatctatatatattgttttgatactgtgaagattagttaaccttcagtttgggacctgaggatatgctctgttacttttaaccgctccttttgatatttaattataaagtggttcatatcagcaatgaattatctcacttgcttcaaagtaggcgcaaagtttctaaatgagttaatgtttattgtgtctattccctcgtaacctctgtgtttcctgctaatgtatcccttggtgtgttggcacttttgtttactggctatagatattcctgtccaaaggaagattgagaagaagagagagaaggttctatatcatgagagtgtattgaagcggaatccatatgtacaaccagtcccgtcttctttaacgacaaagaaggataagaagaagtcaaagaagaaggaatcgaaagagacacaggaagcgaaaattgttcccatggtatcaattgcttttatttgagacaaaatgaatttccttttgttcaagtcccaggttgctaaggtggactcatctgttttacaggaagatgattcaggtgataagatccttgacatctggggtgaagatgttaaaggagatcacaaggctaaaaaggtgttgctatgctccgcattctgttaatctgttttcactttctctatttgtattacaaaaagtcgatttttagaactatgcagtcatatttttcaaaatttacaaatctcttctgttgcaatatgctgaatttgtgggttttgtatatcaattttaatttgttagtttctttttttttctttttatcatttttgttgcagaggtctaccgcatctgtgattcctgctgttgaagttgaggccccaggatgttcatttaatcccccattcgaagcacatcaggtatgttttgtaatttatgttccggatttggcaatgttacccatgttttaggaactgatgatccttatattagtggatatcttagcacttatatttaacaacaaaatcctgttgacattgtaggattctcttgctcaagctgttgctgatgagatgcgtaaaatctacacgaaagagttagggcccaaacctgtgccacttattgttcctggtgaagcaatcactgaagaagatgtaagtcttatgcatctctttgccaatagatggttgaaatttctatattctcatgtcttggaaatgttacacgcgctctcaactttttagttactttgcaatgaaaactgcctttttgtgaacttcgttgtgtattatgagttgagtatttttggagttggattccatatacaatgccagtatgttctgtggtatattcatttagaatagcatggcccttcaggccttcaccttactagtggattgtgcttgtgatgtctatgtagcatttttgcgtacaatcttacttataccttttttctgcatgttgcctacagaaattttttcttgatgcggatgatggagatgaagctgttgaagaaggtgatgaagaccaggctgctgatgctttggctgttcagaggttagattcgactgttctattggaagtatagttttaataggttatgcacttatgctgtacgatagacttatgcgtgatgcttaaatttccaaagcttttacatgcttttagggataacatggtcactatgcccttaatatatattttcaaagcttttatgttttaatatatctttttccatttctatatgataataagctaatggggcaaaatatgggttatccctgtttagagtttttatattcctcaattgctatgtggcacttgctaagtaattatattagaattcaggtttactgtatttgtgaaaataaccatgaaagtcacagcttataacttaagaattctggaattaccatgtgctgttcttgatgaacaaaacacactgttctgactcagtaaattttaaatttgtcttgcaaacactattagagtgtacttttgattgtatgatttattattttttcaggaaaactaaaacgaaaagagttacaagagtagaactgaacaaaagagctcgtcgtaaggagaggttaagagcagaagctgaagcaaagaagatggaaaatctttcaaaggaaatagataggtagttctttttatttttgttcactaatctcccaagatctgccatttcagtcaaagttagcttgtattattatattattctttttgcagcctgcctgatataataaatgaaattgctaaagaagatgaggaaaaggagaaaaggcacataaggcgaactgtggctaaacaggaaagactgaagtcagccccgcctcgtctgggcagacacaagtacacctctaaaatcacctactctaagtcactcatattttcttacagcaattcctttaatcttggataaaattgctacactgttttaaagattctgcaaattaacaaaatagtttagtttgcatatttcacatataatgatgccatagtatatcatggagacatttaagttagtaggcaagatgtttcatggacactcaagtagaacaataattttagaataccgtgatgtagtagtcgtattctttttggaagtgaggcagttgagtactccctccgtttcatattagaagactttctagcatttgcctacattcatata

SEQ ID NO: 74870 - DNA, 3889 bp, Oryza sativa
atccccgcgcgcgcgaggcggacggcggaggcggcggcggcggcggctcctctcgtgcgcgagacggacggcgacggcggcggcggatccccacgcgcgcgaggcggacggctgaggcggcggcggcggctcctctcgcgcgtgaggcggacggcgacagcggcggaggcttctcgcgcgcgcgaggcggatggcgatggcggcggcggatccccgcgcgcgcgaggcggatggcgattcccatgcgcgaggcggacggcggaggcggtagcggcggaggagacgaagatggtggcgttgagtggcgacctcggcagcgtcgacgacggcgtcggtaacggacgacgacgaggcgtcctcggcagcagagggcaaccggtggcggtttcgacagcagacaacggggcgccggcaacggacgacgacgcggcggcctttgcagcgaacggaggtgggcctgataggggacgacaacggtggagggggcggcgctggcggagaggtgccggcgcgttgggcagtggagaagcggaggaggaatcgcggcagagagagagtgcgggatgggatgggagggggaaaaggcgtgggacccacgtttggctaggctattttggccggccaaagttggccggcgcgagtagtattttggccagccagccggctggccaggctgttggagcacgattttgatctaaaattgctaaaattttgcttggagagtgaagtaagggggctgttggagatgctcttattgtcttttcctttccaattgactctcatcagttctattctcccttttatttactagatgccctttgatgggtataattcggttgtgtgtgtgtcaagtttatctacttattctgttctatctattttgagcaactttagtttaccttgtggaaatttctatgcagtataaagaattaaagaaaggacacataaaatgtgagcttgagagagtatgaagttacctcccagaaaaatatacagtgcaaaatttccatatgttaagttcgtggtatagaaaatatggaagcattctcacctcatataaagggcgccgcatatatgtatttatatcagttggaaattgtgaaagacacctggactttacattatatttgctaatcgaactgaacatatcaaatcaatttgcaagcataatataaattctgaagcctcgagtaaagaacataagagacattgctgggactttaccatgtcagtcaactttagcctgagatatgtccgtcaaaccatacgaaggcggtgaccagatgtgttgcacatttaggagacttgacaaaaatggctaaaactctatgacattccaaatgttctaaacccatactcatgtgaagctagttctcaagatgcgcactagctccacactttcatcttaagcaataatacacaaagcaaataaacctaagacaaataaaattcagattacatcaactttaaatacacataggccgacaggccaaataatctgagattcgcggaagcttagctacccagaccacaagcaaaccgactagggataaactcctaattgaatcaagtcctagaagaaacagtcgaagccggcaccattcaaatttatctaagcatttaacctgcaaagatggatattccagtataacaagagttagtacattattaaaaataatgtattggcaggccaatatcaatcctaacatgctacatgtaaggcatatattcaaaggagggaaatatgtagttcaattttagcataaagcaagttttgattcacaattcttttgtaaaaagttgatgattcaattaacaaaacaaatttgtaaatttatcatatatataacatcatatcatcttaagcatacccttgttgccttccttggcaacaagtcatataatcatcatcacactcatacaactcaacacaaatcatccatttcaaattgcggtttcataaacataatttaaaacaatgagtctatactcatgtgaccgtgagcacgactaatcgattagtttttgaactctgcacagtttgtacagctttacccacatgatgtgaatcactctggtttgtccggtacctgtcagtactaccacactctacatattgaatgtggtctagaggttacaacgtagcctttaaattacctaatgcctagccttgcatcatcgatggcaagtgtggctccatcctaggcatatgacctagaatcattaggtggcaggcccacgccttcaaccaaactccgtggcaacgaacatatccgttcccccacgaggcactatactgttgaattggatagactgagacgcccatgccgtgaggaaggacaaatccgtccactcacgtaacacacacgtagggaatcatcctacaatcaaacagacacacatgagtagttcctatgaatcatcgctaagactaattcattctatttcggccttcatatgcaagactagacattaaataacttaattagccaagggcataccataattagcacatgtagatatacggttaactttaagttggtgacacaagttcagtcgttgggcaaacactcccccctatcagtgtgcaactaccaccatatgcacaccacttgccgcccaagtctaaaacctcattttcacacctttagttcacaaataagtaaatatttccaaatctgtccagcagtgaaattatgcccaaaatttcacttaaaaagttttcataatgtgatttggcatattctaagcatggctaagcatatagtagcatattaagcatttatagtcccaaatgagcacaagtgatgtactctaaccattcctaagtatacaaatggagaggtgtacaataattcaaaggagtttatgcaacaagttatggataactaccatttcccaagttttcaaatattggtttaagaaaatataaatgcaattttgcaaacaacacttttcatctcccaaaacatgggtttcaatgtgatcaaagagaaggggaggaagaacttgccttaatcttgagaaactagatagcatttaattcactccttcaccgaaaaaaacaataatctatacaaataacaccgtatgcaaataaataccgaaatctgctaaaaatacaaaatgctctaaaatgcgtgagtttgctaccatgaataggtgctgtgtggataggatttgtggtgaaagaatttctagtttatctattcacatttgtgagttattaattttcaaaatgtaatattaacaattgggtaattaaactctattagtacttaggtgcatcttaggtccatgatttgtgatgcgttcagttgctgcagtgaagtataggttctcaggagtacaacaaaattggtttcacaatatttaggattaacatgatttttcctttgaattttataagtaggatatcacattataggtttcggtagctatactgattcttagacatgtctgggtactgtaagggccatattttattgtataacaattaagctcatgatttttccaatctaacaaatctagaaccacctcatttggagttggaataaattttatatgattttttagaagtttttatactattcttttgcattaatcctttattcaaattttaatgatgttttggttatggtttcatctagagattagtctacagatctaaagtgcatacttttgtgaaactaactaattttagttttgcccattttgagttaaaatgaattacttatggattttgtagtttctaatttgcattatactagttattttactaaataaacatttggtgatgtttttattacaggatgttgcaagttttagttcatgataattaagaatatggttttgtgagcacactggaactttattcactcaaaataag

SEQ ID NO: 74871 - DNA, 18865 bp, Oryza sativa
tgttggaaaaagcactcgcgctcacgaatctgtaaaacaacaataccgatttttctgacccccttaatttgaaaacccaaaaaaaaaaagcacatcaactccaaattgaatggatccaactaaaaataaacagccacagcaagaacaagatggatcagccaaaaataaaacacacagcttcaactcaccgagatctcgaaccaagaagacgagctccgaccacacagccgctagcaaatcgaagaagaaatcagcagcagcagcacaggtagaaacaactcctaggagatcccaagaaccatcagagatgtggatctcctctctctctcctccggggaaagtgagcaagaaaggcaggatcttttaaggcagcagcagtccagcaagaacaagaaaagagagccgcacagctcactgatcctcacgcgcacaaggcaaaaagaaagggaagggaagaacaagctagctagctggaagagacctggaagaagaggaggatgcggccaagaaatccagctgtgatctaggcaaagctcatggaggagagaggagaggagaggaggtggtagctggggagtcgagactggagagagagatcgttgtggcctctgcttttccgattgattgatttatgctggtaattgcaggttgatttcgctttcgtttcttggaaaaaaaatttttctcttggtgttgtttggtctggaggtgagagagctcccactagaataagggattggagcacatggagccatctggtttctgacgttctgtccacatcttgtgtttcttttgattatttactcttcttttttctattatattaaaaaatataaaaagaattggtactctactttgtttttctaaaacaagaaatatgtgatataattattatatatatatatattgaaaaatctaaaaacaaccgttgaataaaaatgaacgtctttgtctatatcattaaaagtaaaatttttacgctaagatttaactatgagttttactacgagaagaaaaggtttatgtttgtaacgtagacaaatcatagccgtttatttttatatctatccttatatatgcggtttgcttgacatatttttccggtttcttaagcaaactaatttaagtgtagaacttaaatttaattttatgagaaactaatttggtgttgtttttctataaatgttgtgacttagggcatgttcatattgtagccaaaataaacattaccaagttttggcaatattgctaaaattttggtaagatttcttatgtattgatcaaatttggcaacaaactaaatgtatttttttttgcaattttggcaactttgccaaaaaatggtatggttgaaaatggtatcaaagtgaacagacccttagaaaacttataattacttataatatgtgacagagagagcaatttggcttaatatatttttacgccgaggcaaaaaataatttattcataacaaaaagtccaaaacgggatgtctttatctactagagaaaatacgcgtaggaataatgagaaaggaccatgtccaggcttcctgtttaaggaaaaatggaagagatgaagcaatatgaatttcaacctttcctgaaaagatataaatttctatcattgctgaggtgtgacagcgtttgtgcagcatatagctatagaaagcatctgctcttcaattatttcccgttcctgtgtactgagaatgtaggcaacggaccgcaaattgaatgaacatttgtgtagcccctatagttcctggcaagaattcaagtgaatttactagtatttacatagagacagctaagctggagtgctggactagttatgcaaggaaatatctttatctattttaacgagtattaagcaatgccctctttttgtttatgtgatcaggcaagtagtaattccatgcttgatcattgttttttttttctaaacatgtatccatgtaaagaccattaaagaataattacacgataatattgttcgtggaaaacctaggacctgttcactttgatgccattttcaatcttaccaaatttttataaagttgcaaaaaaaaagtgggtacatttagtttgctaccaaatttttgtaactatataagaaatccttactaaaattttggcaactatgctaaaattttgtcattggcaaagtttgatatggtttttttggcatcaaaatgaacaggctactaataacgtcatataatccgtcagttttgttttttaacaatattatgggtgtcatttattttgctataacttgtttcattattagagaattttaaacgtttcgttcaaaaaaaaattaaacgtgacttatattttctatattttacactaaattttaaataagatgtatgattaaacattatatatcaaaagttaacagtaccctatattaaaaagagagagatagtatctcacgtatattgatgagatgagatttccagatttgaccgtacacgttctaaacaaacatccttttaagaacggatgagagtatcagaccaaattaatgtttgttggcccatgcacagttgcatactccattatcaactttagaaacaagacaaggaaatatcaaccttccaagttccaagtaaagagtgttttgccaggtaagaaacagcaaaaggttgagtaaccaccctttttcctcttggtttcagttgattgcttgattcagttggatgtccaaaagacaaactgttgtgtacaattataaacaggtcaccaaattctgtgcaaatctgatgtctgaggttaacatgacaaaactggtaatcagatgcaacaattagcagtggacagtgtcagccatctcaggttcacaaggcaatattttccaaagcagtgatccatgaaacatcatcaactaattttgcccacttcagcactaagaaacatgtggagcaaataatatcacttttttttgtagaaatggtactttgaagatactctttcatcaaagcaaacactccacttttaagagacttggacaaagttgagtgggattgcatatgatcctgattgctcactaattataaaaatggctacagatgccattgccagccatgtgctgccaactaaggcaaaagagtcgtccaatttataacgatcaccagtgaactagatttctcttgccgaggacgttaataatcttggttcttgaaggaccctgggttaacaagacaactaaaatgatgacaatctagaaaattaacaattttagaacatgtaccgatggttcattctcctaactgattactgttgactacatataataggatgccacataatttcctctttcacaggaatcagcacatcgggtcaccctcacctccatagttgacccacttagagatcacgacaaaaccaaagaagacttgtttctgatacgtctgtcacagagtttgcatcttcagtggtcacttgctagcatttaccttgtgattcgcatcaaataaggtcgatttgcccactctcaacaaggcccttgatggacttgtaccggaggacatacaaatcatcagcaactaagtccacaacctcctcccctctacgtgaaattagagcaccacagtgttaagtagagcttgaaaaggcgcaacagcaaaaaacaagagaacttcggcacttacatatcatctagctggaatgctcctacgtcactcttggttttgcagaagacaaaggtgtcaagctgaggctctggaactgaacaaggcaaaaaaaaaaaaatcgaatcatatagtttctagaggtcaattacagtattacatcactcaaaaatacatatgtcccacatcagcgtatcttcagaaataggaaggaattttgagcaataaaaggcatgtaaataaacagtctataaataattcccaaatcttcttaaaatagaaaagaaccttttgctggaactttctttactcttttaactaaaagtgcagctcaggttcctgttctagtaaaaagcacatggaatgtatttcagctccaagatacataccatatattaaccagttggaccatcctgatcacactatttcattaaaaaaagttatgcaccggattgttagttactacacactgattaattcctaactgtatgcaacacggctctttggtggattgaagattgcaaccactatacaaggtaaaatatatctgcatggatctttggcacaactgatgatcagtaaaaactggtgattatgttagacaaggaacattatcgcgctgtgtacggttgacatttctcactctgtactccctgaaactgtgtatggttgacattcctgcatactgttgtgtcatgcatttccgtttcaaagaactaactataacagcattttactttctattcatctatgcatgcggataaatagtactaactctaggaggacttaaatattttcagggcaaaccagtaagacaccattttctcgtcagttaactgtatcaaagaatataccactttgttagtaaaaattagcagtcattagtactccctaaaaattataataaaaggattgatatatgcgaagctgattcagttctagaactgtttaaattgagcatatccgagactacaagatgaatgagtatacaaagaggtctttattgcatcctgtggttaaataatgttatttatgagtatgatatgaactcaaattttgggtgcaccaaatttgatacttaaaatttgatcatactccaaatttgatcatgctatctgatcaaatctctgccaaatagtgaccaaaactccaaccaacatctatttggcagagattgatcagatagcatgagaaatgtcgtgttttctgctttgaaatggtgaattttgtactcatcatttgcattaagcagattatgtatcgctcaaaactacaaccaccaaaatagtattgcatcccaaataaacgcactaattataggatcaaaaggaatacccatgtcatcctccgtgctcgacaatgattgcctcgtgacggagtcatacccgtatggaagcttcgacagcactgactgctcgagatgcttctccatcatctccgtacaacttgcaacaaatcaaacccaacaaatgatcatcaaaaccacctgaatccagtcaatcaactaaccagcgtaatcacaacgagtagacggtctagtcgcctgaaaaatacctcttcgcaaatcgctgctcctgctgcgacagccggctcaagagatcttcagacttggagatgtgcatcatgtacttctcaatctacatccatccgtcaaagtaacaggcaatgccaatgccaccagttcagttcagtgatcgatccaatgcgggtggagttacagagaatggaaaattgaatttaaccttttgtaggcggaggcggaggtaggatcggaggaggaagagcgtgcgatcgagatccatctggtagagcgacaccaccaggtcgtcgacgccgctctcgccgaagtcatccagcgtctcctcctgaccaaaatcacatcacatgacagtcgataagaattccggaacaatttgagctagaacacgacgaattgggcacgaatcaagaatcgaagggaaggggaggagagggaaaccgacgaggagctggatctgctcgcggacgcgggagacgaggggagagtcgaagcgaaggatctccggagacgccttctcgttgcgccacgctcgcttgagaagctccacgtcagtgctcgccgccgccgccgccgcggcggccgcggccgagtcgtcgtcttcccaggaggacatctgctttcgctaaaccagtaactggcactctcccggatggtggcctcgccggccagcaaggggcggctacgccgtttgtgtcggtcggtcaggtcgacgcggcggtggcggcggcgtcggcggcgaggtcgccggcgggaggggaggaagcggagcgcgacggcgtggtggtgggggggtggtgggccgagccaaggagatggacgtgtttgggccttggtccatttgcagagtacgcctctctgcagcgaaagcgtatttgatactggacttcctcaaagcctgatgtagctgaccggctggctgagctccaaacatgaccagagcatgaataccaagaacccatcaatggctccatccaaacgacatatttacaaataaaaaatagtttataaataatttttttatatatgtgttgttattgatctaaaggcattggctaaaaataaattacgatgaaaaaaaactaaaatcaactccaaatttaaaattgaaaatttaaatcttggcttataagtataagtataagcggaaagatgaggatgcaagatttttttttttttactaaaacatagagattccattaacctatgtactagttacctccgtactcgaataactgcccatattaactgtaagtctaaaatatctcactttaatgatcatattatatggtgagtgcaatttgtatggttatatttaccacgcaacatactccatttaactgaaaaaaaaaacaaatcctagcacatatatactctctttggaacgctttggaacggagggtgtacttcaataatataacatcttttttaagtttttataatttctttataaaacatttaaagtttaaactagaacaatagtagcgctaagagagtatgtgattatgttgtcaggatagagagtttgaaactttggaaactttggatggctagaaagttagacaaggtaaacccaggttgtcattatcctgatccatattttagtatcttacaatactatgaagccaaaatgatactgatcccacctatgatatcctaattttcataatatctcgatcttactattcatttttcacatgatcctataaaatctgaagtagtatcttggtactacgattctaccaaatattatttaaaataaggtggattgaaaataatgtgaataaatatgctcaagtttacataaaaaccaatttttttttcaaaatcaatattacatgctttaatttatacattttactagaaaaaaatgcccgtgtgttacaaagggtgaatgttcttttaattattattatacggtttagttaagttaaaattcaccgtgagaatttgcttggatttgtttatttttacaaaatcatgagcggcaattaggagtatgatcgtctcaagttagcatgcgagtttttttaaagagatttcttatacgactctctttctatattccaaaagcgaacgtccttaaaatctaactcaaacacggatatggatttccaaaagcgagtgaatttaaaaaccgactcaaacatggatgacgtaccaaagtaccggcaaaaacatcttcagtttttataatagtagacatataaaaataatgtactttccaaatctgatagcatcccgatcctacggtagatttcaatactatgatactacaaatcagaaaacgatcctacctagcatctcgatactgattaccttgggtaaaccatgcaatgttggtttcaatgtttcaatgtttctaaagattagctttggaggagtactttagaaacattgaaaccaaccttcaatattttcaatgttaaaatctctaggataatcataaaacttgaatgatctttaaaaataactccatcaaatatagaattacgatggttgcttatcatagtccttctccagtattaggcaatcgctctttaagatgattttgttgattcttagtgagcttgccatgttgatagccgctgcattgcttgaacttccacttgtattgtaactcaagaaactaaatgatttcctcttgcttcttttcaaaattacctcacgaatcttcgcaacgggacaccattgttaacttcaacaaacgcgagcaatggtctggaataagagaaaaaccgatgattttatcatacccagtaactcagatgataaggaaaaaagcttctcttggatggaagtgacaactaaccacagccaaatgttttcaatacttatcctcctcctacaaaatcaaatagaaaaaaaccagggaaaaatcacgtgacacgtattttcatcaatgcttcccattgtttaccaaatctaaaatcagctaaggtcaagatttcaaagtttttcattgaagtttttttctaagcattgacttttaaatcgctaactatatactcctatatatttacacatttaacaacatattattattgttgttactactttgggcagtgtttagctcctttaaacttccaaaaattccgtcacaccaaatgtttaaacacatgtatagagcattaaaatgtggacgaaagaaactaattgcatagtttgcatgtaaattgagagacggatcttttgatcctaattacgccatgatttgacaatgtgatgctacaataaacatttgctaatgacggattaattaggcttaataaattcgcctcgcaatttataggtggaatctgtaatttgttttgttattagtctatgtttaatactttaaatgtgtatctgtatatttaaaaaaattttggcacacgaactggccttgtgctgcgttcgggaggagggggcacgtaaaacggagcacccattattgcatgatcaattaagtattagctatttttttttcaaaaatggattaatttgattttttaagtaacttttgtatagaaactttttataaaaaacataacgtttagcagtttgaaaaacgtgcacgtggaaaacgagctagatgggttgggaagttgagggagatggtcgaggtggcagtgccaagcaagcagccaagttggcaaccgaaaatatcaaaggcttcccgcgaccaccaaccccaccaccacacacatccatcctcacgacgccctccaccgcttcgcgaatcttcctccccaaccacacgaaaaccaaaaaaaactcaccttcaccctcgccgtcgcggcgccccccaaaaaaattcacccctttttccccacgctccggtggctccacgccgccccgcccgccgccgcgaccacccgttccaccggcgaatccgcggatttaatctcccacagctccccgtgagatcacaaagaccgggcgggcgtgggctgtgggctgggatggtgggcgacctctcctccctcctcgccgccgcctcctccgcctcccccgtcgtcctcgcgccatcaaaggtgcgccgcttttcttgctctctgctaccccggttggggctgattgatgattgggggaattcttggttttgtaggagctccatggcgtgcacttgccgatgccgctccaggggaagaggccgccgctgcagccgcaggacgctgccgtccacatcgaggccgccgccgccgccgccgccgccgccttccaggggcaggtgatggtgcccggccacgcgcatgccggcgctcccgccgccttccaggccttcgctgtgcccgacatggccgcgctcatcgacgtccaaggttcgtgttgcctcttcgattcctcttcttccttcgttaagtgcatgcacaagcacaccgttggctaatttgctagagattttgttgttcaattgaatttggaatttgccagtcgcagctatggatccgaattgtgagattaggcatgctttttttcccctaaagttagagacagtaatttgctttgcagaaaggagtagaaacaaaattctttgcttgttcatgcgcgcgccttggcttgtggtttacaaatgagacctgaagccattgctttacacatcggttgctttcttctgtgtgcttgcacatagtacaagattgtgtagtgagctttgcaatggtcttttctagtaggatggtttttcatggtatgttacacataattcaggtcaagattaaaatttcctactctcactaagtggtttgtcccgttcgattcatgatttaatctgtcaaattttcagttttacaagtgtggattagaattcattttcagttttgcattttatgctgattctaacctcgatgtatctgtgcagcagactctcaccctgactcagttcaacttagccttgggattgccgagcaatgctcaaggcaggagaaaatcctgaaatttctaaggtcagggtccgatgtgaaagaacttgatgtatctttactgactgaacttacggggcatcaaactctgccaatcaacttgggtactcaaccatacatccctgatgataagttatcagctcttccaatcagcatggccagtcaaccatatatccctgacgataagttatctatctatgagtttgaattggatgagccccagcagtatctaccagaaaatcaacttgtcatccctgatcctcttgtggagtttttccagtcccatggttctgcccttaccatagatcaaaacaggagaatcctcttcaatggaaatggagatgatatgagatatttactttcgattgtcttggcattcaatatgtctaaacgagaaataagcagttgcaagacagcatatctagttccatattttgaaaggtaatactgtgaagcatcatgctccttgtagaccttctcattcatcttattcatttgttcattgaggtttaatacttgagtgatatgcaaactccgtggtaaccgtgttctcttgagcactgtaaggtagaccaatgattctaattttgccactcaggctgttttccattagataaaagctgtgttaggcacctatggtcatcttttagctgtattagcaaagatgtcgcattaagatcttccttggtctgctggacatgttgacaccgtttcaactggccatgaatagtgcatagcatatttgttcgcggttggaatgaataattccatgtctggatcaatactcccaacagaattctaaagactgctgcatcacttcacgcacaagacgctttccctgtagaaatacagaagaaagatgttaaaattatttcttaacactattgctgttctagacgacatgtttccttgtgcttcacaatgatctgttaaaaggggcattgcattgcctctgtaatcaatgttgaatcatgtgttttttttcttgtcttagtgaccccatcctcattattgatgcctcttttttttggcttttgtctaattgtcttataaatgtcttttttgataaacaggaaaaggcgatcccgagcaagcagccatgcatccaattcaaaattagcaagcacagcagttgatgcttcaaaaaggtacattgcagtcacttgtgtattttctgaacaccaaccattagcataacttctatactgttttcctgccatagtcatgataaaggttaaatactcaatggattgggttgaagtagtgcaattcttattcttcaaactgctagtgtagactttgtagttacttcgaaaagatacacaatcacttgcagcatagactagacacaagtagtggcaggcttttttgtttgaacaaaataaaagatcagacacatagaacagacatgtgggaattactggactaaactacgatgatattgctctttttacctgtttctaaaactgcatccaaggttatttttacatattaatgtgattttttttaaatactcagcactgcaaatgggaagtcaaaatcttcatcaaggaagaagcagaagagtaaaaatattaaagaacgtgacctgtacccgaagaactatttccatgctagtgaagcatttttatctatgctcctggacaaggacaatagcagctcaacaattcattcactgaaaaaagctggtcctgagatcagtgaactgctgacaaaatgctctattggcatcgctggaactggcttggctgttcttctctcagttgtgtgcaagatggctaccggtatgaagagtcctattgctgctacgcggctggtgaacactggtgttggacttgggctcttttggctctcctgggcagtaaacggattgcgagacacaattactagcatatttagaagcccaggtgacatgaacttgaaggacgaagaggttgcagtcagaatacaaaagagcatgaacgacattctcttcagagctatcactatattggcaatcactgcttttaagtttgcgtaagtggttacatactaatttaccttttccccgacccacctgtaatatataatccaccattttggttcaggagtacagcactagtgcttctgtaggattaagtgccaattgagcaaatgatccccggtaattttgtagaaaatgagaaaccgttgtgaactgtacagaattttgctggcagcttggtgtatatgaaagatgggtttttttcttatctgtagatgaacaatccaatgcccaatgatttatctatccagcagacaggttccatattttagctacttatcctcgtttgttcctgatctatcgatgtttgattgaaatgtcagtcctggtgtaattttaagagattcatgcgctaaattttctgatatgttagaaacaccctgatttgcagaatgctcgtaatttgaaatggttaaagcctgctctcttcttaaaaaaaaaaagcttctagctatgaatctggatagagttttttttttaaaaattttttttgggaaggagggtgcccatgcaacatggttgctatagtctttcttcaccaatcacatggaactagcaatgagtacatccgacgttgataattgtcattgataccatttcgaatttatgatcatagtcaactgattacttcaaaaacgaatttatgatcagtcaactactataaaaaaaatgatctgctggagttccaatcagtgtcttaggataataatgtaattttaagtagctgtacacttgatctatcatatgagagcatataaggaagaagactcaaaggagcttcactgttggtaatgttgacaacagacaacttggcatccgcagctgctttgtcaaaacagttgaatgtctcggcattccgaataactgtggctatgtaggcgacaggaacttctgtcgcagcgctactgaattcgttgctggtttcttctttgtttgcgacattattagttcctcgattattcccccttctcaatagcatagaaagcactctaataaggtgcggcacacagaccggatcatatattatatctgcaccaaggctgtcaaaagatatcaaattagtgtttatcgaaacgaaaaagaaacatatgaagggactgatgtaatctggatcatgtgtcagcaggggtgtatcctgtcatcagcttgcaaaggctatttgtatttgttcaaccagatcagttcagtttaatgggcatgaactcaacgacactatgctcaaaaggttttactctctattttccaagtcgcaatagctcgataaattgataattgattcaaacaagtgtttcatggctcccacagtcacatgtccagtgtcagatggataatggtaatggaaaaactaagtgtaaactgctacaataatacaaaaaattattgcccaaggaaatactgtactcacactaagtctggcctgcagtcccatagatcgctttcagatgtttcttcccatgaaagatatttgcattgtacctgcatgccagaatatagtacaatcatattttatccagtagtgcatttgatctaacctcaaaaggacaggtatctgattcaaggtggtgtctggtggttaaagtgcaacaagagtacaagactacaagagagactaattaagctacaacatttactggaaagcacacaactattttttctcaaatgaaatcatactgaaaaatatacacaatgtataatcttgaaagtatattctttatataagaagatagcataccttattcttgttctcttccggaagttgagaaccttcctgctcaacgcataagttattcatttccatgttgcctttcatgttttctagtgtagatgcatcaccatcagtaagaataacctgcatcatcgtataaacactgtgtcacctgtctttcctgttgaactaatctctaacctttgaagaagtttatgagcttagttaggagtaaatatagctcatagcataaccatcactagtcgctacagtcagtcaaacttaaagagttgactatatgtctgcattttcatttctcagttaagtcgtcttgacaaactatacaaggcttactttttcacagatatccatttacttgaatggagagtggcattataaactttcataccttggaggcgctgacatagttcagacatacaccaaccaaaccaacaccagaacctagctgtttatcatggaaacatttagaagggtaagacacactcacatataacttttaaaagtttcggtcatgagattttctgttgatataacaggcaaggaaaaagtatgatgctgatgagacagatgatcatactaaagtcatagcaacagtaactgcatatctatttgctcaagaaaaacatcaaggtaaagcgacacatatagtagaagggctttgcagagagctagcgacagagttcaagctcaattttacacattgtataatcactagaaaaaatgcccgtgcgttgcaacgggtaaaaacgttttttatactatacattatactcccttgattttgaaccaaatgctttcttgttttttggaccgaacgttcattctttccttccttttcagctctagtcctagagcagtccgttgcctctatctgctcgacctatctctcttcggctcagcccacaagtggagctgtagacctagcttgaacagtcctttgcctggcctacctctctttggctcagcccacaagtggagctgtaggcccatgtcgaacagtttcgtgcccgtaccatgacggagccgatcctcccaccaaatccggtaatttggtcgagctcgcatagtaccgtgcccgtacgatgacggagtcgatcctctccgtcaaatgcggccgaatctttctcgatctccaaaattgttgagaaattttgatccactcgatctcatttttcgaatttttatcaaaatcgaagcaatccgcaaaactcggaataaaaaatgacgaactaatgggaaattaaggggaaaatgatgagagagtagtggggaatcggtttttgcaatcaattggatgaggaaacgcatggagaggcaaatcgccatggcggcggcgctaggattcaggccgaaaaaaaaaaaccgccaaaaatagcgcgttggatttcgttgaaaccggaaaaatggtgaaagaaaaaaaaagaagagaaaaacaacgcaaagaaaataaaaggaaaatggacgaaaaaaccgcgaaaaatggtgaaaaaatggcaaaaagaaaataaaaccgaaaaaggggaaaaaaaaaagaaacggacgaaaattttgccgtgccgagcttcttttttgtccgcttttttagtacagataagaatcggtcaggttttttttttgccacgcctttttttttccgcgctggacttttttcgttacaatcgaacttttttatcgcttttatttattaacggacgaaggaaacatcttatactttttaagtagtagtagattagagaaatgtacaatggacttctatatatttgtgttgcaaaacgcatgcctaagcaagatataaccagtatttgctgggggatgatcaggttggctcactttggatctgtccctggttacagtaataatattttacagcagaagatagagtagttgagctgaacatattcctataaatatatatatgctagataaagataacattttccatgtatctaaactaaaacacaaaaaataatcggtatttacctcaaagcaacacttcctagagaaaatttttgggtatgaaagaataaactcagataggaataaacctgatggccaaagagagcacctgtaaaagaaaagtatgcactgacatgaattaagaatttatgcaagtagcttaatatatagataatagtagattatatattcaatgccatcataccctgtatcaccttcgagcatattgatagaacatgataatcgagcaaccaagcttactcgtttattgtcatctacataaaaggtgcatgttacaaactattataatttggaagaattcaaaattaaaaactcacttgtaggagaaataaaagatatttctttatagatcttctcagtcctatttaaggatgaattattctgcacatgttataaaataagttacttttagtacagcatttcaacagttattaactactacttggctatattacgatgtttaaaagacgtactgattttgacgacatgaactggccaaattcctcataaagtccatcaatcacaatatctgacgataactcagcttctgctataatccttttaagaatagttgtaacataactacagttttgatctccccctgcctgtaatgaaaactcaacattttagattaggagttacaggaaaatattgtgcaacaaccagaaaattataaaaatgtcaagtaaaccaaattgtgactcttttgtattatgcatctttctacaacgcacacatcatggtcgtttttttttctgttgatagttttgcgtgagataacaaaagacatttacattattgccagtacaactctccaaaataaaattttgaacgtgtggcgtgacagaacctcccccagcttttctgcacaatcaaatacacacaaatttaaataaacaccaccataaacttatcaaaaaaaagaagagaaaacaaaatagcgctttgccttgtcaagttacaatcacattcatacaactgagaagaggaagattattattttttttaagaaaaacctttgtatgaaatttcctgacacattcatataaggtggaaactgacaagttctctgaactttcctgggtctaaagatctctctgctcattggagctcaatcactagccaagtctcatcacactactgacgcaaacacagcctcctccactactaaatccaaaccaaatctctgtatcggcaacatttttctgaaggcaaccaaccgcataggcttgcctgagattggggactcgatcgatcgatgcagagcagcatacgaattcgagcgcgtggggggcgcgcgtacctggcgagggagaggacgcaggcggggggctcccgggcgaggaaggcgagcttcaggtggaggagcagctcctgctcggcggcggcgggggccatggatttcagatgccgcgcgtggagatgacgagatgagaggaaaagctgctgatttgcagtctgggccttggctttattgcagttttgggaggggacagactgaggccgtgtacgggcaggctttctaaaccgccggggctgggttactgtgccccgacggtaagcacggttaccgtgtggtaaccgcggtaaccgtgaaaatccatacaaaatcgtgtaaaatttatcaaaaattaattattttttaaatttatttgaatttaaggaggttatcgcggtatttatattaccgtaccccgtggtaagcccagtaaccatggtaaccgtgcggttaccggcggtaagtcaaatcctatgtacaagtactttttggaggatataagattgttttagtatcataaaattattactacttgtcaaaataaatctacagatattttttttcgaaataaatctgcagatatggttccttcatgacaccatcctagtataaaatcctaatataagtgcgcacctgtaccggatttgaacagttttactactacatcttctgatattatgtgcacttattcttgtggtagtaggtgcacttatattgagacgatgagagtaacatatattcaaggtaaatatatttaaaaatgtagtattatgcttaagatatttgaaatttggccataaatattttttacagcaataaggcacgttcttttggataaataaaaatgaataaatgcacatgtttcatgagtttctaaatagtttattaaagggataatgatgatggtgagtgatgaattagtcaccagtcactaccctaatcaccactacctttttggaataaagaaatgacatagggtcaaaggactcgcatgtcaaccaccactaccatcatctctacttttgtggaaaagaaaaatgatattgtgagcctatagagaccatatattagttataaatatgtagaatttaagagatgatgtatacagaaaataatgataatagcaggttaatgatcattttcatcaattaaaattccattacaatgcacgggcaatatgctagtatatacaaacatatataacaatataagaaacggtaggtcatgttcttttctaatcaagatgtagattttacctcagtttcattaacggtttttcaaactgctacacagtgtatttgtgcgaaatttttttagtataaaagttgctttaaaatatcaaataaatatatttttcaagtttgaaataattaaaactgctaatggttttctcgttttacgtaccctacttgatcttcatctttgtcaaattcaaacgggcataatttctgcctctctagctagttaagtattaccacctccatcctaaaagataagaagttttaaggatagacacataagttaaaaaagttggtgaaattaaatagaagaagattgcaattgattaaaaagagaaggtagatgggaaatcggaatggtaaaagtttatgattaattgcgaagagaacgtagatagaaaaattgttatattttgaaataaattttgaaggctttgttatatcttgggacgaatggagaactcctttcgtttgacatatattaattcagatatgaaaagacgaatattttctttattaagacgatctattcgatatttctcct

SEQ ID NO: 74872 - DNA, 585 bp, Oryza sativa
gaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgtttta

SEQ ID NO: 74873 - DNA, 6731 bp, Oryza sativa
atatgtattttacaaatttacactgttttcagttaaacagaaaagtctttaaagtgttttctttatatttcccagattttatgtacatggggtccacaggtcataggcttggggaggagaatagcagcagcagaagcagagctcaccggccggcgggcttgacggcaatgccgatggcgaacgacgactcttcggctgacatatacaaaagagaaaatgtggaagacattcttgcgaactcgtcggtggtggtgtcttggccggaggtggccagaatcgaagccgacggcagcgcgagcagcagcggctttgaggctgcatgtggaagacaagtcacgggcttggttcggttgatttgatgcgtgcatgagctttctttggtcactagggagactcaccgcaggattgtgttaggactcagtttctcaagaacaatggaggatggattgatggaattagggattcggaaacacggaatgtttagagtctctcgatcctacaggaccgaaccgccgccgccaacgccgccgccgagttttccgttcatgcctcctcctctgttcttcttagtatttaacaacacgcaactccagctggcacagcacagcttacgcacgctactcacgcttacaaggcctcacttggcccacatcggtccagcaattctagtattggccttcttgttgcgcagcccacgacccagctttggctttgtcctgtcgccgtcctgtagctcgtccgggacgcttgctgtttcatcgtcaggttgctcctcctctgcttcagcccgacttgcagacctgacaatcccccactcttggtggctggcttgcccccaagccagcgcgccaggaaagcgagcacgcagttcctccatgtcctcccaggtagcttcctctgcaggtgaatctgaccaatgagtaagtaactgaacgacagttttgttaccttttttagtgagacgcttgtccaagaactggagtggaatttgtagttcccctaaagagcttggtaattgagacataaccggtttagagaacccggcagccgctcgcaattgtgacacatggaagaccggatgaatagcactataagagggcaactgcaaacgataagctacagcccccactctgtccagaacttgaaatgggccgaaatatcgaaattctagcttatgattagctctcttagtcacagaagtttgaatgtatggctgtaacttgagataaacccaatctcccacattgaattccttgaaactcctcttcttgtcagcttgagacttcatttgctgctgagctcggttaaggtgttgctgcaagagttgctgcatgaactgtcgctcttgcaaccaaatttttagatcagcaatttgacaatcatcagagctaatgccaaaatgtgctggagtgtagccatataagacctcaaagagagttttacccagagttgagtgatatgaactattgtaccaaaattcagcaagatataaccaggtggcccatttagtaggagtagcatggacaaagcatctcaaatagatctccaaacactgattgacacgctcagtctggccatcagtttggggatggtaagcagagctcatgtgcaatttcgtacctgatctagagaatagttgatcccaaaactggttagtgaatattttatcccgatcagagataataaccttgggtaacccatgcagcttgtagatgtgtttcatgaactcagtagcaactccattagcagtaaaaggatgagttaaagggatgaagtgactgtacttggaaaacttatcaacgaccactaaaatgcagttatagtgcccagatcttggcaggccctcaataaaatccagggacagagtttgccatgcaccttcaggaactggcaatggttgcaagagaccgggatacttggatctatcgggcttagcctgcaagcaaatctggcaatgttgtaacttgttcttaatcatctttttcattcctgcccaagcaaacatagttttggctcgtcggtatgtaacaggaaatccagagtgaccaccaatgggagaagcatgaagttcattaattaatttatcctggagcactggattgttgccaacctagattcttcccttgaatttaagaattcccttgcataactgaaaatcaggcctgctattaggattaacagctaattcagcaatgacttgggtggaaaaagcatcctattcatatcctgagagaatatcttgcacccacaatggaatacattcagatattgctgctaactcggctgaatcaggtagttccttgcgagatagagcatcagcagctgcatttgataatccctttcgataacaaattctatattgaaggcccaacagcttagtgaaagctttttgttgccaaggggtatgcaaccattgttcagacaaatgcattaggctgtggtggtttgtcagaataacaaattccccttgttggatgtatggcctccaattttccatagctagcagaatggctaagtattccttttcataagtggagagtcccttggtttttggacccaaagctttgctaagaaaagcaatgggatgcttgtcttgagatagaactgccccaattccctgatcactagcatctgtctcaatagtaaaaggtttggagaagtcaggaagtgccagcactggggcagcaaccaaagcatgtttaagttgttggaaggctgacttagtttctgcagtccacttgaatggaactccttttctcaaaagcatagtgaggggtttgctgataacaccaaaatttttaacgaacctcctgtaataaccagctaagcctaggaatcccctcaatttttttaaggtagttggttgaggccaattcagcacatcctgaattttggaagggtcagtagaaactcccagtaccccaatgatatgacccaagtaagatagttcttgttgtgcaaaagagcacttgctcaatttaacttgccatttattgtcagccaacaattgcaatacaatctttaggtgttgcagatgagattctttatcaggactgtagatcagaatgtcatcaaaaaagaccaaaacaaacttcctcaacacaggagacatggtatcattcattgcccccagaaaagttgcaggagctccggtgagaccaaaggacatcactttgaattcatagtggccagagtgtgtctgaaaagctgttttgtgttcatccccttcagccattcttatctagtgatagctagctctgaggtcaagtttggaaaaccatcgggatccagccaactcatctaacagctcctcaataactggaataggatatttacttttaacagtgatagaatttagctgcctgtaatcaatgcacaatcgccatgttccatccttctttttaactagaagagttggggaagagaaggagctttggctgggttgtatgacccctgacctgagcatttcagaaacctgacgttcaatttcatccttcagtgcaggtttatacctatagggtcgaagattaacaggttttgcaccttccactaatggtatatggtggtcacacatcctcttgggaggtaatccagtgggttctgagaacacatgagcaaattcctgtaacaagggttgcaccatgtctggaacttctttttaattatgtagttcaacagcctgaagctgaaccaagcacataacaaaacccttcttagtcataccctgcagctgttccccagaaatggtagcacactgagatgtctgtggagtaataccttgcaacttgaccactttacccagatgagaaaactccaaccacttgtgattccattcaatttgcatggggctgaactgctgcagccagtccattcccaatatagcatcatagctgcccaggggaagtaatctgaagtcactagaaaaattatgaccctgaatccaccaatcacactttggaatcacctgagaacatgatagctgccctccatcagcaatttgaaccttcaatggttggggcaggtgttttaagccaataaaggtagagccaattctttcatccacaaaagaatgagtgctgcctgagtctactaacatgagcaactcagttccttgtacccatccccttagtctaattgaagtagaagaatcaatcccatttaaggactgataagaaatagacattaatgcatcatctgcagtttctggtatgtcaccagaaaacttttcttcttcagtattgaactgtaatgcattgagtaattcctccaccacatgaagctgaatagatgctgcacatttgtgatccttgccccacctttccccactcttaaaacacagtcccttagaccttctataagacttaagagctaataacttgtcttctctagttcttacagatttagctcccaccttgtcttcactggttgttcttgttgggaggactggagtaggggtgggtctgcttttcacatatactccagaatcttgtctcctaactccagattgaactaccccttctagagcctcttcctgcaaaagagctaaagaacaagctgtgtccaagtcttgtggcctcagcatcataacagcaagcctgatattgtccttcagaccatccacaaatttagtgacaaaataaatgggttcattggctccacgataggccagcaactgatgcataatgctatcaaacctctcaacataatcacttattgtggagctctgaaaatacgaatccactgacgtatgagtgtctgttgcctatctctagaaaatcttgcacagactctttcacacaattcaaaccaagtggcccctgccaactgagatctaactgattgtaaccaaaaagctgcattcccacagaaattcagtgtagccactttaacccaattccgggggtgaataccatacacatcaaaatagatttcacaatttgctttccacatctgtgggttgtctccattgaactgtggaaatgtcatcgggggaatactatacactagagcagaggactggccatggctactagactggaacgcagaatcatcatgcgggaaaggaataggagagatcagggttgaatcgcgcataccatggtggagaggggttgattggaagttgcgcgaatcctgaggttcctccttgtgggcttcaggatacacagctgtggtcaccttccccgcgaattcatcatccttgcgttgcaacgcaatactgccctccaactgttcgaccttggcgctcagagtcttgcacacggtgttgagggtctccaccttcttttccaccgctggtaggcgcacatccagcgacagcttgagctcggcgaagtccgcacgcgtgcgagcctccgcttcctcccgcttcttctcgttctccgccatcgtcttcaggagtaaatccagtttcccatcttgcgccatgacttcctccacaccttggtacccccttactttgcttccgaatccagtcaacctgaggaaggcaagttgccttttcgtgggatcagttccgaagaacagccccaatccttcccctggattttgcgaccgactcaaggaagcagagcaagtttggctctgataccaaactgttaggactcagtttctcaagaacaatggaggaggatggattgatggaattaggggttcggaaacacagaatgtttagagtctctcgatcctacaggaccgaaccgccgccgccaacgctgccgccgtgttttccgttcatgcctcctcctctgttcttcttagtatttaacaacacgcaactccagctggcacagcacagcttacgcacgcaactcacgcttacaaggcctcacttggcccacaccggtccagcaattctagtattggccttcttgttgcgcagcccacgacccagctttggctttgtcctgtcgccgtcctatagctcgtccgggacgcttgctgtttcatcgtcaggttgctcctcctctgcttcatcccggcttgcagacctgatagattggttggagttggcgtcatccaaacagctgcggcgatggaggagatggcttggcggcagaggaaaaagcagggtgacagcggcggctcgctccagtctatcaactctgagatgaaatcatacttgaggctactgaggtcctagagatgattcctgcacggggaatcagatggtggcactggaaaaagagaaatttggcgatggtgcttggtagccggagttgaggaagaagacgccaatctcccttctctctgtggcattggctggggttcttgagggctttcgaagagaaggtcgaggcgacgcggatggcgcggtggctcggcttgaggcgcaccggatcatcgggaacggcgaagcgacgagcggcggcactctggacaccgagagcggcgatgagcgcaacacagttgtgttcgacccatgcaaattaagaaccaaggaaatgaaagagttaggcatggcgcgcagatcacgttcccatgaatagaatgtcccgaagctctctggagaagattttccacgtacggatcaaacaccttcagctgagaaggagtgagcgtacttggctagacagagaagttcttggtctatctcttagtggaacatgatgagagatgagagaagaatagagtggtggagtggctgctcacatggtgaagagtgtgctggcaggggcatgctaggtgtccttctatggcatagacacgattttggagagagggcaaggttt

SEQ ID NO: 74874 - DNA, 678 bp, Oryza sativa
ataggcaacacttgcttcggtccgaatagaatatcggacctaaccgaggaagtcctacccacgccgatgcaagcgaagatgacggaacttacttctcgccagaggtctcggactaaaccgatgcagcccatgctcgaaattaagaactcgacaggagtaaattagggtggcgatatgttgaaagttgtattgatctagagatagattagaagaaccctagatgtacatatttataacatatttataacctcgagccaatatgaatccccatcataaatgactcatgtttcctaaagataaaacacaagtcctaatcagacactaaccaaactttttaaagataaaaagaaaaaaaatactaaaccctgcataattaatagataaattaagctgccatgccatggtcttcacgactccttcttgaacttggtctcttctggacagactttccatcggttgattgtgttctttccctaaccaaatccactaaagaatcttaccatattttggcattaacacctagccatccttttttttacacctcaatcttagccatttacccatttccctttctcaatcccatgtctcataatccttttgccaaaatatgcctatatgcatctctctatgatctcttatcacgttgttgtgcctctttccccatctttacaaactcgc

SEQ ID NO: 74875 - DNA, 598 bp, Oryza sativa
cggttaaaccttatccccgaaccggcgaaccttaaccaatccgccgccaaatcctctcgggtcgagccgatctcctccagctttggctataaatagaacccccaagacctcctctttcgtttccaacccctagctcgagctcccgttccctagccgtctctccccgcagccgccttctctctccgccgccggcagccgctccagccgtccctagcatccggtgtagccgtcgcctccggtcgccgtcatcaccaccgggttcgcaaggaggagaagaagcccggccactagttccttttcgccgtaacccgctggaagcccctcgacggcgtgaatccgatctactccacctccggccgagcctcgccgtcgactccgtggtttctggacgtcgtcgtcgctttcttcggcatcgcagagccaaggtgaagcccgtccactggttttcctccgctaaagattgccggaacgccgctgtcatcgtcgaccagtacctcaccgcccttcggagttcgtcgccggctgtctcccgtcgtcggtcgtcgtcgtgccgcccctcagtgagttctcctcgtcgtgctctttcttccggtgcctt

SEQ ID NO: 74876 - DNA, 38422 bp, Oryza sativa
cactgatctaaaagtatgaacaggtataaaaaatatctacaaattacttacatgaagggctcattaaaatggcctccagagtgatgagaaaaacctccgatagaattctgcgtttaatgagagaaaatcattaattaggcacttgaagcagcaacaataatttttcaagtaaatatcaagtaaggatgagagttatactaatgaaaatgtccaacatttttcatgggtgttttgccatcatggtactattgttgcactagtatatataaactataaaaacttatgtgagccacaaagtctaaagcacagtaatgcataagtaaacataaatggtgatatactgatagatgcagaaaatatattgttacagaagatttagatgtccttaccgcccatgtcattaacaggctcactttcgcacggtctttcccagtgttcactagctataataaacacagaaaacaaaaggaaggatggtcatgtaatttcatcaggttgagaagattaagagcatctcttcatgtaaatacatatgaaaacttaatgggaacattcaattcagtagaatattcattaatcagtaactcctcaagtaaacagcatgtcccatgatctaagaacaatcactgtaattaaacatttttctatataactgtattctgaaatgttttgacatatatgttcgcaccaacaatattattttaacagtgaccatgttaaaattctcctgtcgacataaaaaggcagggctctctctaccttatgatccatgtcagaactgttacatgtggaatatcttggctgaagttgccagaacatatttcttaatataaatgttattgaaccagtatcagattcaagcaagaattagagcgagacatggttaatcccctagttccacaaacctaatcccaactgttatcaacaccgatccacatgtatattccatgatattatctaaaggaatatacttatcaggaaatatgaaataaaaaaagatgagggaaatataccagctgaagaacctgccagcctagcataaaactaactttatgagtcacttacagtgtacacaaagacagaagttgggaggctgctatctttgtaatcatgaggaatgaatggtgatatctgacgacatgagattttaaggtctggatccggttcacctgaatacacggaaaaattcataagattcttaagttcaaaacatgtctactgctactaaaaaaagatatccatcaagttcataactccatataatagtattgaaaattaattatgtaatcaacatataagctggcttggcataaagcatatccatctcttggtagaaaagagaagtgtttgtgccatcacaagatgcaagcaatgttccacagctccatgatggcataccatcataaacagtccatgccctaggaaataaagcatgataggtagaatgttgaccgctcaagttccagtcccatgaagaaattccagagtcattacatttcctgaaatcaggtaaggcatcaaacaagtgcactctatatcaaatttgttgagtcataactgaagcgtgattgcaacatatatataggtacaataaactagaattctgttcacattatgcacagcgatgtttgactcttgagtcacaaatgtacaagaaagaatttggtatatatctcacactctctctgctatataatatgcaagtcgatatttgaaataaatttctacgcacagcgccgttggcttttgaatcacaaattaaaattaaaattgaagcgcaagtcacttatataaagtatgcaaagtggatctgcatttcaaaaggccacatactatatgggaaacaaggcacatcagaagaacaaatacaaggtaacaatgtatgcactatacaattggctgtgaataccattcaatcaacaataaagaacttctgcaagttttaacttcagaaaagcaatgcaaaattacaaatctacttgttgaagcttacccttgtgcaagatacaggattgcagaatgacgagctcagaagctcagacttagtaaatttggataaactaaagaaagactgttatttgcaatataaatgaagaaacttactttaaaccttcatggtgtccgggagacaataccgatgagtactttttgttccccccatcgcgagatacaaatatctagaacagcagggtactatgtgtcagttcaagactctcaccttagttgtgagaaaaaaaataaacaagcatagtgactcgggagtactaagtcaaaagattcaagattttataaacagttgctgtcataaatcttgtatggagcccctgatgggcttgattgggtggcccacatccatggaagtttatatacatcgataggaaaaataagtgtgtaatagctggcgaattgacaagaacttgctaactgattacaacactcatcaaaaagtgtcacaagcagcagatggaactcgtccatccacaaacattaaacagtggaaacagtcgtgcctttttatctcaacaaaagtccccaaaaacactccactcaacagttgatttcacacttgagcacagccgcaacaacaaagatagcacttaaaagattctttttgacgcatatttagtgaattgccataatatgagtatgtgagacaccagtgaagggtagatgtcataagactttccccaaaaataatactagtgactagtgaggggctaggagcattttcagcagtcagaagaaaatccttcagataagctagctaatggtccaaaaattcaattatgcatcaccataaaccaagttgattaaccagcaacagcagaaagaagaagaaagcattactgaaaactggttctccatgaccggggaagtctcacataaaccaggaatgatatgccaattcttgaactctcccctgaaacctcttgaaatgctaccactcctgcaaaaccagtgtattggtatcaaaattacagcatccatagtgcaaatagacaagcataaacatgagattattggaggttaaaacatcaattcaggcggacacaccccatcccaccaagcggtacgccctgcgaagcagacggcttacatttctctttggtaaacggatcaattggagctttctgcaagcatagcagaccccattttatcaccacacacaatttatattcatagatgtttggtataattttagataaaaggaaattccattaagtaatgaaatataaatagcataagaacagccgatggtacccttccatgagaagcctcctctcggacatacgaccatagcctcaggccaaggctcatctgaaatttttcacattccaaaaaacaaatgattagcagatagcagcattaaaaaggaaacgacgcaggtgttacagaaatcaaactgcttgaacaacatgcagagaaccaagcgttgtaacataccatcctcattgcttccatgaaggtgacgctgaattccttgagtaagttggcgtggctgttcagacgccgccgccatgcctgctccggaggcgacccgccgtcgaagtccaactgcgaaatccaaagcatccccagcaaaatcaaacacgcgcccacaggaagcacaagcccaaaaggaacaagaaattggactcaccaactgcagggcggttcggccgacgtactcctcggccggccacgagttcctccggcagtggaagaggttgccgctcaccatcccgtctcacccccaatgccaccacgcccccgatccaactcccgccgatcggaggcacgatccacgaacaaatcccctcccgcgccgcgccgcaatcatgcgcgcggatccgatcccccagcgccgcccctcctcctcatcgcgccctcctccgatccgatgccgccctctgctcccctcccctccccacctctcgatcgattcaaccaaaccagatcaaaaccaaaccgaagcgggcagcctctcgcggagaggactctccagtctccacccacccgcgcgcgccgccgcgggaggcagttgctccacgcggagacgagaagaccgcgaggaggtcagcggaggaggaggctggactccgaagcgaagcgaagcgaagcgaggcgaggcgaagccgcgggaagaggaaggaagagggtggagaaaaggaaggtggttgcggttgcggcggtggcggtcggcaagggcggctgtgtgtaggcagaacgcaggcaaagcacggacgcgcgtgggggaagaagaaatcaaacgggcgtgtgcgatttattgcgtggccgtaccaatttccggggagtccgtccgttgcccatgtttcgtcgtcaggtggtaaaattgttggcgataccccggtagttatcctgcacggttctttattactcactctatcccaaaacaatatcaatagttttgagtttttgtctataattaccattcatcttatttaaaaggttatgaaattattatttattttatctgtgatttgttttattatcaaaagtattttaagtataacttatccatttttatatttacactattttttaaataagatgaatggtcaaacgttaccagaaaaaatcaaaactacacctaatttatgatgggttattattattattattattattattattattattattattattattattattattattattattattattacctccacgaatctgtgctgaagggtgaaggttacggatgaagaggattggaatatttgcatcttttctttgcgaggaaatgggagtgggaggggggaataatttcgtgtggatagtattttgtgtcaataaacccgtggtgacaagggttatgtgtggttatacatcaataaagtatgagggaatatgttcatatttgattgatattttaagtttgcgtatgctgcttgatgttagccttagacacacgagcataatgatggtgaaaagggtttcaaaaggatgccttttccttttatttgctctacgcttcgaaaaattaattaatatatttcctagaagaaaaggtagctcattatttacacctcttatctaaaattatgtttatttcttaaaatatttaatttattcatataataggtagaaatccacaccaataatctaaaataaacatgatgttaagtcaccaatgacacaacggcacatattcttaacgttaatatatgttcaacatagtttatttttcaatactaatttttaagttataaggatagatatataaaagttttggtctccaacagctgttttagtacataactagcttatagtcaaccgataggcccttctatcttttgtggacacgtgattccattttatttacgatcaataactaaattaagcgtaactgtgcttggctatatgcctatatccaaaatcattatgcaatcacattgttgcatataatactgtactcattttccaaatttggagaagttcccttcatacaacaaaaaccagagctattggaaaaaacaactgctagggtcgtttgagcattttctcatctataccacttgctatacactgcctattttcaacttcacaagtcactgttctagcatcagtgtgaaaaaaaagggtatttgtgcatgcttgtgcaatctcaagttaaaagtcaattgctaacatctacatatacatataactaaaccaacccacaaatagtcaactgatcatccaaattattatttctagtataggctgtccctaattttatttcccttatatatagagttccttcagaatatgtccctgttgcgaagacacatctactcctatcagaagagaaccagtgcgtgctctttggcttgccctttttccttttcttttctttttttttttggagagaactcactttcggttagtttcatgatcttgacagcgaacttatttatcaaccgacattttatctttttcttactcacatgaatttatcctgtgcttggtagaacgacgcgtccgggttagaaaggattatcccgaaacagtgactgtaaaagcaagtataatagtgagctataagcctattataagcttaggtggaggaaagagatagtgaaaaattaaggatgttggctcttatgtaagagctagcttatcacaagctccaagacaaatgcattaaatgtataagtgagagataaagagatgagaagaaaattgtagccaatcttatagctaatctattatatatgttggctttaagatgggctaatagtagaaattgggctttattattatctaagttgctttgttttcgagcaaagtagccttgatggatacgcatctctgacgttcgataattaaaggatgatatgtactttcttaaagactgaatgatactagtatgtagagtacttaatgggacactgacatgtgaaattgagcccaaatttcatttatctatatggagataaaggctacgtttagttcatacggaaaaacttttcacattatcatattaaatgtttggatatatgtatgaagtattaaatatagaaaaagtttaattacatagattgcgtgtaagataagaggcagatttttttttctaattgctccatgatttgacaatgtggtgctaaagtaaacatttgctaatgacgaattaattatgcttaataaattcgtctcgcagtttacaagtattagtctatgtttgatactttaaatatgtatccgtatatccgatgtgacacgccaaaactttttacccatattacatattcctctgttccaaaatacaagtatttgtaatattaaaaaatttgtatagatcaatctaagtatttctctaatactaatttaaatgcaaagaaatccaaacattttcaagcaatcagaaggttaggaatgaaacataaggcgattcaaaatttgacaaactgtgactaaaaaggaatattcaaacagcctaaaaattagtactgatgtactatattttagattaaaaaaatatatattccattttagacttgaaatttataccagggatttatccagaagtttcaatggtcggaagttgtcccgttcagctggctcgaccgagaccagccaaaaagaaaaaagaaaaagtactactagtggtacgaaaagtacaccaggaaaaggttgggtgaaccggggcgccgtccggtgtccagccatgcagccatccacacccttcccttccgtgcacgtcgccgcgcgtggccgctgccacgccacgcctcgtcacgggcgggtgccgacgcgccgccgccacccgccgcgcatgcgcgccacggcggcggcgtcgtcgccagctcgatcgctcagtactttgccggcaggcaagcgagcaaacggccggattgacccctgtggtgttcactgttcagtaaataatgccggcgttttgcgatcggtggtggccatcaatccctcattttctggattagatatggatctttgtataaagtcgatgagaaatgagtaggagaggggagagctacatactagtactgcttattattcagtcatgtaaagggatttcgatatatatatatatggcaaaacaaaacttgttatttgggttaaacgatcgtacgtagggctgatttacggcttacggggaaggaagaacgcgggcgcacaacgtcggcgttgtcgacgcaagaaaccctggtggtggtggtggtggttggaatagctgaccaagcggtaactagtactctaccaagtcgaccgctaagtccatcggtaattgttttctagaatgaaatcagcagaaaagtactgctactattcaaacgacagcgacacctgggacctctcggatctcccccggccctcttccaaacgtcattttcgagcttttcctcctcaaaacgaccgcgcggctttgcactttccgatcatttttttaccattttatctagggacggtctatacgtcattcaacggagaacatatttaaaaatcttacgaattttatatcacaagattatattaagattcgtgcgagtaagcaaaccttaacaatctcctcattctctcgactccggttcactaataccaacacattctgcgtcgccgtcgccgccgccgcccggccttgccgactagccggaagacatcaacgcgcgccagcgaggccccactgaagagcctcctctcgctcccccctctccttcctcgagccatcagtggcaagatgccctcgccctcgtcgtcttccgcttttccggtggctcttttgttatcggatctgccaccaccgagctctacaagctcgctatgcccccgccaccaacaccggcctcgtggcaccgtcacctcccacgatcatccctctaagtcgacgacctcccattcttccccttccctttccccttctcctcccacctccacttcaaccccctaattcatcggtcctccatcgaaattcgggttattatgtaggcaaaatttgctacatggcatctaaaatttgtgtaattggtcataggagaccgtaaaattgtgtgactgctaaaggacatcaaaaaacggtgtaattggctacaggacgccgaacacattattttataattttcaaggcaaagtagagagagaattttttaaaaagacaagtttacccctgattaccctttctccccatggctatgaggaggcgacggcagcttcaacggtggcgagtggcagtgcaagcaaagcagtgacctgctgcgatgggcggcccgcacaggtggacgtcagccactagagtaacggtccggcgctgggcctgtccctcggcagcggtggaggagaccaacgcgacggcacactgtggtggccgtattgctgcgctggagccatcgctgatcctgagcatgcttgacaaacgcggcagatgcagctgcgacggtgaccgtggccctacgcattgcgtcattatatagctgtccgtcggcgtggcggtgaagtgggagtgtgtggaggagatcaacggtgagatggtgtcgtcggcggacggtcaggcgagccggacggcaacgactatggtagcatccgcaagaagctccagtattgatttgtatttgttcatccacacagcacggccaacctggtacatcacgtatgtccacgcgtttttttacattgtattgattggtatttgatcatcttttgttggttgaatacgtgcggatcactaaaccagcgctttgttttttcgagcagaagcagaaagtccctttttactcgaaaatcaactgatgctcaggccaaggcaggggcaaacttgtatttctttttaatttctctctcccctttttactcgaaaattataaaataatattcctatagccaattacactattttttggtgtctctcggcaatgacacgatcttacggtgtcctccagccaattacataaattttgaatgtcctgtagcaaattttgcctattatgtatgtggaaaaaaaagaaagttgttggagttgaataaaaagtacatgtaacataaatcacgaaatatatttaataaatcaaaatttatatggactttctgttgaaagaagggttaagttaacaactccattttctttttttaatggaaaactccattttcttcgtcacacaactagcacacacaagcacccaattagtggatcccctccgcttgtgggtaaaaaaaacgccgtgagtttccctcgcaccgcgtggccaccccgctcgcccagtgccgaccaggtttcacaccgcgatctctccagagggagagaggaaaaaaaactacccgcacaccgagacgctcgtgagtcgtgtcgtgtcgcgcgacgcgccgtgccgtgacgtctcttcgtcggcgcgccgaccccgcgagcgccgcgccgccggaaaaacgacgtcgtcacgtacgcgcgcgcggagtaccctctcacaaaagcgagtgcttcttttttttttccttttggggggcgtagtggcatctgcgtcgtctcgtccacacagcagatgacgggacgagtggtggtgtggtggcgtccaggtccatcgcgtgcaccgtcgacaacgacgacgacgagtccttttcttctttattactatctccatattttaatatatgtcgcccttaattttttattctatgtttgaccatttatcttattaaaaaaatttatgtaattatcatttattttattatgacttaatttatcatcaaatgttctttaaacatgacataaatattttcatatttgtacaaaaaatttaaataaaacgaatgattaaacgttggtcgtgaatttaaataagtatctcgcacagtagtataattgtagcttttttttggtttatctcctggctgagctctcccggtttttgcgcccctcgtcagcgccagaggacacgggccactacatttcagcgtcttagccctttatttcttttttctctcttttcaatttgttctatattacactgtacttgagtgaagaacatacgtaaaattgcaatccactcagaaatggcacggaggaacggacagaagaagcgacgttgatgtgcggctgtttctctctgtccggggactacaagtgataattgggggcgaggttataatgcattgctcgactgacattgacaagtcccgaaaaagaaacggttacatgttcgttattgcgcacgtccacattcgggaactgatcgatcgatttattatacgtatgtagccacaaatacctcacgactccactcccttccttccttttaacaccatctatcggataaacagggaagagcaagctagaagctaatgatagattttttctttctttcttttcctcccatttggagcggcggccaagagaatacacatactgtaacaacatctttttcgtcgaatactacatatgtagtgtatagagcatcaacgtgggtacaaaaaggaaaggaagcggtgcggcattggaagcaagcaaggatcggaagcatcccgtgatcatgccatcttcctaacctatatattcgctattatatactccctccgttttaaaatgtttgacactgttgactttttagcacatgtttaaccgttcgtcttattcaaacaaaattgtgaaatatgtaaaactatacgtgtacataaaaatatatttaacaatgaatcaaatgatatgaaaagaataaataattatttaaattttttaaataagatgaatggtcaaacacgtacttaaaagtcaattgtgtcaaatattttgaaacggagggagtatattttttattcctaatgagtggatcgctgattaatctataatcgtggctcaattagcctccatgagagatgacagcgtcacggtcgatcgatctccgtatcattcaagcaggcatcgcacgtggaggagtggaagctagtgtggaaccttccctcccctgccgcctgcctgtacacgccggcgcttacagtacaccctacaagcgaaagaaacccaaacaaaccaaaaaaaaaaaaagttgcaggcagcgaatgcccctcagcacccgtgcgcgatcctgccggtgggtctcgcgcccgtgccgtccctgcagccgcgcgtacgtacgcacgccgcgatcgacgaaacacgggcgcagtcgtcgtcgtcgtcgtcgtcccggtggtgtttcaagcgcgtgctgtgcgtgcggcggcggtgacaccgtgcgcccgcgtacgtatccgcgcgggacaagcagcggacgggccgagcaaaatccggtgttgtacgcgggccgggcgcggtgaggccgtccgctcgatgtaggccgttccgttgcggaataagttcaccggaggtccctcaatttaacagcaagattttttgaggtccctcaaggcctcaaccacaaaaccagaaatgttcgcccctaaaatttcacaaaccgttcaccagaggtcccttggcagtataggtgggtggttttgcttacgtggcatcctagtcaacaaaaaaaataaaaaaatttcgtgggacccacatgtcagctgcagtttattttttcttctcttttctctcctcttctctttcctctcctctctctttgccggcggcgggcggtgatgggcaaacgcgcagctggagtaggtggaggggcggcgtcagtgcgctagagcaggcggagcggtggtgtctccaggcgagcgtggctgcggcggcgggcaagcggcggctcgggcggtgcgtggccggagcaggcggaagcggcgacatctccgggcgcgggcggagtaaaggggcgggggacgcggggggcacggcgggcgagcggcggcgaggcgtcgcctctttcgccctctcccgccggcctcatctccccccactccgtccgctcccgccgctgcggcgcgccacctcgctgggctcctccgatgagtgcgacggcggcggcggcggcaaccagcggcgagaacgacgtgctcgttcgctctgtccgctttgcgcgccgctctcgccgccgacaacgacgcgactggcggagtaggccgccacgctcctccttcggccacctccgccgttgcggccccttcctccgcctgccgtgctcgtccgctctgcccgcagcccgccgcgcttgccttctgctcgcccgccgccgtccaacgtcgctacgcgtgccgccgcgccgctcgcctccgttctgcccacagggcgcgctcggtggatagcgggctcaaggacgacctcgtgttcggggaccccaacgcgccgcggtttgtgctgtgggaggggaagctaaggccggtgccgtccaagcccggcgacctgccgttcttcaacctcatgagcatccccggcaagctcagggccggcctcggcgtgctcggcattcgaccaccacccccttctgatccctccgccaccggcggcaacatccccgtcggccgcaaggatcccctcccggagcaggagcccgtcccggaacctgcccccatctcccgccgtggtcgcccgcggtccgccggccatcgccccgcccgtctcggtcgtcgaagaagagagaagagaagaaagggaaaaaaagaagggatgtggggcccgtaccgttttctctcacttacatgtgagccccatatactttatttatttacttttgctgactaggatgccacgtaagcgaaaccacccctataggacctcccgtgaacggtttgtgaaattttaggggcgaacatttctggttttgtggttgaggccttaagggactttaaaaaatctcgctgttaaattgagggacctccgatgaacttattccttccgttgcgtcccgcacggcttatgccggccggcccagggaggcgacacataaaccgttcggcctttttatttatatgtaaataaggtccattttatatggatccatatagggatcgggcgcccgatcttttaataaaaaaatcgggcgcctcttccagtcctcccagcttttttactgccaccacgtagacgcaagccactgcatcaaaagaagccatgcattaatagcactaaacaatagtaggatggttacagtattttttacaaacttcaaactattttttctcttaaattacttatccaattcacgatctgattacaccgttgtattcgttataattaaatctttacaacaagaccacacatgattatatttcgacaaaaaatattttagcttttttattgatattttttttgaatgttgcatatggtctcttttgatgtttcaatcagtagttttacgttgtttcagctagtgtacttgtgatgtttcactgtgtacggatcaaatgttgcaatagattttgatattatagaagacgcccttgcaacaaatcacgcgcatattatggaaatcttctattaaggaaatccgttttatattttgttccaccaaaaatgtttcacatagtgtactcataatgtttcactatgtatagatctaatgttgcactgaacgaaacattccattgcaacaaaaagcccacatattttggacatctcctattaagggaatttggtttatttttttttgttccaccgaaaaatgtttaacctagtgtactcacaatgtttcactatgtatagatctaatgttgcagtgaactgaaacattctttcgctatttgctgaaacattgtttttatataagttgaaacaacatccaatttaaacgagtgaaatattttcgatctacttagtgaaaccattccgatatatctggtggaacatcgtacaacattttaaaaaaattcaataataaattaatttttttcgtcggaatatatccatgtgtggtcttgttttgaagatttgattgcaacgaatttaatggtgcaattgaatcatgatttggataagtaatttaagagaaaaatcggtttaaagttcgcttaaaaagtttaacatgcatgcatgatgacgtcaccccgattcctagttgcttcctgctcctcagtgacttgcatgtatgtcaggtaggcatgactgaggatgggataacagcctgataacttttcccttccatcgggcgactgacatcaagcattttcaattttatatccctcaactataatccgagttccatttgtccattactaaatttcaacagaactgctcgttggtttgactaaattagcgtaaaactatataaatttaaggtgttgcagttgcataacgaaaactacatatttaacgtgaaatttctcttagaaatatagatttaagatagagtgtcaaaaaataatagaggttaagtagcaatcatcacaaaaaaaaactacaggtccgtaacttacatagctcctacacaatggcggtgctagggatttaaactctacaatccatagttttgtgatagcttcaatattaaatatgtaggagtgaaatacatgggatggtgtcacttaggtccgtgtgaaaattgcacgtttagatccgtgaacttggtttaatataaccctggtccaatggtcctttgaccacgattaaccaccaaggtggcaagcaacacttttgtgctcagccccctccacatatatcttcgcacataatttgccctgaccagtgcatttcaacccaaatccctcaaaatatccctaaatcggctagggtttcgactgtgaggttagcggaaggaggccgagaggtagcggctgtggtggcctcagcggtgagattagcggcaggaggcagcgcggtgtagcggggttagcggtggcatagtgcggccggattagcggcggagacagcgcaatgcggcttgcactctaggcatccccatggattctccaagctcatcctcgccttgaagtcgctagaagaaggtgttgttgatcaagtgtccgctgtgcaaggataaggttattttggagcgcagagcaatgacaattaacgttaatcggaaccatattttctgtacatgtaaggagaagaatgagaggaaagaacgatttgaggattttttttttgggattctggtgtcactatatagcaacaaggagatatatgcgacgtgttgtgatgtggagggggctgagagcaaaagtgatgcctacgtggcatgccacgttggtggtcaaatgtagtcaaaggacgtttggatcgggggtggtacattaaaccaagttcacggatctaagtgacaccaccacataagtttaggggccggccatgtatttcactcaatatgtagttttgtgatacttgttctttaatatgtagtttttttataacttttccactcaatctttagtttgcgatataacatttaaaatttttagttttgcaatagtttggttgacgtatctataggtttgtgaaatttactctttgtccatttaactgcaaaagccgatattgagtgttcctcaacttttaaaaccagtgcaaatcgagtctctaattagttttgtcctacgacctgttgacttggttctaagaggcacatacgtgatgcttacgtgtcactggaaggagaatacatgttagtgtgctctcaacctttcctactacggagtacttcctctgtttcacaacgtaaaactttttagtattgctcacatctatatgtatataggcaatgctagaaagtcttacattctgaaacggattctgaaacggagggagcagggagtaggtgagtgatggcgcggcaagaagcaacggcgagtgacaaaggagcaacattggctgtggtgtgggaataagcaaagggaagtgcatggcagttctctaatcaccctcgctgccaccccctccttccgacaaccgtgtctgaggcatcgccgccatgccaaatccgatcgagtattaattagggacaacagtggtggccaaagtgagagcagtgagggtcatgccatctaggatgaaattggcatccaaatcatcgaggagcttgattcggactagttttgatagttggagaatactcctactttacactcgattatacggttgaaggatacaaatgaaacttgatatccttctggtgagcaaccgggaaccggtctgccggtttcggctgcgttatatactgtgaggaatgtaaagtggactttttcccttccggtgaacacacacgaggagtggttgctggtggcggcccagggcgtcacacaaacgtgtggcctttttatgtttcactcaagttagatgatgtgagcgttgttattatgtataaacacgattaatcagtattattttcattatttatgttggtcaagtatgatgtttgtgatgaccgtggcacggagaagccgtacacaatgagactctacagatgctttccatcggatgtcaactcttgtactttgcaatgctaacaactagtgctagctatagcctatagctccggtagatcatcttattttttttagcgtcttggtcttaatttcctgacaactaccggaatcatgtaatcgtgacgcataatatagcacgtaattgggactacgcatcttgttagctacttaattaatttcgatggaatcaattggttgacagaccttcattttgcaacgcaaaatatatttttctcgcaataagcagttataaaattacctctaccaaacagcacattggtcgttgacaatagctactcccatctctatttaatgtaacgtgctaattaaattaaaaatattaaccacgagatacacctgtatctacgcgtataatacagtcctataccaatccatacccgtaccttcccagtaaaggaatattgcaatacgtatatctctctctgtgttgcagttaattttcttttctttaaatatacttgttaatttgaagatcatttcctaatgtaacctgctcgaaatcttcaaccacaaaatacacctattccagctcagacgcataccttcccattaaagatatattacatacttattctctctgcgtttcagagaacaattccaaatataattgtttctttgaagatcatttcctatctaatctaacctagtagtgaaaaaaaattccagccataaaatatctgtattatacgcatcctcagttctatgcatctcagccacaaaccttcccatcaattgaaaaacaatttttttatatgtaaatgaagtaggaggtctgtcccttttattttatacctagaagggaacaataaagaacaaactattctaagatataccatcacaataccagtagtacatatttatctctgtatttcacggaattatacttccaaatacacacatgttactatcgagttaatttcataatgcgttgcagccttatcctgcgatcaattgattacacgattaatttagacctaaacgcagcatttgtcgcatcgggtcatgagtcatgacgcgaggccagcgacgtaattacattctaaactttgtggtattttcaccaatatattttccgtctgaccttcgcgcggcctgatcccctcacggtcgtcgtcgtcttcttcccaacgaccgatcgatcgatcgatcgatcgtcgcggcgagaaggggagatcgatcgcgatcggagccgatttgatcggcggcgggcggcggccatggccgtggtgctcggcgcgttcgtgccggacaccgcggcgcagtggcgcagcgtggtgaagggggaggtggcgcggcagctgggcgtggaggcggaggcgaggaagctgggggcgaggctggagaaggtgggcgccgcggtgcgcgacgccgaggcgcgggtggcgcgcgggagcgacgccgcggcgcggtggctcgccagggtgcgcgccgcggcgtacgaggccgacgtcgccgtcgaccggtgcagggccacggcgcgccgcctgacgaggggccgggagcagcagctgcagcagcataaccaggtgagatcgctagccttgaattccgacaaaagcaagaacaccttggtgacaatggcgtcgcagagcagctaatttttgcttcgtgttgttctccggcgagaaggcactgccatggctgctgtccacctgctgcgacgtggccgagccgcgccgcgacatcgccgccgacctcaagaacgtcagccagaagctcaagtccatcatcaaggagcagcggcagctgcagctccaggcatccgtcgccgatcacactgacgaccatccacggaagatcctgaggcaccggaaatccgaacccaccgacatcgacatcgtcggcacggcaatggaggacgacgcgcgccgcctcgtgcgccggctgacgcagccagacagcggcggcgtcgtggccatctacggccccgacggcattggcaagaccacactggcgaaggtggtgttcgacagcgagagggtgaagcgaagattcgagacgaggtcatgggttcacgtctccaggggttgcgtcgaggacggcaagcgagaggccgcgctgctctcgcaggtcgtcgaggccgtcgttgacggcggcggcgccacgacgggcgccgagaccgtcgccgagctggagagaatgctggccgccctggtggcgaacaggaggttcttgctcgtgctcgacgaggtgaggaacggcggcgagtgggaggagttggtgaggcggctactcgagcgcggcggccgcggcagcaaggtgctggtcaccgcggtcaccgccggcgtcgctcgggacatgggcgccggccacgtccaccgcgtgaacaggctcggcgaggacgacggctgggcgctgctccgcgtggcggcgtgcgtcgccgacgacggcggcgcggcgctgaggggcgtcggccggaggatcgtcggcaagtgcggcggcgtccctctggcgatcagggcggtcgccggcgttctgaggacgcgggaggcgatcgccgaggagtgggcggtggtggacgcgagcccggcgtggaaggtgaaggggctccccgacgacgccatgaagccgctgtacctctgttacgacgacatgccgtgccacctgaagcagtgcttcctctactgctcgctgttcctctcggacttcgccgtcgacaggagatcgctggtgcagcagtggatcgccgagggcttcgtgcagatcaggggagacgccggcgtcgaggaggtggccgaggagtactacgacgagctcatcggaaggaacctcctccagccggcggaggccgaccggcacggctgcgtcgagcggtgcacgatgcacgacacgctgcggtccatggcgcaggtgctctcccatggcgagaacctcaccggcgatgcgcaggcgcagcggctgcccagcgacggcgacgcccccttcgcgccacggcacgtctcgtttccgaggaaccaccttgctgcaataccagaggaggttctgaagcttgagggtgtaagaacgctgctgctccagagaaatccactgacaattgggagcaacatctttacaaggctgctatacctgaaagtcttggaccttactgaaactgcaatggaggtcattccagagactttggggaatctgttatacctgaggttcttgaacctgtcccagacaaggatcaaggcgcttccagaaaccatttgcaatctgtggagcctcaaattcttgctgctaagagagtgcaaggcattgcatgtgttgccaaaagggatagagcatctgaaggggctcagagaccttgatcttacaggtactgtgatcaaagacgcggcattcagagtaggccatctcagaaacctcacatcattccgatgcttcaccgtgacgagcaaagaggcgcgtaccgtacaggataccgcacaggataggagtgggtggcctctggatgagctcaagaacttgtgtcagctaaggacactccatgttaagaggcttgagaaggccactagtcagtccaaggcagctgaagtagctcttcatgccaagacaggactcagagagcttgaactgtcgtgcagcggcaccgtcaagacattacagataccgacagtggtccgaaatatagaggatatcttccaagagctgaaaccgccacgaggcctcgagtcgctgaagattgcaaactactttgggacaaagttcccgacatggctgtcatcgacctgcctgccaaatctcctccgactgaatataaccggatgcaatttctgccaatcttttcctctattaggtcgtctgccagagttgagatctttgtgcattgccgattcttcagcgctgaaggatatcgatgctcagcttatggacacagacaactcccatcaggtaccatttccaaagctggaagacctgcacctgcaaggtttgcataatctggagacgtggacgagcattgaggcaggggcgttgccatctctgcaggctctgcagcttgaaagctgccccaagctgagatgcttaccagatggcctcaggcatgtgacatccatgactgagctgcgcattgtggacatggagagccttgaggctgttgagaacattgctgcactgagggaactgagtgtttggaacacccccaatctgaagaaaatatgcaacttgccttccctcgaagatcttgacatatgccattgtccgtcgctggagactgtggacaacatcaacaggctgcaagaggtgcacatcttcgatcatgaattgcaggagatgccgagatggatccaggcacatgcatcgaagctctgctcactggaattcatgagcacaactgaactgttgaagaggtgcttgattgatggtcctgactggcccgtgatcaaggacattgcacaagttcatggatactcgaatgactctagttacatatactattccaagagtctcaagatctttgagggcagcgcgagtattcgagaaagccgtgatgcagaaaggagtgtggcagattctgataaagttgacgatgcatcaatagagagcagaaacgttgatcgagatgcagaaatcgatggcttcttcagctcaaaattagtggagacaggaactgccaggagtgaagacaatgtaccggataggaatatggagaggttcatgacaagatccactggccgccgattgcataagctggaagaagtccccgaaggagatgaggatgaggaagaggaaggtgcagatccagtagttctgattcctgatgatacaactaaatctgacaccgtactggagaaacttcatcctgttgttactcatgatcataatgataaagcgggatccaagatgaaaagggatcctcctgcaaaaactgctccaggtacttctgttattcaatctgctgccacaatgtgtcataagttggtccgagaagggtctcaagcaatcagcattactgaaactgatcaagatctgagcctcgattcatttcgaagcaaagaacatgcatctagtaagcagaaagttgacacatctggttctgtcatagaaaaagtaaaggaaggaagatataaatctgcaaatatcaatgaccgtaagcacattgagagagttcatgactctgcaaataagatgtcaactacttctgtggagaaaagcattcccgaaacagtcaaacctatgaaagcaacaaagaataattctaaagcaacagactatcatggaactgagaataagtcacctgatagtttggcttgttccaggcaaacaataagccagatagaaaaggatgtttctgatgctgataaggctgcaaatcatccatccagcgcgatcacagagaatcgtctacacaaagcaaatgagatcgatgcttctgctactgcaataaaaactgaagtatcaaagaaatctgctggtgccaatatttgtaataccttaaaccctgcagattcacaaacagtacatgctactgacactgctcaagatttgccttccagtttactccatgatgacccacatttaccagatgttggcagcagtacttctacttctatcagtgacaattgcattcagacagagagcagcaacacaagtttgtcggccaacttaaataatgaagaacctaaagcgaaaggtgttaccaaaactacttgcgcatcagggccttgcaaactgactgccaccttagactgcaaacaacagactactaatccaagtgacgacacagatgcatccatgaagaagatggcgagcaacatctctgagaaagttgtcaaaacattgaaacgcccacatgctgaaacagtgaatattactcgctcttcatcactgccaattgaccctaaatctcatgtcattgataccactgcagcaacgaagaaactagaagctaccctgaaaaacagatcctcaagaaatgcagcacctggccttgccgatgacaaaaccccagtatacaacgactcccatcaggcaccaaaggtgtataccgccatctgggccgacaccgacacggacaccctgaaagcccggttcctcagcacgatgcagcactaccgcaggatggcttcgcaccgtcgccgacgccatagaaagcatggctccaggaccaagtggagcatctggccagtgctggtggccatcctcctgatcatctcagtggcacagctgctgttcaccttctggatgtaccgcaagctcatgaatcaaaactcaaaagtagacgaacaatgaattctacactgcgaatttcatactttggatgaagtagactgcgcgtgccttgtgcgttcatatgttgtgttgtgtagctactagctactgagtactgactagtgagagcaatagcccaaaactttggcgggagatcgtgaattttgaagcagtttggcgccaaccattttcaaatggcgctttgctccccgctaaagcctagtagctctgagatttgggaagcgaaaatttggggggaatgaaaggggacagaatgaggaagaagcagaccaagaattacccgagcagaatccgatcgaccggcggccagaccaccctccaatctttcctcttcaaatccaggtagggaaagaagctacctcgaattcagattgtccccaatttttttccccatccttttcgcttcttacatttgcccttgaatccttcagcgttgtcgatgaggaagtgaagccgatctcgccgccgccggagaaggaggaggaggaggccatctcgccgccgcaaccgccgaagcgggagatcatccgagtcaccaccaaggcgatcgtcaaggtaaccaatcgaccaaaccaatccgatgcttccccttccttcgcggtgtaactctggaaatgcttcgggatctggcaggagaaggcgagcgcattctcgtcggtgggctcctcctcctcctcggggaagagcggcgccggcggcggcgccctcaacgcggcggcgctgttcaggcggttcaacagctcagcccccgtgccgagagcggaggccgcgggagacggcgatggcggcgtccggctggagatcgaggacatcgcggcgggggatcgccgccgcgagaccaggaagcggaagagccccctcggtgcgcgcctcgcctctcgaatcccatctccccctttcaggctttcaccactcatccgtgacgcgatgtcgatctccctcgcaggtggtggcggcggcggcgacgaccaccacagcggcggaagcggcaagcgcgtggtggtgctcggcgacgacccgaagccgaggcccgcggcgaggacgatgacgacgacggcgacgacgagaaggcagcggcgggggcggcggcatgcggggcccaccggccgcggcgaggagggcggcgaccaagctgcgtacaaccactgtaatctctctcccctctctcgttcgctctctcgattttgtgacggaaatttgaacggcgtggtggcttggtttcagacgcgagcggcggcgggtggtggcacggcgagatggagggcgtcgacggcgaggaggtggggtggaccgacgacatgtgggaggggatggggtccatcacgctcggaggcttggagtggcactagcagcagccgccgccgccgccagtcgcgagctccgccggtcgccgcggcggcgcagctcgccggttttgggtttcgggtttggaaggtgacatgcgttgttagccacggcgagctgtgggtcagattatgctatgtctaatgagattattatatcatatgttactccatttggcactgtttgaccactcgtcttattcaagaaatttgtttaaatataaaaaataaaaagttgtacttaaagtactttagataataaagcaagtcaaaaataaataaataataattctaaaatttttaaataagacaagtgataaaaagtgcaaacaaaaacttaaaatccctatattatgtgacggagggagtagatatcagtgaaaaacaaaaggggttaaaatgctgctgtgctaacggtataggagtattttgaagtactaatataatttatacgctttatatgtgagaaatgatcaattagtacatcccagcttaatcaaactctgctacggcaggcagaccaatgtatctctaccaaccacaacaaaaactattgttaaaaatttacaaatggataacaagcaataatagtatactcccgctctctgttttatattataagtcgtatactttttttttgttagttaaactagtttgtagaaaatataattacattttcaatactaaaaaatctcaaacgacttataatataaaatatagttaaatttaatgaatctaatttggtgttgcagttgttgctatttttttataaatttagttaaatactaagaaaaaatcaaacgacttatataagtataaaatggaggaaataccatttagcaaataatagcatgaagagagaggtgaggacaaatacatagcaaaataataaatattttttattcagtgttcttcttagtactccacgatgcttactatacctgatagaacatataaatcaaaaaaatttacttataaattacttcatattaataagccgttacagattataattgtaagccaaaaggtggggttgtttctaaaaaatcctgatcttttcttcaataagagttggatgaacattaagattttcgtggcacgtttttcaaactgctaaacggtacgtttcgtgcgaaaactttctatatgaaagttgccctaaaatatcatattaatctatttttcaagtttataataattaaaattcaatcaatcatacattaataccatatcgttttgcgtaaaaaaacttaattttcatcttcattttcaggagaaaagaacaccatctaaaatctacaagctagacccccttcatctacctattttcggcagtcaaccctacatgatggcatgatgcaaaatgccaccacgattcattattgatcatagttcatactccctccgccgctccgccccctaatacaaatgattttaatattttaattgtaagatttgatcacttgtcttattaaaaaaaattatgtaaatataaaaaatgaaaagttgtgcttaaagtactgtagataataaattaagtcataaataaaataaataataattctaaatttttttaagtaataatggtcaaacagtgtaagcaaaatgtcaaaatctcttatattagaggacgaaaggagtacttcgtaaacttaaattcgtgtcatatggtatctgcacttcacttcactaacccctgagccagcaatttgatttgaactgctctctcggagatgatgaagccgaggaaacagttggtgctcaaacctcatcttttcaaatcttggtttgcggctttttcatctggctttggggtaccagatggtaaggaagtgactccggattatctccaaagattcgtaaggtgaactgtcttgcttcactctgagaccaacccattaggcgccatgattcttttcagctattggctatattaaattattgcgatcacgctttttaaaattgctaaatgttgtgatttttgaaaagtaaaattttatatagaagtttctttaaggaaaataaataattttatttttaattttgtcatagttaatatttaactaatttctcaattaagtgccttttgcgataagtcaattgctccttcctccaacctctgaaacgaacagtgctaagcactactccctccgtttcacaatccctccgtttcacaatgtaagtcattctagcattttccacattcatattgatgataatgaatctagacatatatatctatctagattcattaactttaatataaatatggaaaatgttagaataacttatattgtgaaatggaggaagtatttgtgatttgtgaacatccaaaggacattgtggtgactcgaaccaccattcagttgatctgtaaagcactaataaagcgtagaaaaaccactctttggcaaagaaacaacgtgcaaagttcaatcacgcataattagaaggcccaaatgctaatcaaccgccaagtgtagcaaaattcctcatttgcgtcttctcgaattaattagtcgatgtcagtgacagatgacacaaaagcaaaagtcaggcagctcatgtactccctcagtccctatatataaagattttagttgaatgtaatacatcataatgcaacgaatctagatgatcattggtccatttggatgggatagtgcgccaacagcgagaaataaatttcttgtttgggccttgaatggaaattggaaaacagaaacctggaaggaatcttttcaaattgaattatttcacataatcacatggaaggcttcgttgctccaaacagaagtaaaactgcaatgcaccttcgaacatctaatattcactcaatttaaaacgtactccgtccgtcccaaaaaaataagagattttaaacgaatgtgatatattttaagacggatggagttctatgagtttgttgatttttccaataacatctgaccattaatctcatttaaaattttagtgcagatataaaaaaaatataacatatacttaacatacctttaataataaaaacaagctgtaacaaaataaacaatacgaccaatcgtatgttcaaaagtcaataatatcctataaattccaatttaagcttaaaaacgcagtgtgctcatagacaaaaaaaaagtctttatttccatgaaagagatagtaaaacattacaacatttcaatacaaattcataaaaaacaacaacattgcagcatttctactgtcagatcagatcctctaaaacgcggttaacctggacatgtttcaaaacaagaactgctattagtaacacacacgaactcctcccgctcctcctaatgttgccaatttcacacgatcgccgcaatttcgcagaggagaagatgaactcatcatcatcatcatctttctcgccatgaactcgatctcatccttcacctcctgcatctcgttcagctcccagaagatgagctcgccggcgagcttccgccggagctcgtgcacgtcgtccatggtgaacccccgctccagcttctccccgtcccagagctccatgcacttgatcgcgaagagcccgcacgacgactcgtcggtctgcgccgggaggccggcgaccatccgcagcttccatccgccggcgtccgcctccgcccccgcccgcccggccgccgccacgcaccgcgcgacgccgccccgtatcttggacatggcggcgtcgtagaatctggggccgaagcggcggccgtagttggaggagtcgaggatccggtactcgccggcggcgacgtcgagcgccgccacgaagaagtgggactggtggttcaccgggaagagcaccgtgtcgtgggcgaggtacctggcgcccgtggccgacatgtccgcgtcgtgccccgccgccgccgccgttcttggcgggagggagctgacgtactccagccagtcctgctcctcgacggagccgaggagcacgcgacggccgttgcggcggcggcggcggccggcttggcggcggcggaggaggtcgagggcggcgtcgaggagcaccccggtgatctgcctctccgggccgtcgcgggacaggggcacggcgaggcagcgcagcgcgtcggcgcggacgcggacgcgcggccgctccgacgagaccagcagcttgtccttgcgcccgccgtgcgcctcgacgtacgccatcgtcgcctcctcccgcgcggcgtcgacggccgtgctgctcgccgcctccgagcggcggcgcgcgttcttggtctccgcaatcccgatgttcgacgccatggctagctgacgcacgcacgccgcgctctcacgtgttcgtggttcgtactcgccggagttcgatcgtagcggcggcggaagcgcgagttctgagctccgacggggtcttgagaggcgaattcgcggcgtgcaaaggaagaatctcgttgcttcgacgcgacggcgacgagataaatggaggtcggggaggcaaaggcggtggaatggtggggatggtcggtggcgcggctgcaccgaccgaccgagcaaaagtcggtttccggaattgacttgtctggagaagcgggctgtacttgcaacggcgaccggtgggcccaggtgtatatctatctactgctggcccactgtaagcccatgttaatgaggcccaattagatgggccgcatcaatgtggtttccggcccaacagtggcctcattcccggcctcttcaggcccagaatgtatgcgtcagacgtaggccgattcctcttcaggcccagaatgcatgcgtcagacgtaggccgattccttttcagccccagcattaggccttgttcgtttaatcccaaaaaagggatttgggggagaatacatcacaatagatatggaaaaatcccttccaaatcccaccaattctcttgtggaagggattaaccgaataagatcttaatgggacccaagaaggatgccttccatttcccttcaaaattaattatactccaatcttttatcaacgactttttcttcctaacgaaatgcgagagggcgaaaggggtgaatgggaagtactccgtgctacccgttgccacaccatctccagctatacggatcacaaccactatcggctgccaactatttgtgtctattgttcgtcatcgccttccaaatcaccttacgtcgccaccacattctgaacacttctagtgtgtcgtaaagccactctgccatgctatcactgtcttccgcagatcgtcaaagtcctcgatgctcctagagcatcgcgaagccatccaccatggcatggacttgcctttactcttatgcgttcatcggagatgctccaccgccatccacatctatccgtaataagaccttggtgtcgatgcttgcccgagagctgatcatttgttctactccttcccttttcagaatatttttgtaccccttaatttgaaatctcagtgttaaaagttgtcagctagtggttcgatgctcttacgactgatttttggaatcaacacgtgaccaacaacacatcttcaccagtgatttatgaagaggagttagggtgtgtttagttcacgctaaagttagaagtttggttgaaattagaacgatgtgacggaaaagttaaaagtttatgtgtgtaggaaagttttgatgtgatggaaaagttgaagtttgaagaaaaaatttagaactaaaggtcgtttcacattttcctaatcaatcttcctaaagtttaaccatacttgtgaagaaaaatagcaacacatataacaccaaattaattttgttaaatctaacattaaatatattttgataatatatttgtcttgtgttaaaaatattattatatttttatacatatttgattaaaacgacttataatattaaatatagaaagtaataaacaatactccctccgttctaaaaaaaagacaaactgtgggtttccatgccaacatttgactgtccgttttatatgaattttttttataattagtattttcattgttgttagatgataaaacatgattaatattttatgcgtgacttatctttttaattttttcataattttttcaataagaccgacggtcaaacgttgaacacagacataatagtttgtcttttttttttttggatggagggagtatgaattagagagagtaataaactgttaaattgcccggaagctcgtgcgctaaacgctgagatttattttcattatcttaaaataaagcacagtattaattaagaagttaataatcgtattacgattcacaagctagaggagggttcgtggacacatcacggttttccactgagcgcgctgcgcgcgacgcgagcgactcggcgatgcccttggcgacgcaatacgccacggactcgatggtgatcatcgggttgacgccgacggccgtcgggagcaagctgccgtcgcagacgtacagcccctccgcctcccagctctcgccgccgccgtcgacgccgccgtgcttggcgctcctccccatccggcagctccccatctggtgcgccgaggcaaggagcgcccacttgtccgaccccgggtgcatcggccccttctccacgctcacctcgtccaggaacgcctccacgtcctcgtcacgcgcgcccttgcaccggaggcgcagcccgtcgctgcggttcgtgcccacctcggcggcgccggcggccaccaggatgcgcagcgcgcgccgcaggccggcgcggagctcgccggcgtcgccgcggctcggggtgaagcggacgcggccctcgccgccgacggtgcccgcggcgcggtcgcggacgagcaccaccgcgtgcgccgtgcgcgcgtaccgccgcatccgctccttcatgtcgcggccggactcccacggcaccacggcggcgaacgcgcccgggccgagcgccggcgtctcgatgatggtgcggtcggtgacgcggtgcatgctggtgatgatgccgccctcgtaggacttgcccgggagctccgccgtgctgtccgggaagtagccccacgccatggacccgggtggaggtgaaggttccggccgatgtggcggttcttgagcccgctgttgcgcagcagcggcggcgtcatgagcgcgccgcacgccgagacggacaccttcgcctcgatccggagcttcttggtgatgcctttgcccaagcacttcgccacgacgccgacgcacttcttgcgccggccgccgccgccgccggtgttcgtctcgaggatgaaccgttcggccttgcacccggtcaggatgacggcgccgcggccgacggcgtcgacgagccacgtcgtgtcggtgccgcgcttctcgccggtggggcacccgaggttgcagctgccgcagaagtgcccctccgacgagttgcgcgacacggcctcgacgcgcagcccaagcgcctcgcagccgcggcgcaccgccttgttctggaacccctcctcccggcaccggccggtgacgccgagccgagcgcacacggcgtccatggcctgcacgtagccttgccccccgaacagagggagcccatggtcgttcgaccactcctgcaacacgttcgccggcgtgcggatgcaggccgaccagttcaccgccgagccgccgccgaccgtcgcgccggcgaacatggtggtcgtcacgttcgccgtgctgaacacgccgccattctcgtagaggcgctccatggtcgggccctccagcgagctgtagtccctggcggcgaagtagtcccccttctcgacgacgacgaccttgtacccggccgacgcgagcacggcggcggccacgccgccgccgcagccggacccgacgacgacggcgtcgcacagcaccgtgtggtggtgcgcgctcggcgacgacgcgcccgtcttcagcgcgaggcccttctccgcgagcgacatgagcaaggcgttgtcgtccagctgcttggtctccacgacgccattgtccagaggccggcacggcggcgccgtcgccggcgccggcgtcggcgttgcttctgtaggttcttctttctgtggctcttcctcggccgccgggacgctgtacccgattgccttccaacttgggttctccaagttctcgtccacctacatatgttgggaaaagaaggttaaatcgttgataattcgaattttctgtgaaaatgtgtatgcttgcatttcttttatgatttttataatggtcagatttttcatgaaccaaagaaaaaaaagtacaattcttaataaggtatggtaaaatactaccaaaactatagtaagttaacttgtggtaatttcattatgtaaaaattacagtattttaccattcttaataaggttccaagtgtcaatatattctatagtaagtttacactgtgaagtactacatccgtcccataataattgcatttctataaaattagagacggattaatagtaaacacaatttaccacaataagggcatgtacaaagatagagttaaatatgagctctacgttatatagagactagcatcctataacagttagagacaatatggtctctaatcattaatgtatcaaaatactttttcttacttttctttcctttctttcaccaccatgcaacaaaatttgctctaataaatactaagagtcgactctgagctgttgtcatgcataacaaccatacacatttctctttcttccatgtcatcaaatttacttgcatggcaatagagagagaccactaataaacaccgttgtacgtgcctaagacggattcttaataatgcaattattatgggatggaagtacttcacagtctaaacttactatatgatatattaacacttggaacctaccaaaccaggagtagattttttaggggctatctaaaaaaaactccacaagtttattatgtaaaaactttcaaatgtaactgtattgtaatataattataccgtaagtatattttaattacattgtaatttttatgtaatttctgtataagtattaaaaaaatatatgtagcttgaatcatagagattactatttaagttaaagagtgattacatatagttgcactacatgcttatatttgaaagttttttttacccaaactttttttagcaatatcctttttttttactatgcaaagttcaaatcgaaacaaattcggaaagtacgactagttgtaaggtggtggagttgtggcctcgttggtgtatgactcgactccacccgttagggttatcgatgaatatacgtgagtgagctttcaataaaaaattactagttaagctagggatatatcacccgttcatgttttatatgtcttacgcgtaataaaaaaaaccattttcgttagaattaacattaccgcggtgtagaagacgaagtggcagaggaccttgatgagggcaaagatgatcttgagcgcttcagcgccgcctcccgccgctccaccggcatgtcggcgaaccggcgcacgtaggggaactcaccggagacgcaccgccggccgcacagcgccagcgtgccgaccctcgtggccaggatccacaggatgatcctcaccagcacccctgcctcccagatgcaccgtgtcatggtcagctcagcaaccttttcttgcaagagattagagacaaagagaaaaaaaaatgttaagttaaacacaacttgttgtatatcaaagttatctgaaatagttagaagaatcagagatttttcagtagttattaaaagacaattgttcgagagttgacttgaatagttgggactgaaatgtgcaaaaaataataataataataataataataataatttcgggcctattgtccgaagtttcttttttcgaaagaagggggcaaagttggttagttggttagtgtagctatcataattagcacgagaaaactacgtctacgaagattagatcatgataaaaatgcactgcatctaatgtttcagttaactgactgatcaaatgccaactaatcaactcgaagaattggagtagctagggtgaagacagatggaatttctgttagattgctacagcttatcagggcttgggtcgagctgtgttagtttcctgttagtctgtaatgggcaggttggatgtttcttttgtggttatcggctagggacctggtctttctatcgatagctatctctcttttttttttcaagacttgctgtagtttattttcatttttagtaatgaaaatgggggtgcttggcgccctagttctaaaaacactaatcaactcgacactggcaaaaagtattttttaacaaaataataagtggacatatattgaagctttcaaaagttttaaaatgaacacatggagaaacaaaaattgagtcatcaggttgatgagttgattatcgtctctgacagcgctgatcagtcgcgacgaaatcatctcaatcaaatcaataccatatgcgtcgtcaacactgatcgatgacgacgcatgcgctcacctcgtcggggacggtggactcggcggcggtggcgaggtagaaccgctcgacgtccatgtcgccgccgccgcgggcgccgtcctcctcctccgccggcagcgccgggatgagcgcgccgcacatggccctgagcgcccccatctgcgccgccccgagcccgtgcgtgtaccgctcccgcctcgccgggccccgcagcgccgggtgccccctcgccgccggcgccgcctccttcgccttctgatccatggcctcctcccgcggcggcgacgccattaaccaattccctgcagctcgcgcaagctcagctgctagctatagcacacgtacgtgtgtagatatagagtaagtaccgaagtacgtaccggagcttgcggggcacagcacgcactagcctcgcagcgacgtcgacgtcgatctctctctctctctccgattttgtgaagctgacatgtttgtacacacgtatgttagagtacagtataccagagaaatcttgtgtagctgtgtttgagactttgaggagaaggagatagagaagattggaaagatacgcaaaacgaggtgggctattagcgtattattaattgagtattaattattttagactttaaaaatagattaatatgattttttaaagcaactttcatatatattttttttaaaaaaacgcatcgtttagtagtttgggaaacgtgcgtgtggaaaacgaaacaaacaaactccctttgttctccgaacaaacgcatacattatattagaaatctcttacgtgacctagaccgctgacacgttaattagaggaagtaacactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttatcaaccgggactaaagatcatctttagtcccggttcgaatgctgtcaggacctgtcaggcccccccgggatctttagtcccggttggtaacaccaaccgggactaaagatcttaactttaccaaccgggactaaagatcccggtgatctttagccccggttggtgttaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaactttatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaaataaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtattgaaatggaagaagatgaagtggaagacgacaatattccggactttgctcagtatgttggatttgaaggaaatcaaacgggcgaggaggaaatagctgctgatggtaacgacgttgcggatgatcttggtcagatgttacaggacgccagggaggactgcgaaagtgaaaaggaggcccataaattggacaagatgttggaggaccacagaacttcgttgtacccaggttgcgagcaggggcacaaaaagttggataccactttggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaatcatgccctgtttgcaaagcactacgatacaagattagacgggacgatccaggagaagttgacgggcagctaacaaagaagagaattcctgctaaggtgatgtggtatttccctataataccatggctaaggcgtttgttcaggaacaaggggaatgctagaatgttgcgatggcacgctgaagagcgtcaacaggacgggatgctgagacaccccgccgatggttcgtagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacagtaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaattctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaaacatatggaacaacgcggcgaccttcacccggaactaa

SEQ ID NO: 74877 - DNA, 1046 bp, Oryza sativa
ttcctctggactgggttcggtttcttaccaattgatcgcggtaccgtaaggctttggcgacactgtcctccgcatttgcaggctccatctccactgattgtctcactgcatggaaaaaaaaagcattgtgtcgttctgtaatttgagcaagagctagcaatagataagcacctaatccaaagcaaatctaactgataaatctacctaatctcaactagcacttcctatgctcctgtctgcccaaataaaatgctgatttgcatgtaacttcgccgttcaatcccgttgaaacgcacctgccgttgtgtgacaaatcgtcgggtcccagtggattgaaaaaattcagtaattttcctgattacatcatcagctgtgagacacctgcgtgcagtacattaagaaaattcagtgtttgatcaatttcatccattcattcattcagtacagtagaaaatatcatccattcagtgtttaagaaatttcacatatagcaacctacaaatgaatgtgctctcaggtgatacacacatatgtaaaatcatgtgatgaaaagcaacataaagggaaattcaatttcttcagttccatggcatgggacaaatttctgagtgtgaaaatcaaacaaatcaattagtgttgagagagagaaagagagagagtactgcatccaggagttggggccgcgtcgccgcagcctggagacaaaggcggggtacggagtgagggcagggacggcggtggcgcggttcagggaagaagacgggacatggagttgggaacgcggcggcgcggccgggggtggagaaggctgctcgcgcgccgggggtggagaaggcggcgcgattgggaaagaaggaggtcggatgcgcgcgattgggagaggagatggcggcgcgaccgggagaggaggagccgagttcgcgcgctcgtgtagataggagagggcaatctgttcggttgatggcataggtgggtaattttttcaattatctaggggtagtggatctttatccactcaataatctggaaaaagctcttttagagca

SEQ ID NO: 74878 - DNA, 2784 bp, Oryza sativa
acccttagattatcttaaaccctacttaggatatgattatcacaagtaatatataaattattagtcgagttcactctaccatgatctttccatgggataaaataaatacgatacacttaaaatactctcgggtgaaatgctacaatggtatatccgtgcgcttgcggatgaattctgtaaccataatatagcaggagtgtttctgcgccattgtttttagtaatgacgttaagaaataccaacagtagccttgttaagtttcctataatctatgcacatcctccatccggttacggttcgttgtgggataagttcattttgagcatttgcaaaaaccgtcattcctcccttcttcggcacaacgtggatcgggctaacccactcactgtatggtacgggataaataatcccggcatgcaggagtttcaggacctctttctttacaccttctcttatcgcattattgagccatcgttgaggttctctggagggagtactctcggggtcaatagggatacgatgaatgcaaagcgacaagaacagcacaatgcttttctaacacagtcagaagacgttgagtctcgactttggagagcttgtcactgattatgacaagggcttctttgtaattgtgcatgaaggcataccataggccttgaggtagaggtttaaactcaagcggaggtcgaggtggcggttccaagattggaagatcgagagtctcttcgggttccgcttcttccttgatgaagtcagggacttcatcttccaaaagggcctcgggagactcgtgaggaggaactgttgtaaccttctccgctgactcaatctctaggagagaatcgatcaaggcgaaccttgcccgtgagaatgggactgagaattcattccctcccaaagttatcttgaggctatctagccggggtgtgcttatgaggagttgctcaatgggaagcccgattagaatgtcaaaatcttggatttcaaaggcatggacatccaagactggctccttgtcacgcccggaaattcactagtaatttccgaacttatttgtgcataaaacagtcatccaggaatcagccgaggtacataaactgacaatttaatatacaaatccatcaaaataactaaagcaattaatacttactgaagaggcacttagtcctcacaacgaagaaaactacagcggaaaaataaaatctagcgaaactccggctccactcccactagcaactcaactgggtataagccaaacgtcttctccttttggatccttttcttcaactgaggttgattgattattgcaaggtgagcatatgacatggactccctagcgacccccacggacttctcgccgcttctcagtatggtaccccgcaatgaatcatgctatacagaagataaagccgttgcccacgctggcttgtggttagcatggttaatgtctcacaacagtagctcgcaaaccggtccttaattgtcatgagcacgaccttcaaaaccatgtgctcacaacccaccattaacaagttttaattatcaattaattatcataacacgattaaccatcgtgagctaccattaaatataatcataaataataatgtagtatgattcatcccattaatgagctaatgtttctaagcatggctaagcaattatatatatatagcttttagctgaaccaaaccaatatataaggttcaagctaatcaatttgttacccaaggtatcaaggaatagagtaatcaatgcaaattggccataacaaaggaataggttcacaccacccggtgacattcgaaaataaatgcacagttgaaataaatagagaatttaaatataggatcaacatgctcaaaggaattgtgtttgggatctgtgtgacttgccctgcaataatcggtcttcaattagtcttctgaatctcttccgacacactcacgagccttcgcaacgacggaaacgacaagctaacacgcaaaacggaaaaaaagactaataaaaaccaaataaacagtacatataaagtaaacaaacatgtagatcatgattttaagtgaatttagcagcttgaaccactcgaatccgagttacgatgatttagttatgaattttctaagattaatctgattttaagatttatttttagaagggaaaaaggcttcatgacatcatcgatgatgtcaacaccggcgagaggctcgggacatcacggtcaccggcgatctaggtcacgacggcgagaacggagggcaccaacgcgacgagcacgacgcggggaactcactgaggggcggcacgatgacgaacgacgatgggagacggccggtgacgagatcgaatcggcgacgggctcgacttgacggcgtcagaggcgctacggcaggcttcggcttcgacccaggggtcgacggtgtgcagttcctccttgcgaagctgggagaggcgacagcgcaggtcgacgacggccgaggcggctgctaggggcggctggagcggctgccggcggtggacagagaagacgaacgcggcgacggcgctacaagcgacggcggagagagggagaggtgccagccgaaagaggagagggaggggactctatttatagccatgggagagagatcgatccaacaacgagagaatcggagccgggattttctagggtttggtttggagagaaaaacacgaatcgagctcgattctgcgttgatttcttcgggataaagtccgattcttgggggaaaagataaaggaggataacaggaatatttcccctca

SEQ ID NO: 74879 - DNA, 26006 bp, Oryza sativa
catgctcatgcttggtcgccggcgccgtgaacgtctggtaggtcacggtgccggcgccggggaagacctcggcggcgcggcaatggcacgccaggccaagcggctccagggcttcggccaccggcgtgcagagcgacgacgcggcgctggaggtgtgggagatggagaccgagacggtggccgggcggaacgcggcgacggcgcggcggatggcggcgagcgcggcggcggcgtcgtcggtggcgcactcgaagctggcgtagcagtggccgtcctccggcgtgacgtgcacggtggcgtagcgcgcgccgtcgagcgcgttcatggagtagccgcacggcgcgaacgcgtaggcgcacaccagggagcgcgggtcattctcgtccaccacgccgccgatccccgacgccgccgtcatctcgtcgccgatggcgtggctggtccggccgtcgccggggcgctggtagaaccgcgcggccatgccgcggtccagctccgtcatgcacacctccgccgtgagccgcgccgcgccatccgcgtcggatgacgacgccgacgacgacgccgagtagacgtgccacctgtgcgaggcgccgggcgacgacgacgacgacgacggcatcacggcggagcggcggaagcggaggagctcacgggggagggcggcgtcgaggtacgccacctcgtcggcaaagtgggcgtgcgggaacggctgcgcctccgggaacaggtactcgccgcgggagtacctgcacgaccggagccggagccggagcgcggcggcggcgcggagcagcacgggcacggcgcggagcagcggcgtggtgccgcacgtcttgagcaccacccgccccgggtacacgaacatgctcgactcggacagcacgtacgcgtccgccgccgcgttccccgctgccgacaccacggcgcactgcgccgcgtcgagcacctcccgcagcgcctccgccggcagcaaccggagcccatgccgcgccacctcgccgccgctcgccgggagctcgaacaccagctccagccgcttctcgaagccctcaaacccgcaagaagccattgataacgatggtgcgccttcgtgatcgatcgagagcgtgaggagcaacgcggttcaatttatagacgatgcagatcaagctggtgccaagaagtggcgggaggttgatgacgatcgatcgatccgaggaagaagaagaagaagaaatgtaagtggtgatggtggtgatcgatcgagttgagttgagaggcggcatgcgcgcatgcatgaggatgagggggaggcaatggtaatgattgtgagcattatggggaggggagaggaggatcttggtgattaatgaacaacgttaatggtggaagtggtggcagtggggatttcgaatgagatttttctttttaacgattagcactagacaacacgactatgagaaatacccaagggtcatctggctagctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgagccgcgccgccgccatcctggcatgccgcgcggtttcaggcagcggcgaggtgggggagaaagatggagggtggcggcggtgtcgggaaactagggtttcgccccccgtgttgtccgcgcatgcacgatgcccgggggtggggtggactgccttcaattgaaaaactctagtgggaatgagatcaaattcaacttatacaagttaaaaaatttagctgtgaacatacatacacattaactagttatggtttaatttcttgtttttgctacagtttgtatgtataagttgaattttaatatgcatttttgtaaagtgatatatcacgcattagtctatcttattattattattttatatgaagacatttgaaacaaagtattgaattctatgttatcttttgcaattcctttggaatggaaaatcctatagacattttggaggaaatttagtaaggaatccaacctattggaaattttcctctgagtctatctctcttatccgattcctgcatttttcctgcggtccaatcaaagctattccgtgtttttcctatattttacaatcctctattttacacttacatttatattagaatcgtttgtttttcatgttcctgtattttttgcattcctatgatttaaagggatcctaagtaattttagtcctcgtatatagtagcgacaaaataaaaacactaaatttttatgtctttcctagttagactggataaacttgtatagtcggtcaaggattatccataggttgaccggtccgtgcggtgcctatatccttgataaagcagctttatatataggatcaaattgtgatgctcgaagacgacaaaatgaagttgacagtgaacctcgcaataatattaagaaatgacctgcgcatattatgcagacatgcagtccccttcctctctgcgtgatcatgaatcggcgcacggtttaagttaataacaacgaagcaaacaaaacaagattaatttgcaaccccattggattatgatacaattcaatgtactccttttggcctgcatgcaatgagtgggccgacacttggagtagtgtgcatatgctgccaacaccaacaattgaaatcttcctcgatcgttgcgggtcctgtttgacttatttttatatccaagattttgtgtactcaaatacgttctttgttttatactccattcgtttcacaatgtaattctttctagcattgcccacattcttttagatatagattcattaacatctatatgtatgtgggcaatgctagaaagtcttacattgtgaaacggataaaatagtataatttggtttcactttttctaaataagtttcattgaaaaatgtagcaatatttataacaccaaattagttttattgaaattaatattgaatacattttggtatgtttgttttatgtcaaaagtattaatatgttttttttataaatttgatcaaacttgaaaaaaataaacttaagaaaaagtcaaagcaatttataatatgaaatagagatacatagtgcatgaatttgaatttgtgattaagttgataatgtctggataaattatttcagacaaaatataaaattttaaaacactataatttaacatataaaattcaaaatcagtgtggatatagctgagccaaacatgaccttaattaacaacttccaatggatcaactcgttagctaagctagtgctatgcacagcacttttgggttaattcgtgatcgccatggccaacctgcaggctaaactagctaatgatcgagcgagagcatgcatgcacggaagtatgatggaacccgccgacttgcaaataattaaacacactcatgtttgactagagaattgtcgtgctctgttttgtttgaatccagcttaattacgtgcaggaacttgaattttttcccccgaaatttaaggcggatatagccgtctaaatatcgtatattactagcgtgtgtgaattatgtaatttgcatttctgttccggtgtatgaaaagggaatggctaaatttaagataatttcagtcaccttcaatctagtattggtattgggaagggaggagaggtgaaactccccactaatagtaatgacgccaaaactccgacgacatttagatttgggaaggtgactccctggcaggggcggatctatagtaccatggccagtgtcaggcgacaccgacaactttcggcagaacctatagtaaaactgtttatccatatgttataacaccgatagatacgtcatgacaccaacaaattgattttttgaatctgccactgctccctggcagtggtagtatagctagcaataagaaggttctcttttccgaagatggtaataacgtcaaaactccggcagaaaaatctgagattaggttttatggtaagagtccaaatgggagcggaggcaagggaattgagccggtttcctcaagcttaaagggatggccttatgcaatgggcccagggtagaggaggatacggagatatcaccacctgggtgtgtttggacctctaggttcccaacccaaatctctcgtttttcgcgcccacgtttttcaaactgctaaacggtacgtttttttgcaaaaagtttctatacgaaagttgctaaaaaaatcaaattaatccatttttgaaaaaagaaattagctaatacttaattaatcacgtgctaatagatcgctccgttttccgtgcggaggcactatgttcccatcatccactcgcgaacaccagaggtgacggcaacatatcgactacatgcgtgagcacggagaagaggtgactctgaaaaacttagacagacagtcccttaataaaattcatggtccgttccccattaatctctatagctagctgtaaattatctgcaggaagcaatattgtgtcggtggcatgtggcagcgtgactgtcatatgtaaatcatcctcgtacatcgcacaggcgcaacagacgttggtagagggattctaatcattcgagtaggtgctaaaaagagtatccaaaaaggaaaaaaggcaagcaagtagagacaacatatagctagcccggtacaacatgatcatgcaatgtctggtaccctaagactgtactgttgtcattaaccaacttaatttgcatctctacaatgtagatacaatgctcatcgatcgatcggaagggtccaaagattttgtcagcagatctggagcagcagcttgagtggaagtgtctatctctgatttgctgtaattagagaaacaggtgcaaagaccggtcgacatgccttgcagcgcagatcgatgattgtatgcaatcctcatgtcgggaacacatacgaacaggccggcaggccctagctagcaaaatcatgggtttttacactagatcatgtgtgcttcaccctgtactgttctaaaataattcagctttttatatcaatctaaacacaatctatattgaaattcgatcatcgtatcaaatgaaaagtaatatttagtttagattgtaaagacatattggtagccatagctctcccatgatatattgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcatcaccaacaacttcggcaagatctctctcctagactcggagtcaaaccagtcgggagagaaccggatttcggtcccgttcgaattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtctccaccacgacagcgtcttcatcccgtaggcctaggcggaagtcggccttaacaccgatttcgcctagcttcagggaagtcggcgtcatcctccaaccactcggcacggtttcgacggatcagctagatgactacaacagctctcccaccgtcgactcacgtcctactgacatcgtggagtacgacgaatttagttctcgctacaacgacttcaacgacttcgacgacttcgacggaagcctagatgacaactatacccctctctactttggcgttttcatggccaataatgagacggaggagcaacgccaagcccgggagaccgaagaacgtcgccgactggaggaggagcatcaggcacaagaacaagaacggctacggcgtgagcagcaggaccgtgagcggaccgcgaaggaggctgaggatcgacgtcagcgagctttggaagcagggcgccgagcgcgtgatctcatcggccaacaagatgtcgaagggacaccggttttccgcacccctcaacagaatgcggtcgccgcgatcacccttctcgacaccctactcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcacgactaccgtcatccaagcctcagcatcaccggcgcgggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggatcgccgcgatgacgaccttgacggagttgcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaagttcgggcgcaagcctcccaggacagtcaagctcatgtttgaaaaagccaacgagtacgccaaagctgaagacgctgtcaccgcatcaaagcagtcgggtccgagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcatctacaagcaattcgcggatcaatacaccaagactgcacggaagaattctgacgaagaacaaagcacgtcaaggaagaaggacgacggtgacaccccggcaggttttcaagatcaccgcaaggagctcaaccatatctttggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagaccttggatgatatgcagattcctcgctccgagctaaaaccaagcaatgcgccttttcacggagtaattccaggattatccgcaactccactcggccagatcaccctcccagtcacttttggcactcgggaaaatttccgcacagagaacatcagctttgaagtcgccaatttcgagacagcataccatgccatactcggacgcccggcgttagccaagttcatggccgtcccgcactacacttacatgatgatgaagatgtctggtccccgtggagtcctatccctacggagcgacatcaagcaagccgtcacatgcgacaaggagagttgcgacatggcccaaactcgcgagatggcgtctgcccgagaggatatccgactggctgcagccacggcgagcgaaggagaaatacctgccaccaagacttcaaaaagtggagaaagcgaagccaagactaaaaagattcccctagatccctctgatcctactaaaaccgctgtaataggcgccgagttagattgtaaataggaaagcgcgctcatcacctttcttcagaataataaagatatctttgcgtggaaaccttcggatgtgcccggtatccctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgtcgattataccgacctcaacaagtcttgtcccaaagatccctttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttctcaacgcagatcggtcgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgacttccagtggggacccgaagcacagaaggccttcgaagatttcaaaaaactcctcaccgagccaccagtcttagcctcaccacacccgcaggagccgttgttgctgtatgtatcagccacctcccaggttgtgagcactgtcttggtcgttgagcgcgaggaagaaggccatgtccagaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggttacatcatttccactcggtgatatactgcacaaccgcaaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagccggagtggttttgatttccccaactggagaaagattgagctatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcttgccttgacgacaacatgatggcatatcgacaagaggtacgcaaattggaagacaaatttgatggactcgagctcagtcacgttcttcgacacaacaatgaagccgccgacagacttgccaattttggatccaagcgtgaggcggcgccctcagatgttttcgtcgaacacctttatacaccgaccgtacctcataaagatactactcaagatgcggacactcatgacgtagctatggttgaagccgactggcgagagcccctcatacgatttttaacttctcaagaactcccccaagacaaagatgaagccgagcggatttcaaggcggagcaaactttatgttttgcatgaagccgagttatacaagaaaagcccttcaggaattctgcaacgctgcgtatctttagaggaagggagacaattgctaaaagacatacattctgggatatgcggaaaccatgctgctgcacgcaccattgtcggcaaagcttaccggcagggttttttctggcctactgcagtgtccgacgccgacaaaattgtgcgcacgtgcgaaggttgccaatttttcgccagacaaattcatctaccagctcaagagttgcaaacaatcccgctgtcttggccgtttgcggtttgggggctcgacatggttggcccgtttaaaaaggcagtcggcggttacacgcatctctttgtggccattgataaattctccaagtggatcgaagctaaaccggttgtcacaatcacagcggacaatgctcgagacttcttcatcagcattgtgcatagatttggagtgcccaatcggatcatcaccgataatggcacacaattcactggcggagtttttaaagacttttgtgaagactttggaattaagatttgctacgcttcagtggcacaccccatgagcaatggacaggtggagcgagccaatggcatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgggtggatgacttgcaccgattagaagaagcccgcgaagcagctttgattcagtcggctcgatatttacaagggttgcggcgctatcataatcgcaacgttcgatctcgtgcctttttagtcggtgacctggttttgaggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcggcgtttctacgcttaagtttatcattgtacttccctatcttgactgtcaacatcaagttttcttcttgccgttgtcagtcgggggctattatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtatagtacaaattatgcctccatttgttacaatcatgctcagtcagaatcagtcctttcatcatcagagttattgttactcggctgaaggtcattgttgcggaattgatctaccacatcgcttgcaatcttgtcagccgcattttgagcattgttgataagatcaagagcagcttcttcgcttgtcccatctgcaaatccatcaatggtgtcgatttcaattcttgggtacaaggatttggtcatcgctaatgccatgctagctcccatgcttccagctttcttgatgttcttgaagtatacatccggtgcaactcttaacttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgcgatttgattttacggtctacaaaatacatttataataagaatctgctgcattaaagagaggacagttcaaattgtcagttggcagtaccttcaacctccttcaaggctgagtccctttccgcagccagttctaccttgtctcttttcaaggcttcaatctgtttctccatctgggccattctggtggcttgcgctgtttgaaatccaaatgtttgaggatccagctatgacagtataaatgggacagatctagagattaccttttgatgaaccactcagctcgaagttggagtcctggagctgtgcaattcgttcccttaattccttctccgttttcttggcatactccttggcctcgtgtagctgttccctaacggcttcaagagttcccaaatgtggaaccagcttttctaaggttgcagtcttggcctcattacgaagatggattctctgcacggtggttcatggattagttttgctaacaagaaaacaaagttattaaaggcagtcacccggaagatttacattcacaatgcgagtggcttctccaagtgctttcttcagctggcacacttcctcatcttctttttggcgatttataacaatgccggaaacttgagagttctcgtcccaccatttgagtaagatagggggacgggagtcatcagccgcctttatgcgaggaattgtttcttcgtcatcgcctagtgttcctgatgtatttccaagacattagacgagtaagctggagttattcagaacgatatcacttgagaagatgagttacctgaggatgtgcctggctgagcgcgagatgatccttgttctttatctggagagccaaccaccgagtcatttccagcctttggtccttgagaagatgtcgcttgcgcttcaacttcagggatttcttgatcaggacctacatccgactggtttccagttgggggctctcgggttgttgcagtttcagttgttgccgactggtttccagtcgacggctggtcactcggattggccttgtcatccgaagcatgggcgccagtcggctggctttcggcagtcggctggctttcagcagtcggctcagcgtctttggataaatttggttctgtcactgccggatcaggatcttttccagttggatctatgtcggacggtttcctgcgaagtatcctttcgatattcagcgtaatttctatgagagaagcatatcaaagggagttggtgccgagaggtttatacctggacgacgttctaatctttggcgtttgacggccagccagttttttcctgggcatggtatgcttcgggagtttgttgggcgtgcccttgtccccagatttgttgctgtcgtcgccctcgtcgtcatcaagcaccagctttctcttgcgaggacctgtctgcccagccggtttggaggtttgaggttgtgggtctgacctgattgtcggccctccacttccctgaatggtgtgctggcgaggagatcgtcgctgagcaattgggggatcggatttcatcaatacatattcctgaataagatgcctccatggttagttaattcaacatgaagacaagatactattttggtcataagttgaagatttcagatacatacctgcggaggcggattgaatgcattatatggcacaactggcagctggtgtgagtagctaacgacaatggcatttgagaagattttatacattctctccttcatgattttgaaatccagagagtcaggttcttcacggttaggatcatgcttgccgtcgaactcaaaagctgtacgggatctttctttaattggcgccagtcggcatttgatgaaatgccgagtaatctgctctccttgcaaaccttgttctttgagttttaacatgcggtccatcaactccaaggcttggactgcttcatctccgattggaagggagttccaggtatcttggtacaccggaggaagacaagagtacccgggaagagcaggctcaggattctgaacgtagaaccagtttgcatgccaccctttgtttgaagtcttgaagggcatagagaaatatttttggctcagagttccccttagctggaatcctgcccccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccatagaagaaatgcgagaagactacgatctcatgtgtatcaggggtcggaaaagcctcaccgcacgctggccgccacccgatgatctccttggctgggagaacgccgtgcgccaccatctccttcaagttctcttccgttacgtcggatggcgcccattggccttcaaagctttctttctcctccgccatcgattttacccgaatgcgctgatttgatttgatggatggcttgggagaggtgaggaattgaggcggtggatcacgggaaggatttttaatcacttttcgaaggtggatttggacggattgatgaaccctagttcgccggcgcagctatttactgtagcaaggagtggggaaaatggcgagcgttccggcggggaagacgaagcgtcgcttggatctcggattttttgttaagggtatcggaggtgcaagtgggcctaggcctgaacagtacctcagcccaatacttttaacagcgtggcccattgtgttccttagggacttaggcatattttgctttggcaatatttatgcacacaatagtgttgcccaatgctgacaaaatcctttttatgcggtcatataattctttggagttattgcaatgcaaattaaaaggtgccctgcagaaaagcgttatgctgtttttgtaagcttttttaggctacaaaagctgtttgggttaacttggaatgacttgtttttatcatagtcatttccttggtatgttatatacctatttttattgtggtaacttgacatagcctaggctattagtctttttgttaccataatttttataatatttggtgggtaatctttatagttttatattcggatgcctgtccagtgtgttcattcgtgaaccttttcgagtgtaaaccactcggattctttttattatggctaaaaagcagtcggctagaatgcctctttaggcgccgcgtatgcttttgccatctaatgcatgattgtgttattatattgttctcaactatatgtttagtttgttaactaatcacatagttgggggctacacctaattaggtgcatctattcgatgcaccatattctttatcttttcgccctttacagtcttcgtcttcgctactcggtgggccttggcatgaataatctgaagcactcggattgctatctttgagaaggctacgatggttgactgcaaaggtctcgggggctactgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacatatatggagtataacaaattctcacctattacctcttatcttaaccaatcataactatctcattttatttcttcatctacattttcatccgggacatctacatttttatcacaattaatcacaaccatttcttgtttaattcttgagacagaggggaactctaccatttttaagcagtgctgctataattatgtcgacacatttttttagtaaccacagtcgattttctgatcaattgatctccgttgagattggtgctacgattgaaataccaatgcactgacgtctttgcgtattgcagcgtgaagccaaacaattaaatttaattcctcatctcatcggcatgtattttcatgaaaaaaaacatattgtagggacttacatacatgctaactatttttttttcgtgaaaaaatatggtggtataaatatcggtaatccctttttaagttttttttggacgaacctccacctccccgctaatagtccgcacgtgggtccaccacaactccacaagcctgttatggcccacccaaaacaggcagcacgtccattaagccaccgtttcggcccaacaatacatgggccgcacatcgcttcaattccgttccgggccaaaccacaaacgggccacacatctgtttatttttttcccactaatttattaagatcaacttcgattcccaactacaagagatcaaaccggtcgaaatgatgaattagagctttctcgccggcgcccagccgtgccgccgccgtcgtcggcgccgtcgagctcccgcgcaggaaccccaggaggagcttgctgctggcctccacgtcggaattatagcaccttgatcgtttgacactgcatcccccatcttcttctttgtcgatctgtcgctcgatcttggcaagaaatccaagactacaactctacaagcaaattgagacttgctgtccatttacaggacaagagagctactcagtatatatctagccacagccatgcctccctaaccttccatgtccatgcagcagtccattagctaatgtttaattatattttaggttgatttattttgagacgttgagtggcagataaggcaggcaggcaggcatgcgtgtgcaaccgtttgcagcggcctttgtttcctattgagctttgcagaaaatgaaccggtttgtctattgctaacagatatatgcatggaaatttttgtggagcgattagatggagaagatgacgctaattaaaggggaaaattaacccgtgcgttcttgcggttgtgcgtcatgtgactgtctcgatctcggcgtcacatatcaaccaacaaaggcagtttgttcttgattctcatttctgaagacatgcgtcactgttccagactatctcgggctcatcttgattgtaacctcgatataatttggatgaaatggtttacttcaatttgcccccaacagcaagtatataagtttcaagaaagaagtctcgtctgaattctgaaaacggggacagtaacatcccatggaaattaaaagctattcatgaaatatgcatgcgagtttctaccttactaaaccaaaaggtaacaactttttacgattcttcgaaagttcaggttaattatgagttggaagttagaacaagaaaatagtcctagtttaaattctgaattacgatccttcaatagcttaatcctttcatcttgtcttatcctagcttaagctctgaattggggaagaacctgttatccgaacaaggtcttcaaaaaatgggaccaatctagaaaggattaaattgattttgaattaaggagggggtgaggccgtgaggctagctcgaacctggagtggtctagctcgcagcttgcgttactagccaggaagaccctgggcctttctctatccaaaccagggttttaaatttcgaaatcaacatttctgccgcaggtgagcgatagaaccgaaattttcaaaatttcggaaaaatttcgtacgaagttttttgaattttcgaaagattttgaataaatttgacaaaattcacaaaaaaaaatgcaaaaaaccgaaattttcgggcaagatgttagcatttcggtggggcgaaatttcgaaccgaaatttcaatccctgatccgaacaaggtcttgaaaacccctcaaaactcaacgaagcagtagatgattcatgcatatgagactaataaaaaaaatactcaaatataatgaaattatttagtccataaataatcatcatcacgtcgtcctaagtaggacaaataattaatacatgcaccgccatctataaagttcatcatcagttctacctggatcatgataacatggctatatatcacataattaagtagatattaaataattaagctccttatttgcagtggcggcatatacggcgagtggatcgatcgatcagaagagtttcccatcacggccggccgccgtcgccggcggcgagccggccggctgccggaaggacttggtctggttgaacaaccttgccctggtcatcttgatgaacctgtcagccttcttgttgatgtcctctttgatgctgtcgatcttcctgaaggtcggcttgggtgccaggttgtggtacaccttctgcaccgccacctcgccggcaccgccgccgccgatgccgccggcggcggcggcggtggccggagcagcagtactgcctcctcctcctgctcctcccttgcggatgatcttctggctctgccaccagctcatcttaatttgctctctaagctaagctactagctgttcttgcacttgcactaaactaatgttatttagctagctagattgctttgggatttttttgcttcttgttttttcttggcttgctttggttggattggatttgcacctagcaaatgggcgtcctttttatagccaatataatattctatattccttttgcattaaggctgcatatatgtgaaatgtcaggctttctcattgagttatttacttttttaatttcctccgaatatattggcctaacctaaccagggtcagggtgcgtgcttgtcaatcataattaagcatcaagacggtcatcaagctctgaagttatcaattttgtgtcacaaatgttttcaataaaattgtttaagacatacgaataactgatggcttttcaaaagaagtaaaaaaaatgactaacaatataaccttttattttccaggttttgatgtaggggtggataacgagccagcttagctcgtttgatctcattatcttaattaactagcatggtggcccacgcagattgcgcggctagcatcattatgttttctcccatataatagcatatatgttttctcattatattattcaaatatattaaaatgacaacataattttaaattttgcaataactttacaaaactactaatacgtaatattcatattatattttatatacgtgttagttattaattatttttaatatcaaattttagttatttgtaaattatatatatttctatatggactctagactcgtgttttaatatttcttttttttaattccgaattttctgtaaattgtatttctatatagactctatgctcttcttccaatattatttatttttatttctgaatttttattatttctaattgtatttctatctggactctaaactcatctttcaatattctttaatttttaatttcgaatttcagttacttctaaattgtattcctatagtgactttaaactcttcttcccatgtttttcttaatttcaaattttagttatttataaattgtatttttatactgactctaaactctacttttaattttattaaattttattatgtttattccaaattttagttagttttaaattcctatatggactctatactcaacttctaatattccttatttttttatttcgaatttctatttttttttcttcattgaatttctatatggactctatactctacttctaatattccttatttttaattccaaatttcagtatatggactctatactctacttctaatattccttattttgaattccgaatttcagttatttcataattgtatttctatatggactctatactctacttctaatattccttatttttaattccgaatttcagttatttcctaattgtatttctatatggactatatactctacttctaatattctttatttttaattccgaatttcagttatttatttcctaattgtatttctatatatggactctaatctcatcttctaatattccttattttttaattccgaatttcaactatttctaaattgtatttctatatggactctagtctcatcttctaagattccatattttttaattccgaatttcagctatttctaaattgtatttctatatggactctgtcttttctttttccctaattaatgtgagaatttatagaccatgagagcaaacatggaggcttctttttctattcctttaataatataatagatgagcctgcttggctcgacttgctaatgttaacaagctaaaaggttagcttgctcattaaaattataagtttgagccaattcgagccaagcattttgtcacgagctaatccaagccacgagttttgagttttttgttcacccttattttttatgtgtgcaagtcattttaaccgagagcttgaagaaacatgtaacactagctcctaatttggagttgaagttgtcagggttaacaatatctccttttcaaggtcaattaattgtcagttactccctccaattcatgttttcatgttgcaagttatgttagttttttttattatgaaaattggtttatatatatcttcggtttctataccaatatatattcaaatttgtttcgtgaaagaaaaaacagtatcaactgacgggacaagtcctcagctcctcttgaaaaatgatcgtctgaatgagatgttaaagacaaataatatagattctaacgaataattccgtaggtattatatcattatattcaaagcaagaaaaacccttaaataccaattccaaaaatatagcaccgctgtgcgtaccatccgctcctcccgtggtattatcaaagacgataactttttgtagaataagccagtttttaacataaaaagtttatcatttcgacaacatcaaatcaactaatgtagtacactggccctaaataaaaccaattttatttacatgggcattctcataagctaatttctaaaaatattttagttttgttctatatatgctatttttcaactttatgcattgaccgagtttatgaaaaatgcacgacaacaactaccatactaaattagttttgtcaaatccatcataaaatttatcttaatactaaatttatttataatctcagttaaacttatagttgttagacttaggaaaagaataaaatgtgcatgaaacgaagggattattttcgatgggcatattctaaggaagctggcgctagctgcgacaatcatcggcgccgttagtcgcagcacacggcattccatcgccatctcatcacctcatcgatgattccattggcatgcattcatacaggggcgtgatgctagtttcgtacttaagatcctgcaactaattaaccttaagctttagttccaccgttaatgccaatttccagttgggggttaaagctaggaaacgtgaaaaaaaatgagcacatttttggttcagcccagcattactcacttatctgactattgctaagcagttttggaatatcaaacgcccagatgataatcttaaagtggccaatttatcttcttttgtaatcagtttcgctacagcacctgctgctctagctaattgttcatcctttccacgtgtggtttctatattatatatggccgtgcctctcttcaatcatcatgattcatgaatatttggtgattgggtggataagatttggtcaaacttttggtacaaatattcggtcaaacttttggtaaaaaaattcaatcgaacttaattgcggtgattaattttgtggggaagttagttataaacttaaaaaattatgatagtatgatagtatgatagtattattcaagacagatttttcttttagaaaaaaacaacgtggtatgatctttgataaactaagcattcgagaaattcttgatatatttagatttttaaattgtactacttttctaagtcgtatataaggcggatctagggaagcccaaggcccagctaattaagtttctttaggtcaatttctatacatatatatattgtatattggcatgttatatatatttgtggtatttaaaaagtttatttaaattggaccaccatacttacttcctccttttcacgatgtaaatcattctagcatttcctgtgaaacagagggagtacaaatttggatacatacgccaaccgtcatataaagaaaaatggagggaataaatatttattatcagagggagtaagtttttttcttaacttaattgatcacctctgagtctcctactttaaagtttcctacgttatatattgtatatgcccaatgtttatttcatcgtgcatgcacaccgtaagcaaaagtagcaagcttaattttttttagataatggaataaaacatcccggcctttgctcatcagagctatagccaattattacaaaagtaacacccaaacactgagtgtagttcaaatgaattaaacacacccaacaaaataaaaaattaaactaagataaggagagcacatttattcaagtctatttgtgaatctccatccataatttgcaaagagttgcatgaccgttgtctcaagcctacgacatgtaaccttcgtaagctctcgatcatcttcacacatttgcagctgtgcccaaaatcggagccaatatatgagatagatggtgatttgtcaaaaaccatatcattcctagtcaaccacagagcccaacatatgatagaagctcctacaagtatgagtttactcttcttcttgtctaccccaaaacccaaccatcaaacatattagatatggtagtaggaaggtatagaccaagagagaactgtactgctctccaaacaaattttgcataatgacactctataaaaagatgttaaatagtctcatttttcataaaaaacatcttaaactgccattccaattttgtcttgccaaattatccttggttagcacaaccccttgaaacaagtaccacataaaaatcttaatctcaagtggcatcttaagcttccaaataatcttgtttctctcaatataactattattaattaaaactagatacatcgacctaacagaaaatattccattctgatgataattccatctaaagctatcagagaattgattcaattgaatatgtacaatagaagcacacaattcatgccaatatgcaagattctgatcaactaaatgatctcctaaaggaaacattaattgagtcgaacagatctcataacatcagcaatagtagaacttttccttcggacaatagagtataaagatggacaatagtagcaagcttaattatggattaataattaacctgttctactaccgaattagttcggcatgtggaatccattacagatcactaattaggcacgtttgtaggaatccaaatggatcatgacggcgacatgtgtatagcgcaagagactgtatatcgccatgcgtgtggccatccaagctctgagctatactgttaactatcactatacatagaatctgccaaatatgacgtcttatcggtaacgattagataagatttgcactggacggacaaaaactgatactgtgatgaccccgtatcaatgccggttcaagtgaccaaccgacactgatgtattcattatgattttttacatgaactggcatggaactaatatcaatgctggttttataattaaccgacaccaaaaacagagttaagccggctgtggtttcagtcgatctcgccctgctctccttcctcactctcttacttttccctcttctcttccacctcttcctctttgtagcgagcggcggccatctttccttgtctaatgatggctatctccctctctcctgtgatggcgcccctcccctcttcatggcgatcagtgacaccgtccttaacatagggatggcaacggggcggggcggggccggattgagttggaacgaccctgcatccactcctttgcgcgtctactcggccctagcctcggactggtggccgggtcaaaaatgagccccgtccccatccctccagggcccgtcactcgaccgggggcccattgcacccgtaggcaaggatgctcgacgcagcgacggtaagaagcagtatgtggaggcgccaccgtgtgccagcaggaggaggcggcgtagccaggctaaggctgatcaacgacagacggaggtggtgcgacgacgggcggaggcagagctgagacggcgacgagcggaggtggtgtggtgacaggcggagctggaggcggcgggtcaaggcagcgtgacgacaggccgaggaggagcggaaacatcagcgacaca

SEQ ID NO: 74880 - DNA, 2478 bp, Oryza sativa
ttggaaaaatgtcttaactccctcctttcacttgcctttagatgccgcgctacaagcctgagtacttgtttggtgttgagggatttgtccaagagttgcgtacgatgtcctttgccataggatttgggactgcccctttttatgcccagattcctcatgatcgtcacgaagaaaagtgccgagtcaaagtcaccttgaacagtaatagtgaagatatcccctcagagatgttcgaagctggaggaagaaactacatccatgcatgtcaggaggtggcaaggatcgccataggggagctccgcgatagctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactatgttagcagttcaagatcgtgaagatcggaatcgtggtaagatttgcaagctagaggacaaggtggatcgtttggagaaggaactagccgcgttgaagggagaagcaccaccgcagaaggccaggattcgtcttaccgcaaggaagagagctctatttgtccctcgctaccaattggcgccaaaggtccgtgtggtggaaaaagaagttaccccagccctagcggatcctccggtcgttaacgtaagtgatgatgaagaagaagaatccaagcacgcccattccaagatcgagtggggagcaactcaagatgatgaagacgaaccgaacgaaccttcaatcaactccgatgcccggaagaactagaatgccttgtcaagtcattgtcttagatcgttgtgttagttagtttgtttaagtttggttgtgtgtgtctcgcatgtgatttacatcagtggtgggatgtaagtgcatgcgtttgtttgctttcgagtgttaggtggttggtaagtttagtggtgtgagagtcttcagttttgtattaatgaaacacacttaagatcaataaaagttaaattaattctctgtcctaagtagttttccccggtttctcttcttgtgcttctgcccatgccagatggtgctcactcgcagcaacgggaatggccccaacaacaacaataacaacaacaatggagagaatcccacacttgcccaagtcctggctcaacaggcacagcttatgaacatgatgatgcagcaactccagaaccagcagaaccagctcaaccaaggaaacaacaatgctccgccgccgcagaacaagttagcagaatttcttcgtgtgaggccgcctattttctctagcaccactaatcctgttgaagctggtgattagctgcatgccatagagaagaagttggatttgctccagtgcactgatcaggagaaggtctcatttgcatcacaccagctgcatggcccagcctctgaatggtgggatcacttccgccttaataggactactgctgaacctatcacttggcttgagttcaccgctgctttccggaagacacatataccatcgggagtggtgtttctcaagaagaaggaattcaggtcgctcacccagggatctcgctctgtcaccgagtatctgcacgagttcaatcgtctggctcgttatgctccagaagatgttcgcaatgatgaagagcgccaggagaagttcttggaaggacttaatgatgagctttcttaccccctcatgactggagattatcctgatttccagaagttggtggataaggctattcgtcaggaggacaagtacaatcgcatggaacaaaagaaacgccggattgctcacttcaaggcacaacaggggaatagtctttaggaccccagtccatgccacagggaggttcttcgtctgttgttcgtccgcagcgtcagttcttcaacaacaatgctggcaacaacatccgtaatcaagctccacgccctgttgcagcttcgacacagcaacaacctgccaagaaggagcaaggcagcaagcccgtagtgtgtttcaactgtggagacccaggacattatgctgacaagtgtccgaagccccgacgcgtgaaagttgtccctgcccagagcaactctaccgcaccagcatccaaggctcgtgtcaatcatgttgctgctgcagaagctaaagatgctccagatgtgattttgggtacgttctttgttaactcagttcctgcaacagtgcttttcgattctggtgctacacattcattattatctatgagttttgcgggaaatcatgggatggaagtagaagatcttagacgtcctttgatggttagtaccccaagtaatcaagcactctctttgcaacgtagcccctctgtcagaatagaaattcaagaagtaccatttctggccaatcttattctgttagaatcctagggatggactggttagccagatataaaggtgtgatagactgtgc

SEQ ID NO: 74881 - DNA, 13559 bp, Oryza sativa
atgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagtcgcccggggaaaaaatctgccccaggagggggtcgtgcttctgggccccgcgtcgggggctcggggagcagccgccctgccgacgccccggggaagaggaagctgggaggaacacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttacccattttgttcgtcttttggttttttcttctgcttcagcgatgtcccgtcgcattcctcccgccgccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaggcggcagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcttctctcgtcgccccagtgagcgccgagcccattatgcaggccttggccgccgcaaacaccgcggtgctagatggatttagcgcccaggtggaggccttgcaagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggccctcgaggcccgtgccatggcgctggaagaacatgccggcgccgtggagaggagcttgatggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggccacgacgcaacggctggcggacagcctctccctccgcgaggcggcgcaggaggagcaggcgcgccgcaaccttgaaagcgtccgcgccgagagagccgcgctggagcagcgggctgctggcctcgaggcgcgggagaaggagctagacgcgagggcgcctatcagcggggcggccgcgggcgaaagcgacttagccgctcgcctcgcggctgccgaacacaccgtcgctgacatgcagcgcgcgctggactcctccaccggggaggccgaggcccttcgcttggcgggcgagatcgggcccgacatgctctgggatgcggtctcccgcatgaagcgcgccggtcggcaagcgggcctctggggaggccagacgtcggtgccccccaccaatctggaaggcctcgctccgcacctcaacaggatggcttgggttctcgagcgactccccgaggagcttgagaagaccatcaaggcatcctcgagggacctcgcccggggggcggttgaactcgtgctggcgagttaccaggcccgggatcccaacttctccccctggatggcgctggaggagttccctcccgggaccgaggacgacgcgcgcgcgcgggtcggggacgctgccgaccacatcgtcaacagcttcgagggctcggcccctcggctcgcgttcgcccccagctccgacgaggagggcgacgccagcagcgaggacggcggtggcgacgaggccggcgacccgggcgcatatgaatgagcccccaggcccccgccactcttatcttttttcttgttctttcttctaaggccttcatgcctcttttttgtacaatctaacttaatctgcaatgagaaatgatgaaaaatttttgtgttagttttattttgctatatatatgagttgaggatgatctgtgccatggtccttttgcgccttagcttgaaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccctgcacacccgagggggggtgcggggttagcccgagccaaaacctgacacccgacccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacactctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgaactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcctgggtcgagtcagcacagggttagcctcggggccaaagggctttaagtgcagccttccctcagtggccttggggccttcctgagggtcgggggcacccagcaccgtttgacaagcgggtggagggccgactccggtcgtcgggggccttaggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctgagatacgccttcaactgggcgagggcattttcagcttcctccgtccaagtgaacggccctgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcatttatgtataacaataggttcctacgggggtaatgaacgcagttttttcctcatcctccctagccatgcgaatctgatggtaaccagagtatgcatctagaaaacacaaaaggtcgcactccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccaccacatcgaagctcacccgctccgtgcggaagttggcgggtccaccgaaggtgaccggtaggtcgatgtgacctaacggccacgtgtgccccggcgtcacaccgatgatcggttgtgacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggtcagaagctctcgcttcatagccttgaagctccggcgagagacgtgagcacatgctcctccatcgacggtggcaatggtggctccaggttcttggaaacctagatcatcatcaccatcatcaatgtcaacagcgggggccttcttcttggcctcacttcgccgtttgtcggaaggaaccgccggggacttgccgtcacggcgttcctgcctcctgtcctcctcccacttcctcgttcgctcagccaagtttttgactgcacgacagtccgcgagatcgtggagggaggtgttgtggacggagcaccacctgccggcggggcgctccctgccgggagtaccagcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggagcatggctgtgcgctgacgatatggtcagtgtcagaccggtcgcaaatcggtcattcttgtccaccgcgtgtaatcttggcaacgtgcatgtttgcccttcttcacacaacattttgcttgtaatggttaggatgaagcctggcatatatcgatcggggctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcgtgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaggggcagagcaacagaaggctttggatattattaaggaatatcttagctctcctccagttttgatttctccacaaaaggggatacatttagattatatctatcggccggtgagaagtcaatcggttcagtcttgattcaggagcttgacgggaaagaaaaagttgtattttacctaagtcgtcggctcttggatgcagaaacaagatattctcctgtggaaaagttgtgcttgtacttatatttttttgtacaaggttaaggcattacctattgcccaatgaatgcactgtgatatgcaaggccgatgtggtcaagtacatgttatcggctccgattttgaaaggaaggattggaaagtggatattttccttaacggaatttgatcttcggtatgaatcaccgaaggcggtcaaagggcaagctatagccgattttattgttgatcatcgtgatgattcaatcggctcggttgagattgtgccatggactttgttctttgatggatcagtatgcactcatggttgtggtatcggcttagttattatttctcctcggggggcatgttttgtgtttgcctatactattaaaccttatgcaactaacaatcaagctgagtatgaggcagttttcaaagggttgcaattacttaaggaagttgaagccgatgctattgagattatgggggattctttgctagtgatcagtcagttggcatgggagtatgagtgcaaaaataatacattgatagtttacaatgagaagtgccaagagttgatgaaggaatttcggctggtgactttgaagcatgtatctcgagaacagaatattgaagctaatgatttggcccaaggggcgtcgggatataagccgatgatcaaagatgtcaaggtagaggttgccacattaacagctgatgattggagatatgatgtacatcattatttacagaatccatctcaatcggcttctcggaaattgcgctataaagctttgaagtataccttgttggatgatgagctgtattatcagacgattgatggggtgttgcttaagtgcttgagtaccgatcaggctaaggttgcaatcggtgaggtaaatgaaggaatttgtggcactcatcaatctgctcataagatgaagtggttgcttcgacgtgcaggatatttttggccgacaatgctggaggattgtttctgtcacgaccggaaataacccaacgggcgttccttacgtgcgtgcattaatccttgtcccaggaggcaaggtacaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccgt

SEQ ID NO: 74882 - DNA, 678 bp, Oryza sativa
cccatcacgtgctcatgaattatcatgttttacatgcgccagagaaaattcccaaccttctctcctaaacgcaccctagttattggggaatttaactattgccattattagatttggcaattatccaatgctcatcttaaaattgcttttatttttttccctctaaggtggtgtttttttcaactatttgtcacatttgcccatgtaacatgtcaacatggtagtccaaggtagaaactatatggaacttagtagtcagtctccccctcacatggcgacggcgacgggttcacatcctctaccataatgacactcacattacaggcactgacgtgtgggacaatagaaggatggaacccatataacaatgactataatgatagtaacattatgatagaggatctcacccgacagcgacgatgtacaacccagcactggtgacacagcagtccaactaagctcgcgcaaatcaagtgaatttttggcaggaacacacaaatcaagtaaaacacttgaatcaatgagaagaagcacaaatttcccctagttatcgcttggagggtaacccattaccacccctcctatgatgttaagggaaacacagtaggggtgtaccatccattctattggacttatatatgccgctattgaacattaacaagcgggcctcgatcgcca

SEQ ID NO: 74883 - DNA, 4132 bp, Oryza sativa
cctttaatttcgctatatgcatgtcctagctctctgtccttctctgcaggtttaagcacgagctaggcgtgagcatgaagctagattctaacattaatttagttcaactgctagttaaagacttaaaagtttgaatttctgagaccatgtcgatgtacaaaacgtattatttgagtaacttttcaaatttcatagttataaatgatggactagaagattatactgatagcttatttctcttgggtctttgacccaaaacgaacaaaaaaggataaattattaatcctttttatgtttgtaaacaaaaagatattttactgctccttgtttggacttcagagtgaaattgaagtaactagagtcatcaatgaactgattgaatgagacagatgacaataacagctttgaacaaggaccttttgtgctaaaaagtgtagagttcaatctaaacatagtattaatgactgatgcagtgtgagaaaatctttaggtaattctgctaccgggaaaagggtatatcagtaaaacgtttaggtcacaactaaattgaatggcagtttggcgccatttagatcatgaagaaatatttttagttcctagaatgatgcatgatgaatatcatgattcaacagtagtactcctatatgtctgacaaaattgactagctagcctgaaatattttctgcaaactagagttctagaaacaagtgcattctgccatccaaccagggcttaaaattttggttcttttttttttgagaatttcgggcccctataagaaccttttttttcaaaaattttaccgttttgtgaatttaataaaatttattgaaattcagtcaaaaattttcacaaaattcaaattatttttgttctgaaatattacaaaatttcgaaaattttggtcctcctggtagattgtgctcaccgaaattataaagcctgcatccaacaccacgttaattcttcttgccctttattgacgtcctaccaaccgtccaaccagccatactaaaattttcagggttttgtcacacctatatcgtagaatctgagcaaatatctcttgtaacctacaagattgggttacttagaccactttttggtgtctattttttgtcatagttggaaaagcttgcatcatggataagaaaaggcggacaaaagagagattttttctttctttctgaaaaaaaatatggaactgtagcatgccctgattccatctcaacaaattggtgcttgtcaagttaatgtatctgttcttctaaagaatacttaaaaaaatgacttaggtacgaatagtttatctaaaactacatagtacatattcacgctcaatttttctatttcctacttcaccaagacgatcacagcgatcgtactacgttattgtaatgaactgatgtactcaaattttcagcctacttgtgaactacaagtgtctgactatgtctcagtaactgatacagggaaggggatatgtgtccatttcgcttacagtatcactactggtacagtagtacttgatatgaccaaagcgtgaattgaatgacttatgttgcaaggtcataattaactagggcttcagtttgatcaatcagtatgtcatatgattaaccatttcaagctggcgagatgcattgagatgcattgcaccacgaggcttaaacacaacgatcaaaaactgacggtggtttattaattagctatatagccaaacgagcaaattaattacctctgaggagattctccagcctgttgagctcgtcgacgacgggatcaggatggccatcgaacggaagcatatccttgctgacgccatgctcgacgacctctcccaagctgcccatcgtcgctcgatcgacctcctcctgtatgtcctcctgccctgccttttgtacacctttcttgcagttttgctagctgctagcacctagcacacaagataaacccaatcagctacactctatctgtctatctatctatctatctatctatctatctacctagctagttttgtttagctagctatatatgaaagcccagttgatgttcttcttcccacctaagtggaagaaagaatgctcgcaaagatcacggctgcccccgggagctgaatacttgcagtggttgcagtgctgcacgactaagcgagagtgggtttggttggattttatggaggcgcaatgcgtggggtttcttgaggagcaccccattgctggggctcgcgagcgcgcgagaaaggaagccgacggtgcaagcagcggatggatggatggattggatggaggcgggaggagtgcggttgaagcagagacaaatggagccgcggcctcacgccggctttgctgctgctgctgctgttgcatagtccagagctggcacgagagcgacgccaaaagttaacttctgcgatatgccgatgtattttcccttggagaaaatccagtactcctgcaaaataaatatgattgtggttaaatatatgtgaaatctgagtagctaatactccctccgtagttttagattataagacgttttaactttggtcaaaatcaaactgctttaaatttaattaaatttaaagaaaaaaattagtaacattttttacccaagataaatttattataaaaatatattcaattattgatttgatgaaactaatttagaattataaatattatactataattgtttataaacttagtcaaacttgaaacagtttgactttgaccaaacagtttgaccaaagtcaaaacgtcttataacctaaaacggagggaatagctagttaattaactactgctgtatataacttaattaatggtgtggcactgtaattctcttgctaatgatcggggtcaatataatatggtcctaactctcgtcggtgtgatacaggggtaacaaaaatcttagtagtaacttactacactagtggtgatatttgtgtcctttttgtatctgtccttctcagaagttcatcgttttgttgaaaaaaaaaatatgctagcatcatgcatctagttaatgaattaattaattggttgtttggtaagacctggcagtacaggaggatatggttaattgaatgataatctcctattatgaacacgccggttttgacgaaaagaaagaaaccgtgttaaatgcaattagctgtagctggctaagctaagatgaagtgatatgaacaaggccttctcacatacactgcactgtgctgaaactgaaagcatatccattatccgtgtttcgtaaccgtcaccggtcgagggacaaactataatggtgcgtgcacactggaagggtgcaacgggccaacggcccatgctgatgttgaccatggaaggagccttcccttcgccgtctgcatcgccacaaaattactcattggatgaagtggtggcaaactagcttagcttgattagctcctatgtgtgttccaaatggcagctagctagagatggaggaagcattgcaagcattagtctttaagggtaagaagataataagaggctttgcttgattgcttctgctgtcataacacattttgaagctttcaagctactaaaaacgaatcaacctaccctctatatgacagtcttcttcagataaccaagtaactgggtactgattggtgtgtagttttttttttcctacttaaaatattgaatatcagcaatcaaaatgcttcaaatattataaatcaagtccagggtgttcaactagtttaggtggtcaaactaaaacgtgtgaatatgtgtgaggttattgtggcctgccttctctaggtagaagcttgtgttagttagaagatgacaggaggaagaggataagaagttagaaaacaagcttcctgaatggcctgatcgacaattcgacaaatatgatgttatgatgttggaagcatcgaacagttttgtgctggacggactgagactacacagttcgtttcttctcttttttttgccttttctaaaggagatgcttctggcaacttgaatgaagtattcttcttgtggaagttttaacttctcattaacatctatttttgccaaagaaaaacataaagagaagtgaaaagaggaagagcttaattattcgattattacatgtctatattttt

SEQ ID NO: 74884 - DNA, 9009 bp, Oryza sativa
ctgttcccataaaattactatcatggatgttcattatattggtaggtaaaaaaattactatcatcactacaagaaacttgttaatccgtgatggattctccgtgacggatttacggatcgtcactgacagacatactccgtgacgatattttgtttttcgtcacagatgagcccagtggatattcacagcccacaaactcgtgacggttttatcaggaccgtcacaatgtatgattttaaattcgtcatactctagttagcctagaaaaataaaaaacaatgtatgattttaaattcgtcatactctagttagcctagaaaaataaaaaaattgtagcgcaaagaaaaacaaaaaatatgattgcaagaagaatcaaaatatttgttaaatttgaacataatatttttgttgatttgttacgtgtatataatggtttgttaaatttgaacaaaataattttattaatttgttacatgtgtatgatgcataatatggcaaactaaaaaaatattgtgcgcatgcggaaaaaatcaaaatatttttgttaatttgttacatgtatatgatgatttgttaaatttgaacaaaataattttgttaatttgttacatgtatatgatgcataatatggcaaactaaaaaaatatggtgcgcatgggggaaaaatccgcagcatgtgggatttgaacccacattgagcaggaaggtaggaaatatgttaccaattgaaccacttgttgtagatgtccacttctgcacttatatatttttatttatttattattggcccagcatccctgttggcgtggcccattaatgccattcactcgagttgagttggtccaggatgttgcccacagtgtggcccagcagctggagttggcatttcgaaaatggggcccagcagccggagttggcatttcgaaaagaaaaaaagaactcgaatttgtaaaatagaagaaaaaaatgcaaccaacgagaatcgaacccatgacctactagtagaaggcgccccatcctaccactgcgctagttggtttgatgtgttattgtaggattctgtactctttttgacctgtgtatgtatggaggagtaaggtttcctcaaccgtgactcagttattcagttcgacacccagccgcaaccaatctaagacaccgccgccgccgacggcgaaatttggcaggagcggcgttgccgctgcccaccactgccgcgtcgttcagcaacgccgcctccttgcctaccgtgccatcgcgcatcaccgctgcacaccagccgaacagcgacatcaggcaccaccgccgccctacaacgccatcctgtagatctgcagcaccgccgccctccattgccgcaccaacgagcgatgccgagtgcggccatgcgtccacctggtgacaaattcagctgttgaccggactcctgaagcctcttctcccatctgcctcaacagccagccaaggtaatatcttcttcttcttcttcttcttcttcttcttcttcttcttcttcttcttcttcttcttcttcttcttcttcttcttcgatttagttggatgtagcatttgaattggtgcagcttgctcattgtggtttatctacaatgtttgattagatggatagaagttgggtgcacagcagactattttcccctgaatacattgacggcgtcaaagaatttatgagtttcattcaggggaaattcaatgagaatgttgaaattctatgcccatgtagcagatgccttaatcagaagtaccaaagacaggctgttgtgaagaagcacatactgatgaatggtatggaaactacttatactcggtggattcatcatggagagagcttagatgtcaatgttattgacgatcctattgatatgaatgaaaataatgatggttccacaactatggtgacagaggatgacaactatggtgatcgtttggaaggaattttaggagacctacagactgcagcggcacaagcaagaccggatgtagaaaatcaagttggtgctgaagaacctcgtgataaagagtcatttttgaatattgtcatgagagaggcaaagcgtcaactttatcctggttgtaccaaattttcaaggttctcatttgtggtaaggcttcttcatatgaagtcattatataggatcagcaattctgctttttctgcacacatgaagctattggctgatgctttcccagaatgcaatacactcccaaaatcatatgatgaagcaaaaggcattctaaaggaaatgggtcttggttatgaatcaatacatgtgtgctacaataattgtgtgctgttcagaaaggaatatgagaagcatgacaattgctcggtttgtggtctctcgagatggaaagatgcagaaagaaagaagattccacaaaaagtgttgcggcattttccattggcacctaggctaaagaggatgttttcgaccaaagaagcatcagaagcggcacagtggcacaagttaaagcgacagcccgttgagaataatatgagccacccagctgatggcgaggcatggcaagattttgaccgtgaatatcctggttttgcaaaggatgcaagaaaccttagacttggcctagctactgatgggttcaatcctttttcagaaaagaacacaaaatatagcatgtggcctgtgtttgttgtgccctacaacctagcaccgtgggagtgcatggaggaatcaaactttatgatggctttgcttattccaggtccgaaatcacctgggaaggactttgatgtatttttacagcctcttgtagaggatttacttgagctttgggcaggtgttgatacttatgatgctattactggcaaatcatttaaacttcgtgcagcggttttgtggtgcatccatgattacccagctttgagtactctctcagggcgtacaacaaggggctattttgcttgtctccattgtgacaagcatcctctttcatatgccttaaggagcaaaattggttattttgggcacttccgtttccttccaaaggaacatcctttgaggagaaacaatgagtttactggacttcacgaaagcaatgatccaccaggtaaattctgtacagaagagttgctggctgaattggagagagttaaagacgtcagacctgggaagccacaaggaactgggaaaaggaagcgttccaactctgaagggggtcatgtggaaatttggagccggatggttagtttatggaagttgccatattggaaaaaactaaaggtgagacataatcttgatgtgatgcacattgaaaaaaacatatgtgagaacctaattgggacaattctcaatataaagggcaagacaaaagacacagctaaagctaggcttgatttgaaagatttgggtattaaaaaggagctgcaatttagagaggatggagagatgcctcatgctagatataccttgtctactgaacagaagaaggctttttgtgcttttttacaagaggtcaagtttccagatggatttgcttccaacatctcaagatgtttaaatgctgagggaacaacggtacaggggctgaaaacacatgattgtcacattcttttgcaaagaattttgcccgctgccatgagaggatttctggacagtgatatttatgaagcaatagctgagttggggatgttttttaggaaattgtgcagcagaactcttaacaaggatgtgctggttcaaatgaagaaagaaatccctataattttggtgaagcttgagaaaattttccctccagctttctttgatgtgatggtacaccttgctatacatttacctgatgaggcattgctcaggggtcctgtgcaatatgggtggatgtacccaattgaaaggcgactatatactttgaagcgatatgtgaggaataggtcacgaccagaaggttcaattgccgaggcttatattgctgatgagtgtctgacattttgctctaaatacatggacgatgttgaaacaagatttaatcgggagccaagaaataaaggtttctccaatgaagaagcttatggtgttgatgtttttgggcatggagttaattttacttctgcacctgaatatgtatatgatgaaaatggcattgatcaaatggtgtggtttgtgctaaacaactgtgcccaagttgagtattacgtcaagtatgttctatatacttacttttagacttcttctatatgctacctttgtgttgcacactaatttatttttttttctgcagtttgttcatagaagagttagagacacaaggggtgcctaacattgaaagaatgcttcgacaaggatttcagacctggtttaggaaccatgttagtgttcattgtcaagttatatattgcataatgtaacttctatttttctaatatatgtgtgttgtatgcatgtggcagattttgaagaagtatagtacaaatccagaagaggtggatgttgatatcttctccttggcatgcggtcctgatttgagagttagaaaatactcctcgtgcatagtgaatggtgtgcggtttaacacagttaaccgtgacaagaacaagaagacactgaacagtggagtaatgtcacaagctacacataatggtcagttaattgatttttttggaaacataaaagagataattcagttggactataacttagaggagaggtccgtagttttgtttgagtgtgactggttcaaactggatggaaagaggactgcacttaaagatgatggcttttttaaaagcatcaatgttggaagtttgtggtacaagaatgattgtttcatattggccactcatgctacgaaggttttctatttgccagatacaaagctgggtgaaaattggcaagttgtacagacatttgaccataggcatctttataacgtaagtcagacggaggttagtgctactgcatatcaagaagacgagtgctatgatgaggaggatccacgccgaccagtttctagcattatatatgatacgcctttaaatagagatgatgagcgtggccctgtttttgaagctgctgaaattgctcggttgatgaaagaatctagcaaagaagtgaatgtcattggtgatgaagatgaagatgaagaagatgacacacttatggagtattttaacgaagaagatgactcagttatggaggtcgatagtgacgacgaatagttctgtttgaattttatgttttaatattttgtcgtaaggctcaattagtatttgagaccatgttctacttatttgagaccatatgttctattattttagatagcctcaatttgtatttgagatcatgttcatctatggaatttatgtataattggttcgatgccaaactattcatatccgtttttcaagttttgattctttgttggcctaaatggcatttcaacttgcctgtgtcaatgaaactacagatttagtctctactagttgagcctttatttttttattaactagaaaaaatacccgtgcgttgcaacgggtgaaggaatccgatcgtctcaacttacttagtgtgcgagttttttatagagatttcctatacggttccttttgtatttccaaaagcaaacaaacttataaaccgactcaaatacggatttgtattttcaaaactgaacaaacttaaaaacgactcatatacggatgacataccaaagtaccagcaaaaacatcttcaatttttataatagtagacactttgtgatgggtactagttgagcctaaaaatgtttttaaaaatataatcgtgatgcaccactcacctaggatatgtacagcaccacatgacatgataaaccatgtgcggtgcttcacatacagctctcgccggacatcggggatcgccttgtttggcgttgggcgagtgacctattgtttttagtgcttttagtgcctgattcgactgaccttctttaaaacaatcatatctttttcatacggactcgaaattagacatataatatatccacagacatctacagaaaaagttacatccgattctccccgctttgccgggttcggtgaaattagaactaccaaattccgcttacaaaattatgttttctaggcgagaagctccggaaccccttggatagaactttgaaaaaattcctcatgcttcatcttttgtccgtttgagctaagaatttctatggttggttgcagtgtgctccgagactcgaaaaaaatatcaaaaaaaaaaattcgcatatctctcctcagcactagagagagaaagcaacattgactctgtgcgttcgctccgtaggtttagtacggtgtgctgtctcctcccagctgatcatgttgtgtaacataaactctgtacatattgaagtgcaatccttttgcgtgttcgcgaaaaagtaatgggatcatggggcttgtttggccaaaattcctaattcctaaatttagattagtggaatatgactaataccgatggaataagatagattcaagggaacaaatttgcttcatgcattgttttataccacttactagctagaagcactaattgggaaattatcaacacctatatagttttattaatcattatcaacatttttttaagataataatcatcaacataagggatcataacatgatgaactatgtgtatcatatatggtgcttgtctaacctgattttctaattccaacaaaaaaaattaatggagtatgaaggaatgagacagattcaatcattcaaggggaacaaattttacatagtagcaaatctcaaatataagacttattataatatatactcatctagaaggttccaaacaaaacaggggctttgagttttcaggataaggggaaatcccgcgcgcccaagcggcttggcgcgcttgatgtgcgccagcccgaaatatttcacagtccgaattaccttactacccttaggttcataaaatataaaatatagagaacacttccatcagaaaatttctcaagggtacatcggtaattatgaaacagcacttcccaattcctccaaaaacctagccgccactcatcctccaaaacccatcttccagccgccacccatcttctagccgccacccatcctccaaaaccctagcagccacccatcctccagccaccttatctcaccggcgcatcaaggcctgcccgccgccacgcatcctccagtttcccatcctccagccccgatggaaccctagaacgctgttggaaggttccatccgccgcccgcgcgcccatcgtcactgggaggctccgagcgcggccaccaccagcatcgctgttatggcgccgaagaatccaaaaggaaatcgggtagcaggtatagtcctaacatcacctcgctcttgacttttttgtggcgtttggatttgtggagaagaccggtggatttgggaaattgagggatgatagatgcaaagctctgtttgctggattatagttagaacttccatttgcagtgttggtcattttacctgaaaagatagggtacatgcttctgcctttgcagtaaaaaataggttcacaagatgattcttgttcataccctacagttatacatgaatatggaatggaatggagggggagagagtcatactttgcttaattactggtaaacaaaaatcaaagagtacaataattcatttagcatatggcactttcagtcttgttgacaaattcctgatcagttcatctattctcctgatgcttgtgcatgcaattcatgacaatattttaaacaacgtttagttgaaaggcatctcaaagagccagcagtatatatcatttttttactagcaatatatatctttgagtccactaaccattaataatattccaattcatctgtacctcatccaagacatggtgtgctattgctactcttgtggcttatctattgttcactgagtcagtaacacattaatttattgttgctgtctaccatccaccagttcatctgagtccatacgaattggagcgcctaaaagaatgcatgaagaacagtgcaaggctgaaggagcttggacttcctgatcgctacaccccagttttggaaggctatgttggtgttcattctgaccagaatcaaagtggagattcggagtccgagtatgatcctttaaaggatgatactggtgaaggagatttgattgatgatgagaatgcaaaggttgtaattcctttatgttgacaagtcttaacttgttatttttcttcctaattcaatgtaatactatgttgaccaatccatgcttttctttccagcagtgctctaaggagaagactcgcaagaactgtaacaacaaaacttcaagtatccagactggtggagtcaagtttcggtctcgcaagagagtttatgcagagcaaatgactcctaaagttacaaggtcaaagaaaagcattgcccaacaagatgcaagtctcacaccaagtgatatttgtatgccagctacatcacaagctaacgctggagatctcgatggcaacttagatgaccacacacaggctgctgttgaaggccagttctactgccacatttcttggttacattccattaacatgagtcagctataaaaatgtttaacttgctgatctaagtttattgcttgtttaccttttgaaaatattaacttgagttttaagaataaaaaaaattaatgaaaccaattttcacatttttacttgacaacactcacatgaccaccgggtctgatgctatcgaccaacataatcagcacaaccatatggacaatggaggtgatgaattcttactgtcgttatgtaagttttgtttgtatgatgaatgcttttcttacttgctgcccttttttagatggcttcacccagcatgatgacaacacccttgtggctgatgtagttgatggcattactcaacacggtgaccacaaccagattaccaacgaaggtgagtttgttcatctattttccatatttcatattgtctcagttgatcaatatttgtatgc

SEQ ID NO: 74885 - DNA, 30460 bp, Oryza sativa
caagaaatatgcattaaactcaaagtgagataaagagagaggatgaaaaaaataaagctaaccttatagttaatctattatacatgttagctctaacattgacttataataagtagtgaattgtactattaaacttgctcttagggcaagtactataggcattttaggcatccaagcacagacccaagataccacatagcactaagggcaagtactacgggcatctaagcacaatctcctagtgccacataagcttaaatagtgaggtggaggagagaaaaaatgagagagataaggagccacccctcatgcaagaggcaactactacacaaaattcaagacaaagagagcgagagaggaagagtagatagggcaaacaaatattggggctagtgtattataattagtatagatgtgatatattgtacatgttacctctatatttattagttgatgatgtggtcaagattagatgtaacatccacctcttttataaaacttgccctaaatgatgagatggaggagagaataaagataaaaaagaaatagtcacctctcatgcaaggggcaactcctacacaaacttcaataaatatgtgagattgctagaaatattggggatgtgtggtagagacaatctattacacatgttacctcttaatttaatggtgtatgacatgcataaaattagatgtggtactcacctctaccataaaacttgcccttagagcaagtttaatagtatagccaaatcatctatagtcaatttaatagctcatttatataatatagttaactataaatatactatatcattaataattggtcacacatatcatacacacgtagcgttttagaatccgtgctgcagctggctacaaatatatagtccgcttatcttctctcttttcttatcttccgtaccgcagctggctataaatatatagccgacattatgttagggcctcatcggatggatgtatgggctgaggcttttcagccaaagcctatcgaattgcttattgggctgaggactttaaaccgaattgcttattggactgaggactttaagcctcaataagccaaataagccaattaatggcttttctttagcttaaggagaaaaggtaactttgactattcagccaaagctctaggttaaccgatgagggcattattgtacctgctcttaacgggtcccagcaaggccgactccagagatgggcctacagaaatggtcgactgtacagtgtacacatgtgtctagtggttactcgaaataaagattttgtcgggtggtgataatgatccacttatctgtgctcggctagttgtacaagtaggcatatttttttttcttcaaaacagcacaaatacatgcacttgtataaacatacacacacttattattcttaatacacacactcacacaagagaacacacgcacccatgattcttatgtgagtgtatgaagattgaacttgaatatcctgagatttataaaatcaccatatattacttgatatttgatattgataggtacgttggctatcagtgctataaatacaagatgatttgataggtggcaaagcgatagcgctataacgaccgtgatcaccttaacaaatcatcttagttgccttatataaggcgcttcatcgtgcatgtgaaagtcaaagatgtatgtatgcgttgtgtaaagggccagagaggtatctttggaagctttgtttattaaaaaaaagattcaatggtttaaataataggttcaatggttcgaagggaaactattttttattaaaaaatagtatgttcaccgttttagtttaaattagttaatatagaccataaaatgttaatttattgagtatataatataatggtgtagtacattatttgaaaataatagtccaaagtaattagttccctaatttaaataaaaattatcttatattattattaatttaatgggtaaatatagtggtgaaaactttattaataaacattgtagagctaattaagttacacattttttaaaaagttttatgatgatataatctttataaaagtatgattatttaaaatttagagtaaattgcacccacggtgcaacaacttggtaggtgggtgcaatttagtgcaataacttgagaaatgagggttccagtgcaacaacttggtaggaaggtgcaatttagtataagaactttataagtgatcgtataaatacaacaacttgcaagtaggtacgattttgatacaataaattaagaagttatatgataacttaatttttttggagcattttaattttttgagtatttattttgacaatattctagcatggatttgtataatcatatttatatatttatcctaataactaataactgaaagttaataaaactggatgtagaattattatatttcggttgatatttgagatggtgaagaaagaaaaaaaatcttaaagttaattggatgtaaattgtatgtgcagtataattcttaaagattaaattcaatattataaggtaatatccgtaggaatattgtgtaatggcatattgacatcgtgaaaaaactcacctagcatatgcttagccaagttgatgcaccaaaatactataaattgtagttcttgtactagaatgcacccacttgtcaagttgttgtactcaaacatttaattcgcaagatcttgcattatatcgtacccacctgccgagttattgtaccataggtgtaatttactctaaaatttattatcactattaatacgtgtatccatgaaaaaaaaaggagaaaatgtacgtatgtacctacctatgcaacaggagaagaggtcgaatttttcccatctaaacacatgtggccccctaatttcaaatgtgagcacgtattgttcagaattcttttctaatcgaattagttggtacaaagcaaatgatcgatccatcaacacgtgtagctagtaaattacagtaccgtgttattttttccctccttgctgatgttgtttctatgtaaaacaaattaatatttgttagcacaaattacaattttgatgatccaaacaaatggactagatttgagcttaccgctgccgttctaatttcctaaacgaaaactcgagactgacggcatgatgacagggtgccctatctcgtaatggttgatctaacctattgctaatggtatttgggttttctttttcataacaaacagtgtcaagtaggcctaataaacaagctgctacgagcaagtgatttgtcctaacgatcaacagccctttagtttgttactactccctccgtcccgcaatataagagattttcagtttttgcttgcaacgtttgaccactcgtctttttttgcaaatataaaaaacgaaaagttgtgcttaaagtactgtagataataaagtaagtcacaaataaaataattaataatttcagaaaattttgaataagatgagtgatcaaacgttataagcaaaaactcaaaatcccttatattatgagggagagggagtacattttgttgcacatcaagtccgatgggacgaccactgacacacagtcacacacatgagcttttgatttcaaatagaattccagtcattacatgctcacatttgaaattagacggttgcatgtgcttagatgggaaaaattcagggaatgcctgatcttggtcttcgacacaaacagcaggatccgatccccttttagttatttggtagagccaaaatctggctctaccaattctttggtaggattagacttcatattatattgttggttcgctagcaatatcctcaattggtacatggtgaagaaagtttttgagtgttgccaaattgaacgtttgggcattttccaatgatttggctccaatttaaactaactactgtttaagttgttgaacaactcatttgataaatttcggtttagatccaacgcggtccaaaaaaaagttgaggattgggctttacttgcacgaaaaaagttactccctccattccaaaataagtttattttgcatcccatctgtttatcccaaaataaattcattttctagtaatcattgcatcggagtttgtaaaagtatggataaatgcaatgagagtagatataataggaaataattacattgtgattaaataaagttggggtattctagattttttattgatatatgcaatatgagtaaaaataaacttagggttgtgttcgctgaggtaggttgagaactcattctctccgcacgaaaaacagagtggtccattagcgcgtgattaattaagtattagctttttttttcaaaaatggatcaatatgattttttaaagcaacttttgtatagaaactttttacaaaaaaatacattatttagcaatttgaaaagtgtgcgcgcggaacacgagggagaggggttggaaaccctgagcaaagaacacagcattattttagaactaagggagtacagataaagagatgcttgctcaacaccaaattgatcatctcacgggaccaggagtgcacaaaaagtggaaatttgtattatattgaattcggttgaattaagaaagggcataatcgaaatcatttctttgatatgccatatgctttacgaaactgcatacacatcaagaaatgaaaattgcatacatgcataatacaactaccggctggtaggtatatataaaaagggaccttggaaaaccaacaagaacaagttccccatctgctaagcctggctacgtgatctatgaaccatcaaattcttctagcagattgcattacgcgtactatagttatagaccttttgtattgttttggtgcaaacccgcaagagaaatctcgctcgtatgtaggcacgtagtaagctgccctgccctgccctgtcctgcccatctctagcagagaagacaacgaccgagcagggcagcagccagcatcacccactgattagccgatcgatcagcgtgtcatcccagggtacatctccggcgccatggtcgccgccgggttttgcccttgcttctccatgtttgcgtgccatcctgcacaaaaccaacgaaatcgtcatcgtcacgatcatcaacacgcacgacagccaaccattccattagaaaatcgatggctatgctataaacatattttaacatattttaagaagataaaagagtagagagacgagcagtggactacagatttgtagccagctgcagcacagactcaaatacgcaatgtgtgtataacatgtgggaccaggaattaatagtgcagtagataactattgtatcaattaactattaaattaattataaatgatttggagttggtagttggctgtactgttaaacttcctgttaccgaggctcatgtcgaagccgcgcttcttgagctcgcggtactcctggcagagggcgcagggctcgcaccacaagtggacgaggcagtcggggcagggcgtctcctgcaggccgtactgggaccgcagcttggagcggtagatgcaggagtagatacagctgcagcccgtgacgagaaacaccagcgcgtacagcgacccgctcgtcccgcacgacgacgacccccggtcgacgatctccgcgatctgcccgaacgtgatgcacgggcacaaccacgtcataaaacctgcgcccgacaacaatcgatcagcacacacgtaccacgccaagcagagaacacacaatcgtagcccggcttgcttattttacagttgctgctgtcgtcgaagcagtcaaagaggtcggtggaccatgggacgggggcggcctggtcctgcatggcgaagggtggtggtggtggtggcgcctccaccgtcctcctccggcttctgagtatatatatgctggcccgacgtacggggcgccttcgtcgatccctcactctccggcccgcgagggtgaggctttctctccgacgaggctaatgatgagcgcgcggtgtggtggtacaagtagtagagggtaaccggccgaatcgcggactggtcgtccgcgcgcatttatcgggcgaggccgcgaatgttggcctatcgatcataattttaaggacgtaactacgcatcgggtgctcgatttaacgctaaaaatcgggtgcccacccctacaaaacatcagctaaactggatgcatgcacaaagccatgcgcatatgcaaagagacatgcaacaagcatggaggcactcaatagctgtgcatgcaaagtacataactatatctctcactcctagtattaataaacaacttatttaacatgctctaaactttttttcttataaattacttatctcatctgtgatatgattacaccgttatatttgttacaattaaatatttaaaataagatctcacacgactatattttaaattaaaaattaatatataaatatataactaattgaaacacatttatattatatatgaaacattaagttgcaattgtttaaacatcacaaaaaactccttgaaaaatatctaaaaagaatatcacatgcaacattccaaataatttagtgaaacatcacaaaatacctaccgaaacatcccaaaaaacacaccacgtgcaacattctaaaatacacaatgaaacatcataaaatacctcctcaaactcaaagaacaccaagtgcaacatttcaaataaagtagtgaaacatcaactaaaacatcacaaaaaatacttcttcaaacattcaaagaacgctatgtgcaacattctaaatgacctagtgaaacttcgcgccgtttaagtaatccattgcaacaaaaaaacatttaaaatatttttgtcagaatataatcaagtaagattttattgtgaagaattaattataacaaatacaacagtgtaatcggatctcagattattagataataatctgtgaaagaagattatttgaagttatggaataagaaagtataagtatgtagtaggagcatatggatacagagggtgaacttaattgtacacgttacatgtatcatggcatcaccaatatatatagcaaaagtgattcatatagataggatccacataaataaactttaactataacaatcctcacaatgtatatagataaaaggtagcactaagagaagatagaagtagagacaaataatattatttattttatatgggtagcctatatggttttcttttttactttttagtcctttttttaaattaaaaaaaagacctttacaaaaaatatttctaaaaactgaatcttttggcccgattggctgccacaccagttgcacggtgtgacaaagttatttggctggccaaaaggttcagatttggaaatatttattttggaaggtctatttttaaaatttaaaaataaaaaaatattagtccatatgcatatgggtatcttttgttattttctttaaatggactagttgcataatagtattaggtggttgaataaaatattgtattgcctatagatcacttttgcaccacattgtggatgcccttaagtaggagagaataaaactacactctatatgatttttgatgggtaccggctcaaaagcagtggccttgatcttctttcctggctggaaattgcagtcatgaaggcttatctcccgcttcttattgaaagcaaataataagatcaaaacagattctagggattgcgttcgttggcggactcaacctgacatcttacgacatgaactgctcccaaagagggaggcctaaatatagtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatgatttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatcttatcagaaagataggcggacgacttgaccataaggtcggatgtttccgtgagcagtaagctgcggatctccccttttttgggggaaagctggtggcccttttggcgtgttaattctttcgacggggtggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttaggcacttgatcccttcggacctggagaacgtgtgacactgggtcggggtttggtgaaccaacaggtcgctcctttagttgaagtattgggcccctttttcgttgcctaggttacaccttcggaataccccagacggggattgagctctattccccccaatcttcactttacgccatgccgactctccgtcgtggaattagaccaagggtcgaagacccataccataggaccccatcccccgtatcttatctttcgcgcgtaggagatcgagacacagccttagggctatggggaaagtagatcgattgctctagaattacaactacatagagggtctctacaagtctataaagaagtttaaaaaaattgatagacactgtttgatggtgcatgctgcatgcaacacataaccggagtaggaggacgtccgattttttcaaattgggtcgaacacccgaccttaatcgttctcctaatttttcaagtggataattgcatttgtttggactctcgctgaaccaatcatgatgcagtgcgggcctggtcgcgcccacggtgttcacgtgggtggcgcgggctctgcatgcgggatagcacgacgggtggctacggttgtacaagcttcaataaacggtttggagtcagttgcaatacaagcttcaatacaagagagacgagtaaattaaatattaatatattaataattaactattgtataaataggctattaaattgacgaagctagtagttagttatattatattattaagggactaactagctgtcattcgacaaattttagtatagcttaactggttagattctttgtggtggaaccagcccacccaggtttaaatcctagaattgacatgggtgctcgtatttacgggctatttattctttcagtggtaggtaatatacccgtcaatagcgaggcacttacacgcatcaataacttaatgggcttcaacctaactggaccaaccaacggtgctcacacgggctaaaaaaattataacaggcccatggtcaacttcttttttatcacaacttattacaatatatctatagtgtaattatattgtaattataccataattatagtgagttacactataatgataatgtaattttagcttgtaactaaattaaattattcacttgttcgactgacgaagtgcatgttctagcaattagaattcatatgccatcccacaaaggcacttgctggaagattttgtcagcctacagtagcctagtgttggtaacttttttttttttggcaagaagataatcataatcgggacacttaaatgtcttacagtgatataaagtcgccaaccaccccgatatagccaaaggctaaatcaagatgagttttatataaagaaaagctaaaccggctagcggagccgatttagagatcaaaataagcctctaggccgatttagatcgatatgaggataactacccatctcgtgggtgaactgaaggtttacgggacaaacctatagaggggtaatcgcactactctcgcagcgacggcggacgatttacagcgcaaatcgacaaagatgtagtaaaacaagaaagtagaaaacatggctaaaagtaaagataaaagaacaattcgattgtgttcgggggggggggagagatatatcaatcgaaccggtcttgtcccttaaaaaggggttggtcttacctcctacaaatcctcctccacgtccaactcgggatagaaaccaatggaaatccgaaatataccttcccgagtaaggaaatccgagacccgacgaaaacaaactcaggctcggactctaccggtctgaccggccacacactgccggtcagaccggtcctcaagcaacgatctgaccggccaacatacggtggtcagatcggctctgtagaggaaacatgtgatatttccaaatcttgacaataatttcttaatttgaacctaggtgccaaatttgagtataaacaaaagaaaacttatgttctgatgtggtaggcccaagaaaaaaaggtgtcatttgaagtaagaaatctatcgacaaatttatagtaaaaccgtatgattaaacttgctcttaagcaaaagcgacgtcatcaatgaagtttacggatagtgcacgaacaagactcctctgacttaagtcagatgtacatagccactaacgtgtgagcccataaagatagtctcccctgtcagggaccatgtctctctgattttaagcctgaggagatcgctccggtagtacaccagtgtgcttgtactatgggtcggtactttttttggcgtgagataggattgatctgctggctggtgatgttgatcgaggcgtcgtccgcgtggtggtgctgggtggggtgtggctccgtgtgtgacgggggtcaagtcgtcgcctggaccccagccgccgcccgcgactcggcggcgagctttggtttgactggccaagccttgtttctttgtgatccgcgggtcgagggagtcgcttgccagagtccaaaaggacaccgcgatttttgcgaagcaccgcgcctggtgagtcagacagtcacgcacgacgagagggagttgtccccgggtcagattggcatgggaatcgtcggtcgtcttctctttaccttaacctgatttgagtgttccagtttcactgcgcacggtgcgagaccgaggtccgtcgaaaaacgtcgctagctgtttctgttggccagtcacggtcaccaggggaattcgcccagccatatatggcttggcaagccggatggcaactccgttgtagtgcgtttttttttatttcataattagtaaagtttagcttcaggaatgggatagagagacggttagagttgctgcataaatcccctgtgatactgcaaatatattaatattaacagcgactgacatataggccaaccgaaccctctgggtaactgcacagctgcagcctacaccaccaaaataacattggctgtgtttagatccaaactttcaactttttccatcacatcaacctgtcatacacacacaacttttcagttacatcgtaccaatttcaacccaaacttccaactttgaaaggaactaaacacagccaattatagatcacaacatgcgcatgcgaaacttccatgttgcaggcacgacgtccacttcgcacacggtaaaggcgcataccgatgctgtcatgcctcaccctcactctttttgaacaaggaataattaattatttgccactcttacggatggtgataaatgatttaccactggacccacatgtcatagacacgtaagggctcacatgtcatagacagcgagtggcaaataattaattgccacatcttaaaagtggccaaaagttaaatgtccctttgaacaaaagtagagcacctgaaactatgaaagcaacagtacagttagcaacttggcactcgactgcatgtccacaagaaaccgtaagccgtagagtcacctttcagtgaactacatagctctgtagtagagatcactgattagttcatgacaacgaaactgtacctgtaattcttgcagactgaagaattgacatgaagaaatgtttccattcacgaggctggcagcaggctcagtcagttacaaaagacctaagtcaacaactggactaagattttctttactgttttccctacaaagctgcatacatacagatcaaagaaaggccagcattgcagttctacccaactatgaacatatggctgcttgattggcaacatcgtgttgttttgaaggccaccatgattgctggggcacttcattcttctatatttcagaggctgaaaggttccgtagatcaatatttagaccgcaggaagttccagaacttttttgttctggaaattgcagcagcactttcgatggaccgacaaaaatggtcaaatatttaacatgcaattcaaatactcgaggtatttggcaactgatcaagccggctgttcagtatttggtgagctcgcgcacttcggtattgcagtcgctggtgtagtgcttctgacatttgatcaaaaaaatcaggatcccatctctgaattaaacggggatcctcagcatagcatatgtatatcgatgtaactgcactttcgacaactacaacagttaccccaacctgaaagggggaaaaatcaatcaactcaacatgatccaacaggggtcatagtagagaagtcctgctgtgtgactcctagcaatattctattgaatttgtccagtaagagaaatccttgtttccttgtaaatttcaattagattttgcatgaccataagaacttaccagtatcatgcccatcagcatagaggttgagccaaccataatagctttatcactttgtttaaaatatgtccaaacacccgtacatgttcctgtaattaacccacctaaaatggtgctcatcagaaggacagcacctgaacagtcataagcaacaagtgcttcaacgccagttgattggaacaactcccaagcatccctagctgagcgattgaaactctggccattgatagctatctgaaagtgaaaagtatgtgagacatttgtgcaagcccaataggatatcagtaatttgatatagtaatatccatacagtgatattgattcacaaagcatacaaattggtgtaacatcaatccaggtaaggtatcgggtatccatgtgcactttgacagtttgtatagtaaagttgaacttattaatagcttaaggaaacatttaaagttctatcagttcagaacataaatgataaagtggcaaacacatcgaacagggacagttttggcattggcatgagattatcaaaacttccacaaagataaaacatctgtcactgacctgtacatatgcatatttgttgaagaagcgaacaagagtttccacgatatgaaacaaaaagtcaacacagcacagcaaacactcattgttgcctattttagaacgaattcctcgaatctgaaaattagttaaaaaaataagaaaagggaaaattaatattttattgagagaatgacaataaaacatggtaatctgaaaatttcatgcggcgaaactctgttaaggtaaaggtacaaacctcccaacgtaaagtcctaatagcagccgtaaaaagtgatccatagcaaatgctcccaaatgaagttgttacagcgtactgaagtgattttagaagtggttttgggggcatcgatgcagcagcttgaccaccatgaatgagaacaagaaaaaccatccctgatactatgacatggactgtgttactaaggacagctccagtccaaaataaactgactgagaaaatctacagattacaagtgaaacaatcagaaaatatataaagaataggaaagacgttgaaattcgatatagaataaacaaaacttgcccgctcaccaaaagagcccaccattgccctccattaggtatgtgaaaagcaagaatgccagacactccaaaggaccataatgccatccaacaaagcatgactaacacaaatgcatatgctatcctcatcacatcaggaagttcccataccattcttactgccttctgcaatacaagcattgtgaaggggaacctagcaaaaaccaacccaattaatgccattggagataaacggggtatgtatttttgcagcaaatataatgtttatgagaatagaaggggttatttctcatgattttagcatagaatggaaggaacaattttagcataagaattccttatgaaaccaaaccagatattttcagggcttaaatagttttcttccacagacagccatgacatgcaaaaaggttgccataagacatccatgttaacacctaatgttcacaacaaacttttaccacctacaaagtttgtaaacctagctaaattctgtgagttgaagaaaaaacagttgctgtcaaattttccactgataacatgccggctgatattggatgacaaaatatcaataatcagtgggaacatttacaacctacaaatatagtaataatactgtttgtctgtttgatactggtttgggacataagctgattattgcagagtaatctatagaatagttgttttgttgaagtgacactgtccattaatgtaattttgcctaaagatctggttttactcacaaaagcaattattttcccatatatacaacgttatttgaaaacaggttatcaaactaaatttgcacattgcattgtatgatgtctctggcaaataccaaaaaaggaagcttgaactgtatttaaaaaaaaatgcttgaccagtgggtttaagacagcccgtgacattcaactaagttgagaaaaatcccccagaccgcagttgagcacactcaacttctcgtggggagcacgcttctaccagtgcctgcgaggggggatgttttttgggcaaaacctgggttcaagcctgggccggcatcccctctactggagtctctaccactgcgccgcaagcgcgtttacaaagcttgaaatgtacaaaaaaggattgtggaaaacccattccatttatcacatttcaatgttcagaagttatttagatattcattgtccattggtaagtttcatttccatcatggtgtagagcgcactacatggataaaacagaaatcaatagcatcttgtcctcatgtacaatcctactgggaaatgtacagaatttgtaaacaaatgtacatcaataacaattaactccaacaattcaaacatgtacaatcctactgggtacacagaatagcagagacaatctgcaacacctgcttaaatcttactccctctgcttttttatttgacgttggttagttcaaacaatatcaagaatggagggactactatgtacgcacgcaccaaaagaatggcatgatccctgacattgtagtttcttgtacatctttacagcatttgtaggcactaaagcctaaaagcaacactagcccatgcttaaaccgtgtgctaccatccaaatcaagttaactctaaaagagtgtgaagaaacaaagcactagcattgcacacccatacatatgggtgcacctgttggtaatgggaaccgacatggacacgcgccaacagcctagtaaaattcttataaaagagagctgcgcaattcatcgatttctccagtggcaggaatttagcttctgtcggtgtcagcatcatatgaagtatgaaccctcacctactcaagtctaagtttgcctcgaattgcatacgatttctaattttgtgcaggacatttgagaagacaaaaagggcagttgctgtgcattattattacctatcaagaactgacatgacgtagaggaagtgcagcgctccgccgacggcgaacgccacgccccagaagaagtgcttcccccagaagcagagcacgctgaccaccgcgaggtaggcggtgaggctgtgcacggcggccctcatgaccaccctccccccgtccttcttccccgcggccgccgccagccacgcccacgcgagggcggtccccacggcccccgcggcgccgtagtagggccagtacgactccgtgagctcggacttgggggtgacctcctcggcctcgagcgacggcggcgggggcgcctcccgagcgggctccggcgacccggcgaagcgaggcgcggcggtgaggttggtgaagcggtcgatgttgaagcggtccgcctggccgaagcggttgagccccgtcagcgcgagcgccccgccgaagacgagcaggtggagcaggaacaccaccagccagaacacgtcccggcaccgccgcctcggccacgccgccgcccccacccccacccccgccgccccagccaccgccgccgccgccgcaggccccgcggggcaggggctagggttcgcgctctccccctccgacgacgacatcgctccccgccccgccccgccggagatcagcagcagcggggaccgcaccgcaccgcaccggagcgagggatcagccgcgagcggatcgcggggaggaggccggaagcggaggggatgacttggaggagaagaagaggatggggaggaggagtaactgctcggcagtagtagaagcgaggcagtagtaaccgtttctggtcatcgacgacggcgacgactcgcgctgaaactgtgagaactgggaagcgatgggcgatggcgacgtcgcggcggtgtggggtgtttggggatttgaggggaaagccggggaatttcgggggttttgctgttgggtttggggggccgggcggagcgcgaccggcaccgcccccttcctccgtccgtcgctgcgcctggttggttggctttgtggattctagaagcagcagccagcatctcaaagcaagtggcagttgggattggagaaggcgaggccttggtggtggcgtggtgccagttcggaattctgatgcgccccgctgcacgagaggagattccgcgacggcaactcccaacttcttcgtccgtcgtttcgactccccgattcggcgattcgctaccggggatccaaatccatatccacggcgtttgtgttcgtttaacctgcaacgtttggcaccgttcgaacgtgacaccgtcgatctgtcagttactctcggtgtcaccgtcaagaaactacggtgaagttggaatttttttccatttttaaattttttatttttaatatttatagaaatattgtaccggcgaaaatttttacaaaagtataccctgccgagggcggcagtgtgacatgagggacgaacaagataaaaaaaacctagaaaaatgcatctttggtagggcgaaaattgcatttgcccctttacagcccttgcagaggacggcaagggacctcagtgcaaaatgcgcacaccttgccgtccttcacttgggcgacagaggccatttctgtaaatattttggatggtataatatttttgtaaatattaaaaaataaaaattttaaaatgaaaaaaattcggtgaagttgatgtgacatcgatgggccgaagacgagacggttttctgagccaggcctactactgggcgaattctggagaacggcccactggagtactctctgtctctctcccactggacagaccgggctcaacgcagacacggaacggagccagccatggtgaggtcggggcaggcgtcatgtgcccctgacacctgggcccccccgcgacatcatcctccagtcacgtcgtcctcctccacctcgggtccccaaccttttcaaccacacccacccaacacgccatgatgagggcagcagacaagtgggtcccaccaaacagtgtcgacgggtagatgcggctagcagccgtaacaatccgggcccaccttatcaccaacgcggagtcacccgagcccacatcgcgtgacctcactgacatgtggggcccagacggttaactgccggtgggaccacggaaacagagagggcgggggagaggtggggccaaggctccacctgtgcgtggaaaccttttggactgctttggtgtgcccagctttttatgggggcaggagcgcgtccggaaatagaaacatctcgccgaatttgaactccacctgagcacaggagaagccgcagccactgaggtaaactgctcctcctcgccgatttcccccctcctttttctctaataccaaattactcgagaaattgtgttggttcggtccgcgggtagcgtgattcggccagatctggcgtctgtgtgtgtggagaattcgagggttttgtttgggtttgtggggggagtaaatccggacgaatctgtggtggtttgggggggaattcggtgtgtgtttgagttgatttgagttcgtggatgattccgttggatattgataggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagccagggcgaggcctcctcttcctcgcagccgccaccgcagcagcagcaggaggagcagcctccggaggatgcgggagagggcgagcagccgagggttccggatctcggggaggacctggtgttcgaggtgctgcggcgagcggaggcgcggacgctggcggccgcggcgtgcgtgagcagggggtggcggcagctcgcggaggacgagcggctctgggaggccgcgtgcgtgcgggagtgggcgaacctcggcttctccgagcggcagctccgggccgtggtgctctccctcggtggattccgccggctccacgctgtctacatccgccccctgcagtggcgtggcgccggcgtgcccaggcaacaggggaggcggcagccgccggtgaggttgggccgggaccaggttcagctctcgctgtcactgttctccattgggttctttcagaatatgccttgtcctaagaaagacaagggaaatgacagtgataagaatggagggggccaatgcgggtagtcgaatttgtggaataagcttcactccaacaagcatcatcctaagctaccatggcagttgccctattgttcacactggtgatgctagagagtgttggagagacgaacaggaaaatcggcatgcttgatttgggacatgagagaaattaagtggaattgcaagatctgaattggttcggttgtgttccgcacttgtaagatttatgtgatagtgtcacatggattgatggacgttgagtgctatgaggacagttgcgtgaatgctgatgacaagtgatttacttcaagagaagggagaaatggtttgcaattcgttctgctgttgctgatattctagttatcagctattgtgtcaacttgatatatctggcccaagagcagtatggactgtgtgccttcttgcgccggtaccaagctttagagggaaagctgatgcaaatagcttttgtttgcataacctttttcaattagggaaacataatttcccatattaggcatatggagaattatgtgaggtattgattgtttgtacaaaaataaccattttattcttgaatattgcattttcacatgttaactaaggttcttaagttgatctgactgccatgtacaatatggagcccaacaaggggtagtgacacatatttctcaacttcagtatgcaataagtcagtcattttatatgtttttacatgtggagctgcggataatgtgacaaacttatgtaatcgtgaatgatcttttgatgtttctctgtttttctttcatgtagtttgatataggattcctttatctggcactattgaagttttgttgtaaataatgttattcttgcaaagattatcttaaatcaatcatttctggatctgaagaggtattgtaacaatctgaagctttgcacaaccaattgcaactaaacttttgtatttcttagggtgaggacttgaggttggtgtgatgggcatttagctaactgaaatttctctcaaacctcacagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtattacaatagttcctggcatagcagtctttaatttctatttctttatattgtcaagttcatgtgtttgaatgtatgtgtttgataggtacctcgcagagtttaagactggagctgagaggaaggatgctgctgagaacaccatggtggcatacaaagccgctcaggtggtttccttaacagtgaatttgttgttgcggcatcctgtttgtttgtttgtgccattttgcaattttgattcggggtattcagctaaagttatttgtgatgtgttctcctttggtctgttttgtttttctgaatattgttggtgataaaatctttcaggatattgccctggcagagttgcccccaactcatcctatcagacttgggctggccctcaacttctcggtgttttattacgagatcctcaactctcctgaccgtgcttgcaatcttgcaaagcaggtttaatttctactgcattctatttcattatttgtgaattggaggaccatatggagttgagaagatattttgaagtttataccattgttgtgaaatataatgtcttagtaattgggattgaacaaataacatgtatgaattagtaatacacctggaacaggttctacttagttctgttagcaaatagcaaagtgtaggctccttaatgcaagtaagctgaacgggttaggtgcattgtcatgatggattttcttcattaagaatacttgatagaaaatgatgaatcaaataagaggtgtaagaaattatagtttacagttacagatttgcccaccttgaatacttgagtgcttctaaataactgatgaagtccgagcatcactatggccattgtgacgtggaacaagcttgtctcaatatggccatcgttcattcatagaggcctaccagtttgttctgtaatttgttaataatagatatctgatgtatatagaatggtttactgcagacaagtttgctataagttcactgctttgtccatggatataattgatcttggacttggagcacacattatgtgccttactttatgaaacttgcttgtgctagtacttatatttgccatcataatagaatgtgacagtaacctactttatctcaggctttcgatgaggctatctcagagctggacactctgagtgaggaatcctacaaggacagcactttgatcatgcagcttctgcgtgataacctgacgctgtggacttccgatatctcggtattttcttcgccgctagcatatatatttgcacttgcatcatattgtctttggaatcatcttaaatgcgtaaattccatgtgtgcggcttcaggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaacattattctgtcaggtatgtgtgataagcggtttcatatgcaacaatgctgtagggacccaaatgttcactggcatcatgtacagatacttgtagtaccaaaattagtttagcagatataagcaccagtggtgtggttatggccttatggattattacgcacacacgattatgccatcactagaaatttagtgactaagatttactaatgacttctgcgtccactcaacgtacaaatattgtagttttctagatgatttttttattttctataagactcatcaaaaaatattatatttgataggatcccttgaaatttttagttgtgtttttcatgagaatgagcaactaaacataactaagcataggggtgccttctgcttgaaaatttttatcattaaaaaaatggggttttcttcttcaagtttgaatatttaatttctttcttttttctacaacattttaaaagttggcactaaagaagacaattattatgcaaagaagataatacatctatttcaatcctaccagaatggaaagctctggaagctgttaaatctttttttccctttttttaccttgcttccagattgtggccccgacgatggtgtcaccttttctattttcttttacatttggagcttaagcatctctattgttttatttgagctccgattctagagacattcttagcatctagaaaatattttttattccaataatgtcattatttatttcatattttattatattttctttattttctttcctaatttttattttgcaatttttcagaaggtgatgtttattttagtagtagtattgttgaaggatctagatgttaccggtttaatttattgagaattagtatagaagtttctggagagactataagctgcaagaaagcttgagctctgtggcatcttttcttgctccatttgtgttttttttttcacaaaagagtctatcatttatcttggaagctagatgcgccaagtgaaccaatcagctggctggatctccaaccagctttagaagtatagctccgttacaggttataagacgttttgactttggttaaagtcaaactatttcaagtttaactaaatttataggcaaatataataatatttataatactaaattagtttcatcaaatcaataattaaatatattttcataataaatttgtcttgggttgaaaatgttactaattttctctataaacttagtcaaagttaaaacagcttggttttgaccttgaaacgtcttatagtagtttttttttatggaaccgaattctggaaggagtaggttgtaaacagccgccgtttgccatatacatatccaaatcgcaagtctcccgccatcgcattgcccgccgaaatagcctccctgcacatcacgcattcacgttcgcacgcagagccaggtaaaacggtcactacccgccacgccggcggccggccgccgcgccaactttgcaccggtttgatgtaatgatgtgtgcagtggtggaggcgccgccgccgccgccgccggacgagacggagggccagcaggcagggggcgacgattcgtcgggcggcggcgaccggcggagaggcgccgccggcgccggccggcgcgtgatcgccgcggtggctttgggcggagcagcctccgtcgccgcgctgcttcacgttttctgatgatctcgcacggcaacaggccgatcaattattattattattatttttcagcttctttagactgtcagtgcctcccagtaatttagcggtagaagatatgcaatgtggcaatgcaaatgaacggttatcgatggttaatttctttcgacgtaaacatgcttatcgatggttaatttcttcatgtaatcaggtttagatgagaccttgaggttgaatatgtcgttcggcttgtgatgcgaacatcccagattcaaaaacatcaagcaaaagagctatagtttcagccaagaagtccaaatgggaagcatcatcagactcgctatatttccctgatttttcaggtaccacaactcgcagctcaggttttctagctctgatcaataagaaccagatacaacatacaaggcacggtcggaagcaaaagctagttttcttcatgctggagaagtgactcaactaaaagcttccagagttcatggattggatgccaaatgtttacatcggctgcagattaatttccatggagagccacgattgttctactcaccttaacattctacggctcttggacgtcagatacatataatacacagcaattttttaccttgtaatgaatcgatttttgatctcattgtggatggcctaatggctcgacagcggttctgaagagaagaacgtagaccttgtcgacggagaagtacaagaagcctcccacagagtgggtgacataggaaccaaagcctgtaccaacaatgcagtgccaagcaggaccatatgttgcgtcgaattcctgcaagaaaatgaaaaaccacattaacaatggctaagacatttcatcctagttggctcagtgaaaaataatgtaaaacgtagtgttcaaaaggaaaaataataatacagtagggaagttgctacaaactttaacctaaggtgcaaccgtgcaagtgcaaccgatattctgagcattagcattctgtagtaaccaaccatccatatgagaaccacttgtacatagccagtttaggagcactgagaatcagagcttacagacatgcactctgaacttttttgtgtgaaccttgaacaagctgaacaacagaattcgatggaaggtgctgggaaatatgattggcaattaggactaaaaaaatgtgccctaattttcatctgcctttcagggatatctaaatttcatatagttttttttttcatgtgatacataaatgcctgatgaaaaaattatttcaagtagcaggtgcctttgggcatgagtatttatttaacataggaggtttgctataaaagtatcattcctacaaaaggtgtaagactgcagaaaatcttgttgggtcaagcggtcttctgacttcagatagggctgcaattttgtaagtaactcttcttcttaatacaatgatgcgcaaatcatttgtgtattctcagaaaaaagactgcagaatatgacgaagtaaacacagaaatattcttttgcaccacatccacaggtaagagttaagatgttgataagttagcacgttgaggttattaagaaggataggcagacctctaagtcgaactgtcaaagtagtcataagtaaaagcaaaatactgttacttcttctagacaaagtattttttttattcaggcttctacacaaggaatgcactttaccatccattattacattgttttagccatatgttgacgaccaatgctaacaaatagcactcattcacaaaattgaaaccttgaatgaaaaccatctaactacaaagcaaaatattgtgtacctagatggcatgcatccattttttaagcaaccaatttgcgtacctctttagaggatgcatttagttaatctaccattgagcacacagaagtctagattgctctcagattcttgtaatcaacaaatttctagaagatctgttccacattttaatgctcaggtaatgagctactccggctaaaatataaaatcagacaaagcaaaaggatcagatggtgtgaacaacaacatatatgaatgggaaattctgttaggggaatggcgaagaatgaatcttacaacacaggggtaaaacaaaagccagcttctgagcttcacgggtcacagctaacaaatgctggatgtcacatgtgttaggctaagctgtcacaattgcatttctggtatatgattctaaagtagcttttcccctatccaatgttgggaccaaatgataacacatctctaacagaaacagaaaattttcaaccatagtcactttcttcaagatatcccttccagttatttataatagagatgctggcattgcacctgtctatctatttttgctaaactagcctcaaagacatcgttttccttttcccattttcctgtttttaaggttcccatcactagccacctccttgcttgagttgtgaggctatatatttcttgagaaaattcccaatatacccctgaaaatttactcaatcccttcaatacccctgaatttgacatcatcccttatatacccctgagttttcattttgatctcctctatacccatctccgttagttgatcattagttgaccgttaaatattttaaaataactatattacccatcctatacaatggtacctacctaataaattttcatatgaaaaaattaacttatacaaaatacaagcaatataatcatttaatgcccaacttaaaaaataaaacttattattttttattttttaaaacttatgattaaatccatacattagtttcaccagaaaattaagagcaaaaactaaatgttatttaggtttaaattttaaatttgttttctaatttgtgataaactaattacatcccctttgttttttcgcaacaaatcttttttcactaaatatttgttgaaaagtaattttgaaattttatgcagaactttttttacaataaatcttttttattttaatgaaataattttttatttttaaaaattcataacaaatatttagtaattttccttattggttttcacaactcaaataatttacacataaaacatttctagcttttaacaatataccaaggacaacaaagtaatttctacaataactaacggtcaaactaatggtcaactacggaatgggtatgtaagggatccaaataaaaactcaggggcatataagagatcaaacaaatctcagggacgtagaagggattgggtgaaattacatgggcacgtagggaattggcccatatttcttgcccaaatttctcaatcccccaaccatattctttactactccctccgtttcgaaatgtttgacaccgttgactttttagcacatgtttggtcgtttgtcttattcaaaaacttttgtgaaatatgtaaaattatatgtctacataaaaatatatttaacaatgaatcaaatgatatgaaaagaattaataattacttaaattttttgaataagacgaacggtcaaacatgtgctagaaagtctaacatgtgctagaaagtcaacggcgtcaaacattttgaaacggagggagtacaaatttaccaccccaatactgcactgtgccactgtctacgtgtactcgaatagcttgaacaaactgtagccaatggcgagacggatggttttaccttcttgagggcgagggcgaggcgcttgctgtcgagccgcggcatggcggcgacggcgtcgaaggcgaggcggaccgcgcgccgctgcatcgccagcggcatgtcggccgcgcgcacccggaccgacaccttcctctcctccttccccttctccatctccttctccttccccttccccttcccagcttggccgccaccgccaccccctcccttgacctccctcttctccaccacggcggccaccgccgccggcttcttggcggcctcctcgactcgctccggctgcggctccatctccagctgcagcttcgtctcgggctccgggggaggcgtgggcgggggcggggcgagcgccggcgcggcgtggagcttggtgcggcggatgagcgagctgaggtagcggctgcgctgctcgagctcctcggacgccggatccatggcgggcgtgggcgtcggagtcgtcttctgctgctcttccttccagggtgcggggacgcgcgcggggcgtcgtgctcacctgaggcggcggcggcggcgagcgttggtcaccatcgctgcctgcgccgctgcgcggtggtggggggaatggaaatggaagtggccaaatgagaggtcgtggtcaaagcacaggagaagtagtagcgccggttcacgagacgaggcggtgtggggtccgtttcccctggccttttcccgatggtgattggtgacccggcgaatgtggtgagcgagaccggtttgaaactttgaactcctaacgaacgtggtgattcgttgaggccttgaggggattgtcgcagaaatagctacattttgtaactgagagtactccctctatttttcaatagataatattgttgacttttaaatatatatttaattatttatcttatttaaaaattatgtgtaaatatataagatataaatcgtacttaaagtattttaagtgataaaacaactcacaacaaaataaattataattacataattttttaaataaaatgaatggtctaacatagaaaaaaagtcaatagtatcatctattagtatgtcattgtgaactgtggagttgtttcgagctggcatttttactttatgttcagtgctactgtgcgagcaacacgaatggatacagatcaggtatagttgtacttgtatggattcttatcggaattttagctcttaaatttaacttgaagaactagttcgaagtggagttgtgaagtagttgaatcgcgctctatatctttcattttgtgggaacactccagcagtccaactcgagcattatttaggacttgtttagtagagctccaactcttaaatttagctccaagagttgagtctggagtggagttgtggagcttcctaaacccatctccacctttctagttcattttgtgagagcactccacccagcttcgctcccattttaggtggagctggaactggttcattttgtgagagcactccacccagctccgctcttattttagatgaagctagaactgctggaactggttcattttgtgagagcactccacccagctccgctcttattttaggtggagctagaactgtttggctggactctagctcaggaaaggtggacttggagctagagctgtgacaaacagattctcagactctagctccagaaaactgtttgtttcgactctctggatgagatgagactctgctcctttgtctccggaattctcaatttcaaggcttgtttggacatccgagtgtcatcattgcaacagcgctcatattttctaaacaagcacagaaggttaccaaagagatactctctctgtcccaaaatagctctaggattgaatttagtttggaacagacgagtacaccataaaacaagttttcgatgccagtatgctccatcagtccatcatcgaacttccatccctcaagagttcccagaataaacattagcaatttaagatcacataaaagccaaatggcttcaaaatgtagactaaactacgatgggtaaagaaaactgggctcttctgacattttgcctaatcttgtgcataaactacataacattgcttaatctcgtacattaattacataaaagaaaatcaacagcaagcaaatcataaaccatacttcttcccccaattaacattaagtacataccagaatcatggctgtgttctccccccccccccctccaacccattttcccaacccacctctctcattttccgcgcacgattttcaaactgctaaatagtgtgatttatgcaaaagctttctatatgaatgctgttttagaaaatcatattaatccatttttcaaaaaaaaagttaatacttaattaatcatgcaataaaatgagcttcattttgcatgccaggagaaggggttcccaacccctcctaccgaacacagccatagccacatccaactccgtgtttttgagtttcagaaacaggctttactatttgttgtgcaatgtgatctaaagcaaaattcgtcacagaaggcaaagcccaataactaactgtaataaacgttctcaaatataaatgctctcaaatcaacaacagtgacagtcttactactgatttagactggaagtttggaagctaacattccggaaaagtttcagatcagtaaactcggctagtaacaatcttactgagtactgaactactgaccatgctaatgccactaagcagcacactacaggatttgaattcaatgccatgctaccataattctattcatcgcatggtcctcaacgatcggagtagtaatatactccctccgtttcgttttatttgacaccgttgactttttaacacatgtttgaccgttcgtcttattcaaaaacttttgtaaaat

SEQ ID NO: 74886 - DNA, 13432 bp, Oryza sativa
gggggtcgtcggcggggatcgaagcggagtcgatcagaggagtggagaagagagagagagagtatggctagagagagagaggaggaggaggaagaagaagaagggggaaggaggaggaaggagatgaggagaaggaggcgcttgtctctcctcttctctaggcctgatggatggagagagagagagcacacacagcacagcagttacggttgaattttttttttaccatttcttttctctcgttttctgctgggtgctgaccccaccaatggttaggtgccacgtgtaccgtgttcttcgggtgagggctgacgtggccggtggcggtcgatgtggaataaaccagggaagggagatatgtgttgttcttggttatggaatgcgagatgtttggagatggttaggttggttttgctttgtttggtgaatggattgttgtttttatttagcatgggttttactagtgatagattagcattcagtgattacggtgtaaattggctaaaaaatggaaattgcccttcgatatggtgtttagagatggatgacgatcgagtaaatattgaatgaaatagcgggaaaatagaattgcacgaggcaaattctgtgaacaattgaattacctacataattcctaatgaacgggattgctatatattattcgactgaaatatgggatagccgtgggtggcggaggaccggcagtgggcggtggacttcggcgggcggcgaggcagcagcggcgccgccggagccgcggagatggaggagggcggtgggccggcgtcggtggcgggggcaaagcaagagtgaggttaggaggtggtgggcagtggttgcagatccggcggcggggagccaccggagatgggggaaaacggcggcgcgggggcacctcgccgtcgccgccatgaggagaaagagaggggggaaggggagggggaaagggaagggtgagggggctcgccgggggggcctcgccgacgccgttgactctttccggccagccggcgaggcaggcagcggcgcggtggggtggtggtgacggtggaatcgcgcaacggcgcgaggacgggagtggtggcggcgttctgaacggggaggagaggagttagggttaggggggtctgcacgaatctttaagcgtatccagtggtccaaaattcgaatgataggaggtgggattttctatcacaagatatatagacaacctctttaatgaaagtgaaggtttatcctagaaccatgttttttttttgcagggaagaaccatgcaaattgttattcaacaatatgtaatatgtgatgttcaaatatcattttgttactattagttacacatcactctagcattgcttttaccccattaatccatatagtaaactctgcgctggtaaagttttgaagtcatatgctcccatcgaaacatacaacaactaaacttagcttacacatcatcatccaacatagataatacacacagcctcatcactaggagtatcaccacatcaggcggaacagccacattagctctacatcttgctatctattgcaattgtggtatgagatatattgcaattgtggtatgagtaagtgatttgatatcttccttatttagtagtactatgtcactagatagagcaactaatgaatagctgaatagcaaaatagtgttttatatcttcacaactgttactaatccaagttctagaaggaatttagtattattttttttcatgaagcaagtaatgacttgttgccaaacaaatgctctcaatgggattatctcgtttctttaagtttaccgttttacttgatagaataagaaatacaactatggggtgtttagatcccaccccaaaattttataccctgtcacatcgaatgtttgaacacatgtataaagtattaaatataggctaaaaaataattaattgcacagattgtgactaatttgcgagacgaatcttttaagcctaattgttccatgatttgacaatgtggtgctacagtaaatatgtgctaatgacggattaattagacttaataaattcgtcccgcggtttactgacggattctgtaattagttttttttattagtgtccgaaaacccatgcgacaccatatataatacctgatgtgacacgctaaaactttaaacccttggatctaaacaccccatatgattgtcttaaatcaattgacattagcccaatcaaacctcataattagagcaaggacaaagggaagaaaatgtgttcatttgtttgtatgattccacatctagcatacctaatcaaaagaacattattctattctttttatgcacaccgtgaccgcgaataaggtaacttcaaaggtacaatgagaaatctaaaaaaaggaaatttttattgaagatgacgaggtaataccgtaatacacacttttgcatccattaagtaagaagagcttgggctaaaaacaattattgcaaggtcgaagctcgcctcattcatcttgatacttataagggaatggacaacaaagtctaacactttcgagagtacgtgttttggaagatagagaaaagaaaatacaacaaggttggtccatttaccccaatactaatgggattttatttggttgacatgcctaaccaaagcatcaatccatgttcatgtgtgcctacatctatttggttcattcttattgatcgggcttagctaatactagcagtaaaaaaaatttagatatgatgtgaccatcaagtataggcatacaaccaagcatgagaaatataaagcattgccaaagaggatgaatggaggatgtacaggatattcaagtccaacgagttttagaatccagttcggcctccagagacatcactgacttcaaacggacctatcgccttcatgccaactacgatttgcgtgatcttggaatggaaatattatctcgtcatctttcaaatgcatccagtctcatatccaaattcatctcgagtcaacgagaatcatcaaaacaaaacagtgctattgctgaaacggaacttgggcctttggtcttgtaatagactagggccatctcagaagtgtctccctccacctccccgaattagtacttaaccctagctctagtttcccctatgaatgtctatttacaccgtctagaacaattgggttttatttagttgaattatgccaagtgctattcaccttgtctctagttcttactcgattagagcatccctaggagatacgctactacatcctccgttcgcgatttggcgtataggagtgcaaaaaccgtctccaggagatgcgccatccaatccggcaaaagtggcggatgcgccaaaaagggagagagaaaacccaaaaatagcgtgtctctctcctcgcgccaaatcacaacgatcgagctcccgcccccatccggaattccacgacgtcccctcccccgcaacctccactccatcgtcgtcatcgccggccagcgaaggggagtgcgccatgcccgtttttgatttttttttttgcaatggagggtggagagaaaggggtgtagccgtggagtgagggtggagggggataagcataccagatcagggaggagagcgccggcagcgcccaccgccatcgccctgcccgctgctgccgcctgccgccgttgcccctcgcccaggcgccgctggatttagcggtggaggattggagtagatgcggaggcccggccgccaccgccgcccgccgccgcgacacctccgcccgcgcctgcgacacggtcacctgcgcccggtcgctcatccgcccggcaaccccaccgcccgcggccgtgaccccgccgctcgcgcctcgcccgcccgcgcatgtgaccccaccaccgcccctcaccagctcgctcacgagaagaatagcagtagagagagtagtagagaaggttagttgaaagatgttataaaaaataggaggatgcgatatggatgatgtaatatagatgatctgttggagtgggaagggatatgaacgaggaatcttttttggatgggcatccatatgggcatatagaggatgatatttggatgatctgctagggatgctcttagtcgacgactatagattggcaccccccctaaatagttggtgtgttgatttacctggtcgatcagatataccacttcaatcgcaactatttctttgtgcttaatcacctattcataatatttagattgcatcttatcttgttcttgcagtgttctctcgtttgcattgcaaggatcctcaaccgcgtgcaactatttctttgtgcttaatcacctattcacaatatttagattgcatcttatcgtgttcttgcaatgttctctcgtttgcattgcagagatcctcaaccacgtgccacggttgatacgacatcgtttatggtgtagcgattgcatggcgatctagacttgttctgattggtagccatgtcgtacacgtcacactcgataaaagcgagagttatcccctaccagaagatcaggccacgagagagagcacgtcatcaagatacgtcagtatcataattgataagtagaatgagaggccatgcttacttgggagagatacatatgtcaactaatgcaacccattttttcacatatttggagtacaatttaacatctttttccctctttgaaatctctaccatctggtttattcacctaacgttgaaatgaacgaggaaaattctgcttgtgaggcaagccttagaaaaagcatgcccttgaaaagaccatgcttgatctctacacaacatgagacctaagaaaaagactttgcaacttaaaagggtgtgttcaggaggagttgggaacttctcatcaccacacgaaaacatgatagctcattaacacatggttaattaagtgtactagctaaaagaacttgaaaaatggattaatatgatttttaaaaacaactttcatatagaatttttttttaaacgcataccgtttagcagttcagaaagtgtatgcatagaaaaatgatatagtagaagttgggaaagagtagtgccgaactaagtgcaaatcatgttttgaataataatacgattatcatcttaagtaaaaacgattttgctagagatcaatcaaaagacctttttcttagccatcacaggtgggaaatcaatcccacgacctcttggttgatgccacgcggttgtaaccagatgagcaagctatcaatcctatcgtgtttaatatactccctccgtttcacaatgtaaatcattctagcatttttcatattcatatttatctagattcattaacattaatatgaatgtgggaaatactaaaatgacttacattgtgaaacagaggaagtacaaccgatgtacgatgccattataatataattaaactgtaattatattcgtgtgatttttacattgaaaaaaatattttgaacgatatctagtagccccaagtaaaaaatatatttagacccgaaacttaccattcaagccaaggccgtgtttagttcccctaaattcccaactttccatcacatcacatcacatcacatcgcatcgaaaacttttctatgcacataaactatcaactttttctccaaactaccaactttctcccaacttcccaacttttccaccatctaaacacagcccaaaaataaaagagttaatttcacaaaactataggtactttgtacaatatatcacaaaactacatatttaagagtttgtttcacaaaactacagatttattgtctccgtttatcacaaaactataggtacctgtacaatatatcacaaaactacagatttaaaaacttgtttcacaaaactatagatttagtgtatccgtttatcacagaactacacatttagtgtcttcatttattacaaagctacatatttagtgtcttcatttattacaaaactactccctccatctacttttgatagtcatatttccaaatctgaaaaatctatttttgataggcatatttcaacccaacgacctatcctcttaatgactttctcggatttaatgcatgactctccattattccacacaagattggctacatgggcatcgagaaatgtaaatattaataaatctcttgtttacgaggaataactagtagcatgtttaaatggatgataagtagaattacttatccttgtctgtgtgtcaagatgaaatatgactatcaacagtagatagagggagtacatatttagtgtcttcgttatcacaaaactacaatttttgcattaaaacctgtagttttgtgataacgaagacactgaacctatagttctgtgacaaatgaagaaattaaatttgtagtcttgtgaaacaagttttaaatctatagttttgtgatatattgtgtaaagtacctgtagttttatgaaataagtttataaatctgtagttttgtgatatatggtacaaagtatttgtattttttgaaatttactcaaaataaaacctgagtaagaagatcagcccggcccggaccagcccagccggtccacaaacatgcaataccacatttcccttttcttaatttttctaacacgaaaaaaggccccgaatgggtgggaggggcccgttcgtcttctccagtaacgcaggagggaggagctcgtggcggcggcgccgccaccgcaccggccggcggtggggacgcacggcgagggacccggtcaatttttcccaaaacaaaaagcgttcaaatcctcaccacctcccatctctctctctcttgacctcacgaatcccctttgccgcgagcaacccgcgacctccctccctccgcggccacacgaggtacgcgcgctttcccccttaccatctcgagataatccccgaatcgattgatttcgacgccgatttgcggcgatttccacaggcaggtttgctcgcgtccctctctgctctcgattgattcgttgggggttcggggggttgagtgctcgatcgttttggttgcgtgagtcgcggtcgaatttagggtagtattgcttggcgattcgtttgcgcggactggatgggggctttgattggatggggaggtgggaaaatcgctatgcatgcttgttgattggaattggattttccatgtgtgggcgttgcttgtttacattgggattgatttgcagagttggacttcatctgattgcgttggaagcaagcgaatgtgtcgtgagattgaataatgtgatatacattttcagatgttaggtgccatgtgttaaaaacaccctcgggtcgtaggtttgatctccatttatgatttgagtgagccggggagccacagcttaagatgccatatgtgtcatatgttgtttggggagagaacggaattggattgataggttttacatacaacaccgcattgctgaatttataaaatgcacagtagcgaaggaagcaaaacaatgtatcatacatacccccctggtgtcattttccatgacatgctgcctaagtttttccttgtcgttttgcatcaccgggatagttgttcccatcttgtgcatagttagccacctgaaaatcacaaattatcagtttgcgcctggcaagtaagccaaccaccaacaaaatttcctatctagaaatctgacagcgatattcttcctgaacctgaagggctaggaataatatgtctgcagtactgcaataatcataaactcaggttaaactagttgtgtttcgggcatattgcacctgggattattccaatatattgccaaaattttaaaatgacatgtttcggttatttttccttgtttttggaggaaataggtggaggatacctttagatcagcagaatccccctttgggagctaaaaactgaggagtctatgtgaaaagaaagattactgggaaaatcgtaaaaacttagacatgttagtatgttcagcgtccttcttcatagaaccataccatctgtttcatcttaagcttcaatggtcatgtaaaaggtcctttgaatgactgcaagcaccttccataggaagcattctgatgttggtttcagatcatgttcatatgatggaggttaaaagcaatccatactttatcaatccagtagaacaataaagtagtttttaatttttggaatattcagaattggcagtccatatatgttgagaattttctcaatatggaacgaagattccaatttcctaatccagtgctggtgctctacagttgacttcaaatcccactgaattatttgtgagcaataagtcagtgctagttccttgctaagccctttctagtgttgaaattttagtgtttaattctgtgaacttctagggagggaggatgatgtttttaagaaataaaaaatggagaaaaatactcttgatttcaccacttcctttttcaatcttgcatatctcctgcagtaagcataatctcctgcacatatgctgcttttccaggattctaccttttcttccgcagctgtctatctaccgccatggagcactgaagccccaagcatccaaatcacattgaaatccttccatttagatcaccgtaagtgataactgttgaaacttatgctcaccaagtcaaccacgcacataatagctgccctgtaaagcaatgttttgtttgttaaatcccattggaagtccatgctctctgcaacaatatcctggtagacatgttgcctcctgttgatccagttgagcgcagaaaacacaatcaacattcccatcacatcctgctcggctttttcttggttgcaaggactaaccgctgaaggatctgatcattaattggaactggaagaccccatcatttctatacttcttcagggatgtattcatatcattatatcaaatttaaaaacctatatggtaaatctacatattctgcaggctgtattcataggaattacaacaagctgtgcaatatatccggaaaacattccttgttttcttagtggtccgctgatatggccatacatacctcataggaaattaggtggataaatttagaacattcaattattttagtctcaaagatggaaatagatttgcaaaatgcagcgtgttgcactacctcttagtgttaacatagcattctgaaaataagaagattattgagtattgacactgctattagcatttgttgataatattatatgaatttctttctttctttttatcagtgtagatatttgcatcatctggactcaagactccattccattttgcagtggccttttgctttcaactcaatctcaagagtgtaattaacttggaaataaagacaggtgacttattggtaagcattatgtcctgcttttgcacttttcttgtttaattattaccatttgtttctccagttattttgtgcatttgactgttttagtggcttccatagtccctcatatttgtgttgcttgcgttctagtgtcccttacgttttatagtttggcattgtggaattataactctcgagcaccatttcaatgatatgccgctaaagtacttgtatgtgcagttctagactgtaaccagataatcctgctttaaaaaactaagttaaattgccataaaaaacaatgttctgattttaggttggttctaattttctattgagctacaatttggtattgtggggcttgttttgtttgataccaacttattgccctaccaaaattttggtaacttcaatagtagcaagtgcatgtttggtttgctaccaaattttacccgcatcagttcaaattcaatactacccaatttggtagtgccaaaacttgccaaggttttggcattaccaagattttgatagggcaaaattgattccaaaccaaacaagcccgtggtttatgagccctacaattaatacttaatgtaggaggatacctaacatgcaatctatttatacagttctactattttattggagaagaaccatgtaactatgtagtggtgaaggcagggagccaattgctatttgatagtgcaactacattacagaactcctcaaattaaactacttgaacatatactacataaattgatgttactaggctgttcagatttacctttggggatttctggttgagagttgtgtcataggaaaaactgtgggaagaggagctcatggaatgataaaggggatttaagtgtggtaggaagaagggaagaaaatggcatgagcgtaaatgaggggttttggatagggacatagttcggctgcaccatcatcgaatactatcactctttggtgcacataatactggcatatgctagtctgcaatggatatgcattttatggtaggaaggtgcgtgaatgtgagtggctgacactaaaatcttgggagggtgacagaaaaatattcacatatgactcgtagaaataagcaatgagaaaagaccttctagcagatatcacagcttgcatctttatgaaaactttaatctgctatttgagttgtgttatgccatacttctccagtagcacgaagatggtgttgagatatatttgacttgatattgctcagtggtcagcaccaatagaaacaaatattgcatactcctgatcctttccccaatcattatgccctttttgagtgcattaccagtcagacttaagtgcttgcatgatccataaaatctggttatattcatgtgtaggggccaatggactcccacttggccattcactttgtctattaaaagtcattataaatgatatgatgaattgcattgggtgcattgaaggctatagtatagtgcttgatgtgtgtcatctctctctaccaacagagaaaaacagagctaatgttcctttttaggcttatgtactctttgtttgctgccatgaaagccaaagtttgccaagggaaattttgttatcaccgcccaaatttggtctttgttttgatgccacatatcaggaaggttccgtacaaatggttttggttactctgtttagttcactcttgagttttgactccaaactaccaagatcaggacagcctttcatgcgcaattttagctttgaaaccaaatatacccttgatgcctcgagaagattggtctccctgatcaattggaactctttatgctattctcacccttttttctggcctcccatcacaatggctcattttgctcaaggtctgttgaatgcaacaacttaaaatcataatggaccatccacagatttttttttttcgtgtccatcaagaaatgaacagaagagtccgagtgataaccacaccaaaagacaggattgatctaaaccctaccaagcgctagctgagtaggatccagtacaataaagcaaccggagtttcataaacattaaagtgtgtttagcgtgtcaaaacgctaaacgtactttattgttgaaactgtcagtgctttgctggcctttgattctatgttacttctcgagaagacatgggctgttcatttcgtaccatgaggccccaaacctagaagcctagatgcatcgaacatgcagacttccattgttagatcgcatcagtattcacaccagagtcacgtgaaaaccagccttgtccgattaaattgattttagcactgttcgaggcccataaatcattttgtcattccttctgcactgcttatcttcttccttgtagattgctagttagttgccccaaaatccatgtagacatcactgcatcagatgctggtttcggtcgctttcatcagaaacaaaaaaaatgatcctttgctctttgaagtgttaaaaaatgcaataacattccagtctttacttaaacagatattcagggaggtaaagtagcccaaaacatgggataaaaagtgagctgaaacttctctgcaatccgagctgtatccattatcttatttggtagtggtaccgtggattgggggcttggaacaccacatgagatgttcttcttccttaggggagaagactgtgtcctcaagactgaaaagctttgtcaaccttttgggagcatgtgatggatgtcctctaaacacccagcttaaccatggcctacaaatacaatatttgatttcttattgtcatctgtcccagaaacatgcttgcaccggcatgcttcgtgttgcttctgtgtgaataccaaatttttgtcaaaaaaaaaaaagaagcaaagctttaaagcaatctatattccttattgctagtagctttgagcaaattgagctggacatcatcatcactcatagctcccccttaaacaatgttttgtttgcatcctatgcactcctagtagtgtacacgttgctttacttcatggttgttactcaccatctttctggaaaagcaaagcttcctttgtgtgcctgttactacttgttaacacaagttacactgtcaagttgcagatacatttttttttttactttgcatcatcttttgactgtcactgtgcccccttagctagatatctggacactgttggccattgatgctacatatcagattcaggtcagtatcagtataggtaggtggtatgccatcgacgagtagggttcttacgtccaaagggtgtgttaggaggtgtgctaccatcagccacatggataaattcctggaagaagccggaatgcatcaccatcagagtaccgagtgccaccaatgccatgataggatgaacccaagacgtgtagtactagttgcaccgtagcagcagcacatagcaaggccgtgtggttggcgatcgattgccgtgtgggtgtgcgcgtgtgtgcgccctgataatgcaccgactcttgcagaagaacaggagagttgcttggctgattccggttggaggatagtagtgatgattttccattaggatttaggaatcgtgcgccgactagtggactagtaatgcttcacggagaggagaagcagaagcagaagcagcagcatgggtggtgccggtgatgtaagtacgatacgctaagcatcctatcgcaagttcgaagcacctttgcaccgcgttttgtgaggccccacactaaaagaaatcatgtcatgtgccccccgtgtttgctttaatttgatgggcccttaggtccttttttttattaagatacatatttttatcttaattttaattcgagtactcctagctgctagacagtatatttcgtaaaaaactttctatatataagttactttaaaatatcaactaaatcaaaatttcaagtataaaataattaaaacataattaattgtatgctaatatatttttttcgtgtccacaccccatctttatatgctattttctcaaacggggccttaataagaaacttagaaacttgctcttcctatttctgctaaaatttgtactgtttgttcctttgagaaatccattactaattcatttctgtagaacatccagacaagaggttactgaaatgtagcataacgaatctt

SEQ ID NO: 74887 - DNA, 1394 bp, Oryza sativa
ttcctgcagcccgattatcaataaatatcaaaggaagtatgagagataggaagaaaagtattatgaagatgatggtggttttgatcctcattgggactgtgaattttttagattttgttggaatgaagggatgagattgccgtcaagagaagattgccgaggatgcagtgattctaataaaggtttcacggggagctcgagccgatcagaggaagctgcctgttcatcagagattgggtccgattcattaggattgttttcaggatgaaaatgagggcaggaattcacaatgttgtccttctggtattttcgccaagaatcaaaagagaagggtctagaggatgaggaacaaggagcgttttcaggaagtacagcaagagatcaatcatcggttgaaaaaggttggggcaaagcaagagtggcgtgttaagagtaaggtactaacggccgatgaagttgaagctgacaaggcaaagagactagctaaagggaaggctgttgcatcttcatcaataaacatggtttttgtgctacctgcagaatatgaagctaatcaggtcgatgtagatgttatggaagaaacttttactaagttggcgttgtcacctgaacaagctatttttgagaaaccagaggggacagagaatcggcatctcgagccattgtatgttaaggggtttgttaaaggtaggctgatgtccaaaatgatggttgatggtggggctgctgtaaatttaatgccttatgctcatcaaaactaatatggttcttaaagatttcggtggcaatccttcagaaaacaaaggagtgttgaatgtggtgttgacaatcggcagcaaaattgttcctaccacgttttttgtcatcgatgggaagggttcttatagtgtgttgcttggaaggaattggattcatgcgaattgttgtattccttcaaccatgcaccagagtttgattcaatggcaaggtaacaagatagaggttgtaccagccgactggtcagttaacgttgctagtgccgatttaactgtttgggagatggatggaattgattgccagtccggaaaaatttgggaaggaggttatctaaaagtgtccaattgtgatatacatccaattgaagacggagagcctcaattgttgctttgagggagggcgtcgtggagggttcaaatttctacaccaaggatactgtagatgatctcgatggcaaattaggacagggttttatgtcggccgatgatttagaagaagttgatataggtccaggagatagatcaaggccgactttcatcagcaagaatttatcatctgaatttagaaccaagttaataaagcttttgaaagaatacagagattgctttgcttgggaatattttgagatgccaggactt

SEQ ID NO: 74888 - DNA, 3660 bp, Oryza sativa
ttctttgttggtgagatcaatcagttagcgggggaatatgagtgcaagaatgatacattgataatctacaatgagaagttccgagaattgatgaatagttttcgggtggtgactttgaagcatgtctctcgggagcagaacattgaggctaatgatttggttcaaggggcataaggatacaaatagatgatgaaggatattgaggtcgaagttgctacgattatagccgatgattggacgtatgatgtgtttcagtatttaaaagatccttctcaatcggcttcaagaaaattacgatataaagctttgaaatatgccttgttggatgatgaattgtattatcggacgattgatggtgtgttgcttaaatgtttgagtgccgatcagggaaaggttgtaatgggagaagtacatgaaggcatctgtggtactcatcaatcggctcacaagatgaagtggttgcttcggcgagttggatatttttggccgacgatgttgaagatttcttccgacattataaaggttgtcaagattgccagaaattctgagcaatacaaagagcactagcgtcggctaagaatcctataatcaatccatggccgttcagaggttagggaattgatatgatcggccagatcaatccacctttaagcaaatgacataagtttatattggtgggaaccgattatttcacaaaatgggtggaggcagtcccattgaagaaggttgactctgggatgcgattcaatttgttaaagagcatattatataccgatttggtgttcctcagactatcacaaccgattagggatctatctttgtttccattgagtttgtccaatttgcagaaagcatggggattaagttgttaaattcttcaccatattatgcacaggctaatggataggctgaagcatctaacaaaagtttaattaaattgatcaaaaggaagatttctgatttccctccgcaatggcatacgaagttagctgaggcattgtggtcctatcggatggcttgtcatggatcaatccaagtcccaccttacaaacttgtttacgggcatgaagcagttttaccatgggaaagtgtcatcggctcgagaagaatagatttacaagatgaattaacagccgatgattattataatcttatggtagatgaaacagaagacttggttcaatccagattacgtgctttggaaaaagtgacaagggataaggaaagaatcgctcatcattataataagggagagttggtttggaaattgattttgccaataggaactcgtgataataaattcggcaattggtcgccgaattgggaaggaccttttcgaatctataaatttgtttctaagggagcttatatgttgcaagggctcaatggagaagtttttggaagagctctagatggaaagtacttgaaaaaatattatccaagtgtttggatcaattcatgatcggttcggttataccgatgcatgttagccgatgtgttgacatcgccttcagatggccgatataagttatatcgcccttcgaatttttattgttaccataatcggttgtgttatgcggatgtatgatggccgatataagttatatcgcccttagaatttttattgttatcataatcggttatgttgtaccgatgcatgttagccgatgtgttgacatcgcctttagatggccgatataagttatatcacccttagatttttatttttatcataatcggttgtgttatgccgatttatgatggccgatataagtcatatcgtctttagtcaagttataattttatcaatgtttactcagcattgcaaaattaagggggcatacatatatatgaaaatatgcgaattccaaaacaaaatatgtattcagttcaagttcagattacaatcactatgcacagataacttttaaccagatacaagcttgttaatagccgatatagctcgttgcccaatttgttctatgtcctctatggcctgagcgtcggttgcatcggtgtcatggttatggataccacatacctaatagaagttgactaaactcggcaggacccaccacataccacgtcttatacgagaacaaacctcgtggggagagaggacacacccaccacagacgcacaatacacaagccaatatataccaagacaagccgccggatatcaacatcacagattagtctagacataccccatccggctcttacggaggtcggcaagagggatctagcaccatttctgatctcgccgagtacggattcgaggaggaagactaccctgtcgtcgactacgagttggttatctagccaccaagtcgatgagagctagataggttatcaaaaatattgtatttgtgtgattcatatgaataaagagcaataccggcttcgaccaacaggatgttgggctattacctatcagataaggggctcgaacctatataaaaatccttgtctctatctcttttacctcaatctcgcatataccctggtaccgacgatccccataccatccaaataccgtagtcgtgatctcaaacgtcgacagtagcgtgccaggtagggggattttggtgtttcaagatttcgacgagatgggtttaagagacggactctccaacaacaagctactcgatgacttcgaaccagggagatacaacctggccagagtacgtcccccaatgagatcggaatcatcatcgtcaacaaatttgatctatcgagatcaatcaaggtgtcgcaagccttggactcacatgccgacgccgacaagaagctgcggcgcgcactggtgggcggcggagctagcaaggtcattgtggcgctcgtccttgcccttttcaggtcgccgggcagcgtgttctatccacagcaaggcactcttctacgcctattacgtgatcctgctcgccgttgccgtgttcggcgtggcggaggtggctgtcggctgctgggtctctgcttccccgagcgaccggcggcgaggcgtcgggaaggtggtcgtttgggcctctgtcatggcaatcgttgtcgtcgccggacttggatgtttcgccgtgcttaagtaatcaatcgtgcagcaagtaatcaatcgtgtagctgagttgggtgcctgcttgttcttgtcagtttaagctgcagtcgtttgcttaggaccaaacaccttcgggcgtcgccgccgccgtgctcgtgtgctcggtgccgccgctgtgctcgtgtgctcgtgcgccgggtggccgctgcgcttcgtcgtcattggcgatgggtccctagcggtgcgccgccgcttccccggcgtgcgttgctactcacccgcggagggaggaagaagaagaagggagaaagaaaagaaagagaggaggagagatggagagctgacatatgggcctaagggtatttttgacatttcacgcgatttctctctcctcctcaaccggaaatcattattttaatcggcacggtgtctattggcaaattaccacgtttatggagtgttttcccccaaaagtgagtttggacagtgtcccacggctaaaaccacacaataatagtgtcctgtagcaaaatttgcctttgctatttggagcgcatgcgccagaaacggaactggcacgcagcaactggcgcttcccatgggtttttt

SEQ ID NO: 74889 - DNA, 15846 bp, Oryza sativa
cctcccccctccccctcccttgtttatataaacccgaccgcaccctggcgccagccatgtcatcatcatccacccccaccggagcagcagccgacgatctcgccgccgccaacgccaacgccaaggagtgcgtgttctgcgagatgacgcggcagcaccacccgcaatgcgcgcggcggctcccgaagcggatcatcctggtgcgccacggcgagagccaggggaacctcgacatgtccgcctacaccaccacgcccgactaccgcatcccgctcaccccgctcggcgtcgaccaggcccgcgccgccgggaagggcatcctcgacgtcgtctcctccgccgccaactggaaggtctacttctacgtctccccctacgagcgcacccgcgccacgctccgcgagatcggcgccgccttcccccgccaccgcgtcatcggcgcccgcgaggagtgccgcgtccgcgagcaggacttcggcaacttccaggtcgaggagcgcatgcgcgccgtcaaggagacccgcgaccgcttcggccgcttcttcttccgcttccccgagggcgagtccgccgccgacgtcttcgaccgcgtcgccagtatgtccccatctcatttcaattcaattccattctcccattcttcttgcaattcaaaacgatttctgatgaaattcaatccaattcaattcttgttcaggtttcttggagtcgctgtggagggacatagacatggggaggctggagcaggacgcgagctgcgagaccaacctggtgatcgtctcccatggcctcacctcgcgggtcttcctcatgaagtggttcaagtggacggtggaccagttcgagcgcctcaacaacttcgacaactgcgagttcagggtcatgcagctcggccccgccggcgagtacagcctcctcatccaccacaccaaggaggagctccagcgctggggcctctccccggagatgatcgccgaccagcagtggcgcgcctccgccaaccgccgcagctgggccgacgagtgctcctccttcctcgccaccttcttcgaccactggaacgaagacgacaatgacgacgacgacgatggcaaggaggaaaatggcaagaccaacaagttgctcgagtaataatcttgctgcttgcctctacttgctctttctttagaaattccgtttaaaattctttggaatttgattcgattggtactactagtgtatttctccattggggcgatgcaatgtactcccctttgctgattcttttctgtttgatctgtagcctgttcatacatagttgctagatactacattgataaatactatatatgatttggggaaatgaagcaaacgatttgactatcaaaaggaatcattgcctatattctgataaacacataggataaatctcgagggtttgttctgaatctcattcctattacttgactgtcattaaaggggatctttgcctctcttctgtaactaaacacagccccttttgtttcacctaactttgtttaactactaataatagataggtcacattaattcgagcttttgttgacagtgatatatgagattatggatttctctgtgaaaaacactttacttttggggcaaatgcagcatgttgttagcagatcacctgggaaggccagatacgcctccatgctttcgttcaatttggttcttgttttccctgattattttactcctagatatggccatggcctctttactattttttgtcggggtgaccgaaggaggtcatccaatgtaattaagatggaggaaacctctttactattacaatgtgctttgtttagctaataaagataggtaatattttacatcttcggtttacaatttgtttttacaaggttatgtatttttgtcaaaaaaagggggggaacttagcatttcgtgtggttgcattcttcctttttgtgacgggagaaaaatggtagtatctgttattcatgtatagctagacacacactccagttttcacatgcatatgtcatcagaaacaggtgcaaatgcaaagattccttccttgctactagttggcatgttcatccttgactacacactatacatctagatgttgcaatttcgtgcagtgcactacaagtaggagtacttcttttctccctttttcttgttattttatcttttattttattttctaaaaaaatcagaagtactagaattgtggaaccacaaacagagcactgtccttcctggctggtccagcaaacttgcccatctgacaatctgagtactaggatccatgctccaaaatctctataggattgtccattccataggaatttgaaaggattggataggattcaatcctttgtttcaaagtgctttataggaaattttcctataggattgaaatcctccaaaattcctatgaatttcctttgaatcaaagttgattttagatatttccaatgtagttttattttcatcattagtttttaagtagctaagtttacgcgtaaaaaagttattttttaatcgttaataagtcattttgacttgtaatcaactcatgtccaactgatgggtccttcatgtcctgcaaagtgtgctgcagtatgaacttcagatgttcttctccttgtataagttcccatgaactgcatatgagcatatcagcagtctgaatattttttgagcaattggggcgagatccccaaatgctgggtgaggtgtagtcttgaccatcttttttttttcttctaaagatggatcaattcccatcagggcttggatttcattaataagcatgaaacttgctggtgatattttgttacatgatggcaattcaacagggcagtgacctacatgttgtacattggaatataagaacaacttgtcctgacatgtgtagattgcgcatctaatttcgctaatgtttgatcctttcagctgccatgaacatgcttcatcactcattcactccgatgtttaatattccctccagtattttatttcccatttttctaattctctgaagtcaaaggggtgccattttgattactactcactctgatcctatttactactctctccacgggaaagtattttctacacctagatattatgacaactaggtatatgcatatagtttaaatagctatataaaaattcataaaattgataagatactttatgataatataagatactatacaaacatacaggtttaaattcgatctatacataaaaaacaaaaacaacaaaattatttgcaatgtagaaggtatttcataatgtaaggcatggtcaaacttagtacggtctctaaaactaatctttgacttataatttctcgtatactataaagtttgtagcaacaaaattataaccatatgaaaatatattgaaataccaatttaatgttattattttcagcaaataaaatttaatttataatatactaatcattagtctttttttaaagttaaaccttaaaatgtgtacgtgttttacattatggaatggggcctaagtatttcgatataggggttgtaatttctttaaggatgattttttatttgcccatgtaaaatactctcttcatgtggatgtgtcacatccacccaaaatcctttatattatgggacgggagaagtgtacgtgaatcgttgttttcatgtaatgagtcaattagggatcgggtcaactttctagggtaaataaaatataatatttttttgtcccttcacatacagttgaatataatttaggccgagtttagttctgtcgaaactagatttcggcaataataaaaggaggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtaacccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctaaagtactgttcaggcctaggcccattagcacctccgatacccttaactgaaaaatccgatatccaagcgacgcttcgtcttccccgccggaactctcgccattttccccactccctgctacagtgcaaagctgcgccgacgaactagggttcacaactccggccaaatccacctccgaaaagtgcatcaaaatccttcccgtgatccaccgcctcaatccctcacctctcccaagccatccctcgaatcaaatcagcacatttgagtgaaaccgatggcggaagagagagaaagcttcgaaggccaatgggcgtcatccgacgtaacggaggagaatcttaaggagatggtggcgcacggcgttctccctgccaaggagatcatcaggtggcgaccagcgcacggtgaggctttcccgtctccggatactcatgagattgtggtcttctcgcatttcttctacggcggctttgctcttccgacctcaaaatttttccgcgggatcttgaacttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactggcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaactgccagttgtgccatataatgcattcaatccgcctccacaggtatgcatcggaaaccctcaaaccgtgatcagaacataattttatcttcatgcttagttgactaactatggaagcatcttgttcaggaatatgcattgatgaagtcagatctaccagtcactcagcaccggtctcctcgccaacacaccgctcagggaggtggagggccaacgatcagaccagatccgcaacctcagacctccaaattgactggtcaaacaggtcctcgcaagagaaagctagtacttgatgatgatgaaggcgacgatgataaatctggggataagggctcgcctaataaacccccaaaacgtaccatgcccaggaaaaaactagctggccgtgcaatgccaaagatcagaacatcttccaggtattagatctctcggtatgatttccgcttcggcatgttttccgatgaaaataatgctaaatactgaaagaacactctgcaggaaaccatctgatatagatccatctggaaaagaccccgatcctgccatgacagagcaaaatatatccaaggaccccgagccgactgctgaaaaccagccgactgctgaaagccagccgactggcgcccatgcttcgggcgatagggccaatccgagtgacctgccgccgactggaaaccagtcggcaacaactgaaacggcaacaactcaagagcccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtatatccgtctaatgtcttggaaacgcatcaggaccatcaggtgatgacggagaagaaatccctcgcataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgatccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgaactaagtggttcatcaaaaggtaatcacccagatctgttccattgatttatgctgtcataattgcatcctcaaccatctggatttcaaacagcgcaagccgccaggatggaacagatggcgaagcaaattgaagccctggagagagacaagacaggactggctgcgcaaagggactcagccttgaaggaagtcgaaggtaacgccggctaacaatctgagcttctctccttataatgcaacagatgctcatcataaatgtgttttgcagatcgcaagatcaaatctcaagctcagttcgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtatccgagaattgaagtcgacaccattgatggatttgcagacgggacaagtgaagaagctgcccttgatctcatcagcagtgcgcaaaatgcggctgacaaaattgtgagtgatgttgtagagcaatttcgcaacaacgacctccagccgagtaatgaagactctgatgatgaaaggactgattctgactgagtttgagtgtaatacatggaggctcaatttgtacaatactggtgtatttatgctgtgcttgatgattcttgcgaagtttttgatttcttaaaagtttttgctaaactttcttgagcctaaaacccaaagaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaatatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcataaggtttaagccggtcaaaaactcgagctttaatcctttgaagtatcatgccgttggccctctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtcgcgagcattatctgctgtgattgtgacaaccggtttagcttcaatccacttggagaatttatcaatggccataaagagatgcgtgtaaccgccaactgcctttttaaacgggccgaccatgtcaagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccaacaatggtgcgcgctgcagcatggtttccgcatatcccagaatgtatgtccttcagcaattgtctcccttcctctaaagatacgcagcgttgcagaattcctgaagggcttttcttgtataactcggcttcatgcataacataaagtttgctccgccttgaaatccgctcggcctcatctttgtattgagggagttcttgagaagtcaaaaatcgtatgaggggctctcgccagtcggcttcaaccatagctatgtcatgagtgtccgcaacttgagtagcatctttgtgaggtactgtcggcgaataaaggtgttcgacgaaaacatcagatggcgctgcctcgcgcttggatccaaagttggcaagtctgtcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcctcatactcggcgacgttgtgagacgccgaaaaatgtatccaaagtacataacttagtctttctccggtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattagaataccatataacagcttctgaacctgagggtacctcgttttggagtcagccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggatttaacttcatcctgaaggcgcggatgctcgcgaaggtttcttctagatccaagatcagatcatccttttgcttggtcttgacgactacgtcatccacataggcttcaacgttgcggccgatctgtgttgaaaagcatctctggatcatgcgttgataggttgctcccgcgttctttaatccaaacggcatggtgacgtagcagtatgccccaaaaggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcctgctgctaacagcttggtcaattcctccttgatcgcgtccttcctgtcttgtgcaaatcggcggagtcgttgtttaataggtttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtttcggcttcggtttccccactttttgaaatcttggcagcgggcacttctccttcgctcaccgtggttgcagccagtcggatttcctctcgggcagacgccatctcgcgggtttgggccatgtcgcaactttccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccgaaaatgtggttgagctccttgcggtggtcttgaaatccagccggggtgtcgccgtcgtccttcttccttgacgtgctttgtttctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttgcgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgccaaagccactggtaaataattcgccatggccttattgtctcctcctgctgcgcggattgcgagaccgtagacggtgagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgcatgatcgtgtcgcgaagatcgatggggcggcgacgaggcggtgaacgtggccgttctactcggcgctccccacggtagtcgggaggcgagtgcacggaccgctcgtcgtgacccctgctcctgcgattggatcctgcgccggtgatgctgaggcttggatgacggtagtcctgagatcggaagtgtggaactcggctaccagtcggcgtgtggacgctttcggagttaactggaaccgaggccgcaatcatggtcttggtctggttcaagatgttgatgacatgatcagattggttgtgctcgttttccttgaggggggtgtcgaggagggtgatcgcggcaaccgcattctgctgaggggtacggaaaaccggtatcccttcaacatcctgctggccgatgagatcacgcgctcggcgcccagcttccaaggttcgctgccgtcggtcttcagcctccttcgcgttccgctcgtgcacctgctgctcccgccgtagccgctcttgctcttgtgcttggcgctcctgctccagtcggcggcgctcgatctcgcaacgtgtttcggcttcccgggcttggcgctgctcctccgtttcattgtcggccataaagacgccgaagaaaagaggagtgcagttgtcttctaggcttccgtcgaagtcgtcaagatccgcgtcgtcgtagtagcgagaaccaaactcatcgtattccacgatttcggtgggacgtgagtcgacggtgggagagctgtagtagccatccagttggtccgtcgaaaccgtgccgagtggttggaggatgacgccgacttccctgaagctaggcgaaatcggtgttaagaccgacttccgcccaggcctacgggatggagacggcgtggcggtggagacggctgccgaatcgtcagggagctgcatcaagatcgatgggtaaggctcatcatcttgatctggcgttgttggagtagatgcgatctcggccgagtggtttgaagccgactcgatcgagatggtcttgaagtaactttctgccgcgtttgggaatccaaacgggactggaagtcgattatctcccgactggtctgattccgagtcaaggagagaaatcttgccgaagttgttggtgacgaagtcgaggctgccgaaccgaaacgtctgcccgggtggaaagacgaagtcgtcgatgccggtgacggaacccatcgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacaagttccaatctttttcttcaaactttcaactttttaatcacatcaaaacttttctatacacacaaacttctaacttttccgttacatcgttccaatttcaactaaacttccaattttagcgtgaactaaacacacccttagagaagtgtaaaagtgcaatgctttgttcgtaacaaatctacccctgccaccgccatgtataaaaaaaaaggagaaaaagatcatgcatatgatgcattgaacctacagaaagctagcaatctactccctccatctgaaaaaaagacaacctcctagtacaatgtctacatttgttctactaggaagggtcacatcccattttaagttatctttttttttggacggatggagtagacgcctcatgtgatggatctttgatcgacagaaacctgacattttcatatctgaaactgtagtcgacattctagcagagaccaaatctcctctccttaaaggcataatccttatgcatgatcactgcaccccaagtgatgctaccacagcacgcgcgcctccactgcacactccaccactccccaaattcacccccaatccatgcattttgcacatttgcattcttcctactcgatcgatcgcccatagtgcccttgccaccacgccttaacactgcattatttccaaattttatcttaattttatcacgcgcgccaccatcctcgaaagcaattaaaaaaacagagataaattttacagtcttgagaggtatgaaaatttt

SEQ ID NO: 74890 - DNA, 39164 bp, Oryza sativa
acacacgcgcccgtgaaaccgcgagagtcggctctgataccattttgtaacgtcccgccttcccccaggccaagcccgcttacgtctgatagctttcataggtcatagactaccctcacagaccaacacatgtcttttctgcacactttgtcctcactcgtgtgcacccgggaagaatttccgggtcggtcacccatcccaaattgctccacgccaagcacgcttaaccctggagctggagttctttggagattggcttccggaaaagaagttgcaacttgttgatatgagtattctattaatcctattaagccctagaccgggatgttacatgaatgtatataatcctactattaatatatatttcgatctaagtgatttatactgtctcggcaaggcgaccgatctatctcaatcatttgatttaagtatatatcgatataaggattatatatcattaatatctacagccgatcgagtagatttagttctggtttgcttattgatatttgtcgatcgatgtacacatgacaccggcttgaaataaatgatgtgtcatcggcacttagccgatcggctatcatttataggattaattgcggtttctttgttctatttcttgttgatttcaagatcaaatcaactagcacgctcatacatccgaaggcgagctttggacctgcactggagttaagcagatctcccaggcctcgtgttttctgtcaacagaacccaatacaagattaattaaaattcaaagtaaaaaataaaataatattcaaaattagaaaaattaaaagagagttcaagtaggaatacaattttgaaacaactgagattgaaaaaaaaagaacacaatacgatattaattaaaatttgaaaaaaataaattctgaaattagagcaagaaaaataagatttcaattaggaatacaatttataaataactaaattttttgataaaaataaagattattaaaataaaataccatctaaaatatatgacgagatatattaagtaacatgactataaaggagtagagtggtggcggttgatatgacatataaaaattgttaataaaacaccaaatagagtctaatgacgattaaaaggagagacgtcagggaggccgtgaagcaaacgaataagacggttgccgggacttctagaaagtaaaaaaaaataatttttagaatcacaatgacaataaagagtaggtgacagacgggctgtagatcagggacacagtgacatcgtttggtggcacttctaaaaattattaaaaataaaactacaagttcaatttttaaaggttcggaacttctgaaaagtaaaaaaaccaatgataatcatgttcgattttaaaatcaaaatgaaataaagaagggaggcagcgggcgagccgtagaggattacaatggcaaagccgctaacggtttggcgggacttttaaaaagtaaaaatgaacttaaaacgataattacgttcgatttttaaattctcaatgacaataaagagataagacagtagacgtgtcgtagaggagtataatagcaacgtttgacgggacatctagaaattataaaaatgaaacccaacgtgacaataaactctaaaaactataaaatccaatttttaaaggttccaataagaatgaatagaaatagtggtagatcgagcaatcaaataaagaagaagctgagacataaggggtagcaactagtgtgacttttaaaaactatattattagaaacacgatgatgataaggtttggtctttcaaattcttaagacaatgagatagatatttaataaattttaagtaaaatcatacttaaaaaaatatatgattttgtttgggtgctagccgcgcaattgtgcgggccacccagctagttatattattaagacagctcgaaaagaaggcaccacgttcgctgtaggggctaaaaattcccacattaatcggagaaaaagaaaacaaagaaaaggagagtctaagtagaagtataatctaaaaatagctgaaattcggaaataaaaataagcaatattgaaagaagtttccatataagaacccaatacgagattaaccaaaatttgaaataaaaataaaatacaatctaaaattagaaaaggaaatgagagtccaagtaggaatacaatttaaaaatagctgaaattcagaattaaaaaaagcaatattgaaagaagattccatataagaacccaatacgagattaatcaaaattcgaaataaaagtaaaaaaaatacaaaattagaaaaggaaaggagagtccaagtagaaatacaatttaaaaatagctgaaattcgaagtcaaaaataaggaatattaaaagaagagtccatataagaacccaatacgaaattaattaaaatttagaataaaaataaatccaaagttagcaaaagaaaataaaagaagagttcaagtaggaatacaatttaaaattagctgaaattcggaattaaaaataagcaatattgaaagaagaatccatataagaacccaatatgagattaattaaaattttaaataaaaaataaaataatatccaaaattagaaaaattaaaagagagttcaagtaggaatacaatgttgaaacaactgaaattgaaaattaaaaataaaaacattaaaagaacacaacacggtattaactaatttttttaaaaaaaataaattctgaaattagaaaaagaaaaataagatttcaattaggaatacaatttataaataactaaaatttgtgataaaaataaagactattgaaagaaaagaccatctaaaacacatgacgagataaattaagtaacaagcctataaaggagtagagtggtggcggttgatagttgatacgacatataaaaattgttaataaaatatcaaatagaatcctaatgacgattaaattgagagacgtcaagcagaccgtgaagcaaacaaataaggcggttgccgggacttctagaaagtaaaaaaaaaccattgatagtaatattcgatttttaaaatctcaatggcaataaaaatgagaagcggtgcgcggggtgcatataagtaactcaattttttgataaaaataaagattattgaaagaaaagaccatctaaaacacatgacgagataagttaagtaacaggcctgtaaaggagtagagtggtggcggttgatacgacatataaaaattgttaataaaacacaattgccgcaaaggaggaacgtcaggtaggccgcgaagcaaatgagtaaggcggttgccgggacttctagaaagtaaaaaaacaaaccccattgataatcatattcgatttttaaaatctcaatgacaataaaaaggagaagcagcgggtggggtgtataagagtatagttgcagagccgtcgacgggacttctagaaaataaaaaatgaattccaacgatagttatgttcgacttttagaatcacgaggacaataaagagtaggcggcggacgggttgtagaggggcatagtggcattgtttgatgggacttctcaaaattataaaaaatgaaactacaagtctaatttttaaaggttcggaacttctaaaaagtaaaaaaaacaatgataatcatgttcaattctaaaatctcaatgacaataaagaagggaggcagcgggcgagccgtagaggagtacaatggcaaagccgctgacggtttggtgggacttctagaaagtaaaaatgaaccaaaacgataattatgttcgatttttaaaatctcaatgacaataaagagatgagatagttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaacaatcccagctacctaaccgattgcccaacaagaaaatagcaatggttagccggggcactttcgtttttgccgtcctagtggcgctaccgatactgtcactccccgtctctggctacgagcagaactacactgccggcagacggagcaccatgtcgctgggcagaggctacggctggtcctccggcggcgcgacgtggtacggcggcccgcaaggcgacggcagcgaaggtaattaagtcgttgtcaagtggtagtatgaactgcatgcatgtgcgtatttgacctcaagtactcacgttgccatgttggttaattaatccaaatgcaggcggcgcgtgcggttaccagagcgccgtcgggcagcgcccgttctcgtcgatgatcgccgccggcgggccctccctcttcaagaatggcaaaggctgcggctcatgctaccaagtcagtagtgtatttgtatgttttaccagtcaaatgcatgggacgtggagcattcctaactaaattagatgtacagattaagtgcaccggcaaccgggcgtgctccggccgcccagtgaccgtcgtgatcaccgactcctgccctggaggggtatgcctgaacgaggcggcgcacttcgacatgagcggcaccgccttcggcgccatggccaaccgtggcatgggcgaccgcctccgctccgccggagtcctcaagatccagtataagaggtgccccgccattgaatttgcaaaattatttctggagttctggtccactctgcaatgtacaagtgcagatttttactgaatttttacttttgcctgcagggtgccgtgcaggtttgccatgaacgtggccttcaaggtggacgcgggctccaacccgtactacctcgccatcctggtccagtacgcgaacggcgacggcgacctcgccgcggtgcacatcatggaggcccgcggcggcggcgggtggaaggcgatgcagcagtcgtggggcgccacctggcgcctcaactccaacaccgggaagccgctgagcccgccgttctcgatccggctcacctcgggctccggcaaggtgctcgtcgccaacaacgtcatcccctccgggtggcaggccgggttgacctaccgatccaccgtgaactacgccgcctaatgcggcggcgtcgtgcgcgactacgtacgcgcgtgtttgttaacgtcgccgcgatagatccatcgcgaggcagaagctcgcctcgtcgaagtgagttcggtgtgtgcgcgtccgggaatcgtgcgcagccgcggtaaaagaggagttcgatctgttagtgttaagtgttcgtgatgtgtgttctccctccgtggccgtttgcagagctgcttctagtgacgtctcttgcttggttataacttaaccgaattctgcgttgcgatttgcacttgtataattgcgttgacatggttggagacatcccgggcctgccccaaccggcaaccgtagctcggttttgacgagcccggccgtgtgacggcctctattcttgctctgttttagctaccggcataatcgtatgcagtaagcgatttcttattttccaacgtccatatatatacatgatacgtcttctgttctctgccgaatcagcttacgtcaatctatacgccgtgatctgactttgccgagatggcaaccgccgaaccggatactacatatacctctcgttggccacaaataagggcaacgacaccagtagttgcgatccaagtcggggaaggcccacgcgctagtcattctaagaataagtccattttccatccctcaagtttacaccgagtctacatgacacccataatctccaataccagaaattatttctgaccccctcaaaccttcaaaaccgtgaaaaattggttccatgaaaatatagaccatatttcccattgtttttgttgacgtggcatacggtggggcctacttgtcagtgtgtcgtcagtgccgttgtttgacaaatcaacagcaaagaccagtttccggcgagcacgaggctgcaggagctggcactggtggacaactggccctccggcgagctgccggggttgttcggctgcctctctccctccttcctcctctcttccccttgttctcggcctctcctcccaaaccaggtgaggctagctgagcgacgcagcgacggagatggcgaggtgagcggctcggagatgagggacggacaaatggtgaggtgagcggcgcggcaacagagatgatgatgaatggcggaagaggcgtgatgtggtggtggcagccgctgctgtagccacggcagcgagaaaagtggggtggaggtcgaggcggatcagggacgatttcttcgagggccttcgaccgcccgccgccgtctccactcgccgaaggagagtgcacatcatccacatctccccctctcccaagtctgcacactaagaccacttgagacgatggttgtgcccgtcgagggctggcggctggaatagctcgctggggaggaggttgtccgacaggttgagaaggtggcgggtcatgagctacatgcggtgagacagagagggggaggttgtcagctcagcttccatgtgaggggactggaggcgggaaaggggcgacgtggccgacgagccccactgagcttgagcttgctcggcattggtgcaagggaggtggaggtgggagagggaaggggagactaccggtgagcccctccgcgggggctcctcaatcgactgcagcaggtgctcctctctctttccctcatctcccagtgacaccaacgacaccctgacaagtgggacctccatatgccatgtcaacaaaaaagggggaaaatgatctataccgtcatgggaccaactttgcacggttttgaagactaggatcaagatatctggtattgagggttagggatatcatacaaactcggtgcaaagttgagggatgacaaatggacttgttcctctattctaatacgaagccttctccattccgaaacagcgctattacttgagcccagaagacccaagttgagaaaaagcccaacacatcagcaccccgtccctccgccccttctgtctccaatggcagccgcgccgccgttgtggccccagtcgtccaatccctccacggctccacctctgtgccttccgtgctccggcccagctcaatcgtacatcattgcagctccacgcttgagatggcatccccatgtgtcgacgtttgatagtcacgactagggtatttggatggtatggggatcgttggtatcagggtatgtgcgagattaagataaaagagatggagacatgaatttttatacaggttcgggcctcttatctgacaggtaataaccctacatcctgttagccgaaaccagtgttgctctttatttatctggatcacacaaatacaatatttgggataacctatatagctgccatcgtcttggcttatgtgtatgttatgtcttgtggctttgtggcgtgtccccttttctcctaggggggcttgtatttatacccataagtgcccccttgtccaagtaagattaaggagataaatatggatacaatccgagtagtccttcccgttttcatatagaactctatttattcttccttatccggaactctttttatatacgaggtttgtttccgtataagacatgatatgtggtgggtcctgccgagtttagtcaactactattagatatgtggtatccataaccatgacaccatgacaccatggatgttacatatcttcgttgaaccatagcttttgttattatgcttagtcctttatatgatgtgatcgttcatgaactttttgaggaatgtaaaagagtaaatatgcattaccggtatacggacttaagttagtgtattaacttataatacgtttgttttgggtctgatacgtctagacaagttgtttgttttggtgaataaacctttttattgtgtaccagacaatttcattcaccaaacatgcacttgcttgaaactagcttatcccttcattccaaaatataagcatttttagagttggacacggttattaagaaagttggtagaattaaatgggggagtgctctgactggagaataagtggagatatgtgagaaaattgaatagtggaggttgtgattggttgaaaggagaatgttaatgaagaaattattatattttaggacaaattctaaagactaaaagttgttatatttttggacgaaggaagtacttgataaatacgtattctatttgcaaaaatagtgtaaatcacttatatactgaaaacctgaaaattatcgttggattaaaataaaatggacataagattcgtccacgtgcgcgtgaacaaatcttaggcgtccatttttaatctaacggtagttttgaggtttcaattatatatgtggtttctgctacgtattatgacaacccccccccccccccccccaggctgtcactctgctctctaacattactctgtcccgttcagatgatctttgtcctggtcaccgtaagcaagtgaagagcagaatgtaaaacatgcttcaatgaaaaaaataataaatctcgcaaaactatatattggtatacattaaccaaactatcgaaaaaaatgtaattttaagacgttgaattacaaaactttagatttatcactaaagttatcccaaaccaaaagtatcaaaaaatacagatttagcaacaaaattatcctaaaactacaagtttagcatcatattaatcacaaaactataacatttatagttcaactataaaatatataattttatgttaactttaatattaaatctatagctttttatgtactttaaatatgtggttttgtgatatggtgccttaaatttataattttggatagtttagttaaaacacctatagtttcatgaaatttatttttaaaaattctctagtaaacacatgcctcaatttgtttaccatccgctcgcatgagcactgtcgcaagccatggccgattgattcgatgtcccagagtggaatctcttggcaaagatcatgctgtacattatcacgcctgacaataataaacaaaagctacttgtccagtgggagagaaataccaatatccaatcaagatcaggagttcaaaaaaaaaatctaagatcaggggcatgataactttgatcattattatcagaaagcaaagcaaagttctgctttattcctgcaagctttatgtgcgtgcatataccaaccagacatctctttccaaaaaatgatcctcacaaatgaaataaattaacctttggcaactttaattattttcgatgaagcagcttattgcaacctaacctcatcattctgcaagtagtactgatgatgaagaaaaactatcagcagatccatttttatatcctctctggatcttcatgtcaacacctcgatgccgctgtcctatgagtacccaagaacagtattcccactgatcatccaacctactaaaatagtgcaaatctgtcggcagaaagggccactcctctccagcaactccaagaaccggttgttacaacgccgcggccattgtcgtctcctgcatccatcggtcgcttcgacgtcttaacagaagttcccattaccatcataaactagcttatcaaccggcaaggcaagactaaaaagatcagaggcatctgttcttcacttgcccacaagccacgcgtctcgccgtgacacaagacgccgtacctgaacagcaggtagcacgtacgcgggaaaagtctcgcatagttaaatgtgtacgggttcgccgggcaccgacgcgataattcgccactcgcgcttgtttttccctcataaatccagcctcgtcgatcacggatgccgcccccaaccgcagtagtgcagtaccagccatcaatcagatctgcccctggatgcatttgtcgtccgcttgatcataaataagctcgggtgatcgggtcaggggcctcaatggaaggtgcctgaaggcttcatctccgtgtctcgatttgttttagctccagtttgcgtgtacgtgctgagtttttttatgccgatatcttttgtttctttgctccttcctcgtgtcgccttcagctgttcagttccgccattgttaatagcttctttttgcccccacgcttgcctccctctggtgtataaagtgtctgcatttgcaagagttctctgtgtacttgtgtagcataggttttgtgaagaaccaagcttttgccattgaattcttcaggagatggcgtccactgagttagcgtcggatgtgtacgcgctcccgtgcggcgacgacggcacgacggcgctgtcgacgccggtggtcgtgtcggtcctcgcgtcgctgctggagcggcacatcgcccggaacgagagggaccaggcggcggcggcggacggcgaggccgcgaggagggcgcgcgccttcgacagcggcacggtgctggacatgagccttcacgcgttcctggagcggttctcccggtacgcgaacgtctcgccgcaggtgtacgtcgtggcgtacgcgtacctggaccggcttcgccgcggcgacggcgtgcgcgtcgtgtcggccaacgcccagcggctgctcaccacagccatcctcgtcgcctccaagttcgtcgaggaccggaactacaagaactcgtacttcgccgcggtgggcgggctgaccgccgcggaactgagctcgctggagctggacttcctcttcctgatgcagttcaggctcaacgtgagcgtcagcgtgttccagagctactgccggcacctggagagggaggtgagctacggcggcgggtaccaggtggagaggtgcctcaagaaggccctcgtctgctccggcgaggcgcaggcgcagcagaggcaagcggcgtcggcggcagcccagtagacgtcagctccggagccgccattcgcgcgtgatctgccagttgcccgccacaggcggccggcacagcagccgcacgatttgatcgccggcagctgccactcgagtgcccagaaagatcaaggatgtaaatagttatggtttgctcgtgtacttaggataggagtaagaattgtgcaatgcaattgttcctctctacctcgattggtaaaagaactgatgcggggacaagtaaaattgattttctttcatgttgtcacgaccgatcaactttgctttccggcaaatcaagtctttaaaacgctaacggaatcgatagcgacaaggtagcgagattacatcaaatcaactccagtagggaccaaatatgactaccaattaacactttaccttaactcatggtccatgccaatgggcgaacatagcacgcaaaattttctctgttgcgatatgcgaatgcgttgtcggtgcacattaaaaacttttcggataataagagttatttttaatgaattactcgacgcagcacagcttgcaagctgcagcaactcggccgcccccacggcagcgtacgtacgcggcggcccatacggtacgggaaagggttctgtgcaggtgcaggatctgatttctggcaacgcggatgcccctggtccatggaccatggctgagtgaggagaggactgaggtccttgtcagcattccatggcagcatcttgtgacggaaataatttacccacagactagagcgatgacaaagctttgcccgttcttggagggcaccagtgaccagacactatatctgacgagatgaaattgcccagatgcaggaaactacgtggagtacatgaggaacatttcaggcgagtagctctgggcagctgacggggagtcggtgtgggggaataggatgagcgtgcgacggcgacggcaaagaatagaatcgaggcagcgggacgaatggaatggccgatcagctgcgctgtctcggcccacattcggaggcacgtcggctgtgaatctgtgattggaataagttggtcccttaattttcaaaattcgtcccttgaccataaaatcaggtacaatgcatcatccaacttacaaaaccagtacaaacgagatccctcagtgatactatccccggcttcgactgacgtgacgcctacatggttcatttgactactacgtctcacgtgacgttggcatgatgcttacgtgacaatttaatatgggtaataaaaaaaagcatgagcccacatgttagttacaccacaaaacaattaaaaatgatggggcccatgtgggccccaaatgtcatccgcgctcctccggtccacccttttgccctctcccctctctctcctctctctattcttactcatcctcactcctcccttcttccatctcccctctcttcatcatctcttccaaggtggcggacgggggtgggggtgggggtgggcagcgaggagaatggcggagcaggcaagcgaggcaggtggcggacggagctaaccgatggtgggcggcgacctcaccggtgccttccctcttcgaccgtgcctccaaggccaccacgctcctggtgctcgtggtgctcttccgcattatgacccccaagtgcgtagactagaagtggattccgccggttttcttcttcatttgttgtctctctgttacttccaaagaccaaacaaaacatgggtaggaaagagaagaggagagaggggaaaatttgggagccctagatttcgacaggttggctatagtgagggggagtggatgtattggcgcgcggatctggtgggtgcaagaggttgggtggggcggtgagatctatgtggcagggaggagacgagaggaggaggaggggagaagggtgagaggagaggggaggcggttgagttgtcgttgtccgcggactccgtggtggtgatcgtggtaattgtggcggtggtggggcatgtgctcatggcatggtggaagttgaggtgcgacgcggttttggagggaaggaggtgtggcggctcacgcggctggcctaggagccacaggaggagtcggagttggtggaaatgaagttggcgcatgtgtactagtcagagctgttcccgagcacagtgcacgccgcggaaatatggatgaggctttgtgggcgttgccaacggtggtcatcttcagctcctctgcgccacccactaccgctatgcccttctccttgcagtgtaggggaaggagagaggggatagggagaagagggaggagtgacgataacacgtggggtcacatgggcctcaactttttttttattatcttgtgtgtagctgacatgtgggtcccacgtcttttaatttttacagaatcaaattgccacataagcgccacgtcaatgttacgtgggataaagaccttgtcaaaggagccacgtatgtgtcacgtcagttaaaactgaggacaataccaccgagggatctcgtttgtattggttttatatgttggggatgcgttctactcagttttgcgctcaagggactaattttggactcggcgactgagggactcaaagtgaacttattcctctgtaattcatgttgcgcgttcgtgtgaatacagtcccggcccaactaattgcggcagatgggaatcccgttccggcccatgtagttgggcacgtgtgtggggatccagttacagcccaactcgtgttgacggacctggcggtgcgttacttgcccggtcgattgatcagcaggttgacgcaggatggcgaaaggagccgaaaattccccgggaaggccttattttagaatcgccaaacaaggggagggtggtaatcgtaagaatttggatcgctgccacttattgcaatccaacatacggcgctctctggaaacttccgaaacaagagtgtacaatctcatctaaaaaaatgtgcgatctagagtatagcagccgtcgcatattcagacggatttgctattcagatgtgcatacgcgaatgatacttacatgattatcatttttaaaattacgaccaaaatttgctactccctcctttccatattataagtcatttgattaatattatcaaaatacattcaatgttaaatttaacaaaattaattttagattctgcaatccgaaggagccccaaggtacactagtgcacgtgcgctgttgttaaaaaactaacaactccaatcctacatatatgtcaaatggcatccgttggacgaacatgattcgtgggctggtcccttgactttcagattcagagatatgtagcttattatcaccggcacgtgtcactcctaggcgttgtcaaacgtcactagctaaagcggccgatgcaccgcgaaacacgcctatgagaactatatatgtctatggacgtgcagtagtgacgaagtttttaaatttggatggctgttttggaccttcaggttcaggagaactcgcggcattgctgcgatcgtgagttcgtgacaccggacggaggcgcgcacttgatcggcgctcccatctccaggtcgaattcgattccgccgcggcgaaccaagcgcatgcatgtgtgaatcttcaccgtctttggtacttagtcgattatcacatatatatatgtctcgcaccgaaagttgatttgatttttcgtcgagacatgttgacattgtgattttccatacaacgattgcatcttcttgagcatcatggccagatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaacgccgcagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtctgccatcgactgttcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggcttagcgatctcaaggacgtgagcatggcaggggagacgacaccgtggctgcaagtcggcattggctcctcgtctcgcgggggtgctgatgataacgacaaggagtgattgatctgcgaattgatcagtacatacatatatactgttacattatttccatgcgtttgcaattgcatatatgttgttcgcatgagcatataagtatttgccttcttttttgtgactttttcttttcttttagacttgtaggtttttttttcttctcaagatagtgagtatgttttacaaagaggtaacatatgaatttgggaagaggcagtagacttgtaggatttttttttcttctgaagagaagcaagtagtgagtattttttcacaagaggtaatgtattaatctgtcaagctgcgtgaccagaaatttttttaaaaaatagttgcttctcttgttttttcacaagaggtaatgcattaatctgttaagttgtatgaccagaaaatttaggtaatgtattaatctgttaagttgtatgaccagaaaatttttaaagaaatagttgcttctcttgttttttcacacaagataatgtattaatctgttaagttgtatgaccagaaaattttaaagttatagttgtttctcttgtttcttctcgagagaagcaagtattgagtatttttcacaaaagaggtaatatatgaatttaatctgttaagttgtatgaccagaaaattttaaagaaataggtgcttctcttgtttcttctcaagagaagcaagtattgagtatttttttcacaaaagaggtaaatactagaaaattggtgcgccgttagcacaccatccatatagcaaaccatattaatactacatatactgtttattgttatttgtaaaagcgtaaaattttaaagagatattttagcagtttttaattttatgcctacaagtctgagtaaacattatatttgtaaatatttaaattacagaggaaaaaatgatgtcaaatatatgttggttgatggtcgatttaattattattaataagataaggctaaaaggtgaagccttatatgaaaattgtttgggactatactaattgagaaaatcccttatatacccctgaaattttacctaatctcttctatacccctgaattttgcttacttccttgtatacccccaaaatttgattttgatcccttgcatacccctcccatcagttgaccgttagttgaccgtctattttccataaaaatgaccattttacccttggatgaacaaagaaattcatgaattacattattaaaaatataaaagcttctcgcatgagactattatagttatgagtttgttgtgcgatgcattatttatcccaaaaatatttttagatcatgaaataaaaaacacgtatttatttttttaaaaaaagtcataaaaatgaggagcattcatataaagataggactaccaatgttcacaacattttttttatgaatgctcccgataaaaaaatccattgtcctattaaaatttgaaataaaaattttaatttattacatttattttattttcaaaatttatgtcaaaattttctgcactaattatttagtttcattagtcttataaaatgcacatactgtgcacccaaacaaaattttttcaattgttttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaagggattgagtgagttttcaggggtacacagggaatttactcataataactagaggtttcttataatagcactaacagttggaattgtttttttaactggttatgaaaaaaaagggaaatgattttttctttttcttcttcccatatttttattttctttcagcctaagtataacattctaaattctctttatttattttacttttacattattaaatcctcgatggttaaaaatcttatcatttgtatctctaccgcgctctctgttttttccaaatatttgcttatcttctcagtagtcgaaaatagtcatgactcatgactacgagaggaccacatagttcacacactatttgaagagccacatgtgaatggagagggacacgcctccatatcttctattgcgagtagtacaccatttagatgtcacaattcgtagcctcatatgtataattcggaaaactatagctataccacctctcttagggcgttcgtagtgcaagaccctcctcaaagtatcacgtaggatgagttagcatatctcaaatttgtttatcctataatgcaaagtaactctagagatattcttgatttttcatgccgggccctcatatttcttactttagttcttatgtttttcaaatttatagaatagtccaacattacactaaataccctaaaaattagaaacaaatatacaaatctcacctccctatcctttcccaattccctgcttccatatcctagaaaattggcgcaccatcggcacaccaacttatagctggatatatttactcatttagaaaaattattgttgttgttgtctagagtttcaaatgcagtagatttacaagaacctatttaatgaattttgaaaagactgaggaacgattaacttatagtaataaccatatttatgtaaagatttaagcgttgtaaaagaattaatacataaagcaaaattatgtataaaaattatgtatagtacttgcctatttgctttcaaacctttgtttttctcttccattagacagagtaattaacacctattattaattggtaagattagatcattagtggaccgaaaactaaaggatatattttttgacaagtctctctaagagaaatttcttctgctaacataccagtgtcacctactcctctctgtagtctcatatacgatactccctccatcttaaaaataatacaagctaatcataggtacaatcgaacatagttagagcaatattatcaacaaatagagtaatatggttaattagtgtatgcatggctaattaattcttctctaccacatttagatagccgtacttctctgctgtatattataattcaacttgaaaaaagttttgctaatgaaagattaacttgtttaagcgtctataagtacctttggacaaatactttggaagatgtgtcttttgaattagtataatttacagaatttgttaacctataggaaaattacgaaatttatgtaaggcataattttttaggctaatgactctaattgtcagcttaatatccaaagccagtctttgtattaaaagattactctttgtattaaaagttaaaaccagtcttaaaaagttaaagcatcaaaggtcttggaaatcaatatgtgactatgtgagtactgacatagtttgtgcgtataaatacacgtgaagaaccatgttatattttaatttttctagagacttcggaagggttacatatccaacttctatcttaatttttctagagacttcggaagggttacatatccaacttcttcacaagggttaggcaaggtgatttattgactcctgacttttcctgagagttaagtggacagaagaatgcagtttaattatgtatacgggaggacacgtggcataatttcagagtagccctggaaaattttgtagagtgccacgtgggccaatggcagcctggatgctgcaccctgaaatcgttatttaagatatgaatttttgaagctgtatgcctgcatgaccagaaaatagaaaatcaaaaatttccgttgccgggactcgaacccgggtctctcgggtgagagccgagtatcctaaccagctagactacaacgaatttatccgtcgatgtgtaaaaaggtctttcacatcacctagttttactttccctcacgtcaaactaccgaatatatttaccgttcttatatcagtagctatatttatgacgccatatttttcaccaaaaaatagtcgatatgtatttacatcgtaagttcttaaattacatatgtaattttagtgtatttataatgtaagtctcaaaattacatatgtaagtcccaaaattacatatgtaattttagtgtatttacaatgtaagtttcaaaattgtatatgtaagtcataaaatagtatgtaattatagtgtaattagtatgtaatcgtctatcatcacgcgatatatgtgtgaaaataatcttctctctcatggaagcacatgcagtgggaagcctgtgcggctgtgtgaccaataggcatgtataccgactgtaatcaacgaaaatttatggcgacataaatgtagcaaatccgtctcaaaaagaccaagtaaacatgtaggaatatcataaaccctctttaacgaaactttccgaaccaacccggcattaaaggggacaacaaagctatggctgtgttttcacaccaaaactaaaagtttggttgaaattggaatgatgtgacggaaaaattggaattttgtgtgtgtaggaaagttttgatgtgatgaaaaagttggaattttgaaaaaaaaattacaactaaacacggcctatatgtttgatcctttttcgttttctacacgatgcactacaggtctacagcaaatgcatcagcattcggtagcttcttcttcgcttcgttcatcggtttacgtgtcgaacagccagctagctgctcacaattaagcttgatggcgcacgcggctctcgtcagctggcgagcgccggcgcatgcgatgcgaggctgccgagcgagacgacgacggcggaaacgacgggggcttcgcttcgttcggcgcttgactcggatcgctccactccccaattcgagcgcgaggcaggcagccaccgggacgcgacgctgacttcttccgtaatcctttctgacccaatcccgttcgtcctcgcctgacgcgctcccgtccatccagccttgctgaatccaaggagttgtgcgagtggacattactgcacgctagccctctcgtagccctcgcggcttccgttctttaccccgctccgctccgctgcacgcacgaacgcacgctcgttttgaaagcgcgagaggacaagacggccatgcgcgccggagagcaacgtgtggttttcatcgccatcgcatcgcgcgtcttgttcctggactggagtaccatctaaacagttccgttgcacggaaagctttggtcctctggatcctcgacgcgactgcaagtgaagttcacagggtaggacaatgaccggagtactggaccgaatcgcggatttgtactcgttccttcgattttcgttttctccatgaaagaaaaaaagacatcgtggcacacaccattgtggaatagtaacataggaagacactaaccctttgcttccactgattgccaagccactgcattttacaggagaatacaaatctgcttcacctgcaggcccaaggaaaggaaaaggagaacactgcatgttttgtaagtattcagagctaatcacttcgatatcatatcatgaattcgggatgatgattccaatgaatactcccaaaggttggagatagggatcaagagcagaacaaggacagcaccaagatgacagaaaagaaaaaagaaggtgacagatagggggaaaaacttcacactccagtagagtatacgagaggaggagcgaagcaagaaaccaacacacgcctatgatctcatcgcctgccacgctgcctagtgttcagaacggaattgaagccagccagccgatcccccttgacttgtaccgtatctgtacgctgtactagtacagtactgacagtaccagctacaaagtgaaatggaaatttggaaattacctaccgaagtccaaacacgcacacacacagaaacacacagaaacacacaaacacaatgaacaccatgcatcggcagcacagtagcatgctactaacatgacagccgtagcaagcataacaaatgcttgatcaacaatgatgctggatacttggtcgctacttgatggtagtactaaatatgatcctgagtggctagctcgctagctggtaggtgtttattcggggtgaatggccatcatgtacataaatcgggggcgcacctaatgcgtacccatcataaccagagagatccctaaagcggttagttggaaaggctagctctcgcagatgctttgcttgcttgcctgctaagtgctaagctctcaacgagcatgcagcagctggtgcatatgcatgcctggtggttaaaattggcaggaagataatgtgaaggggaggccaggagtaattccagggagattaagaacaagatgaggctggatttggatgggcataattctgagagatccgctgatgagatgcatgcatgctggccgggcactcggtcaggctttgtgggtaagcaactaacgtgctgctaataagggattaatcgttgcctaaaccgtatcgagatcttttgttcccaccatacccagatcttaatttaatgagaaaggtataaaaacagtggtgcattgtaagtgactcttgtgatttagaccccggctgattaatctgccacttattactatcactgattccccaagccacactccaccctgtgttcgctttgttctcactggtctacccatcttcccaaccttcttgtcacctactctttgttcccatctcattctgagccctctattcagacatatctcacccaacttactgaacgcctgagctgcaccaaggtgtggcctttggatgatcaggatataaaaatggtggtttaacaaggcaaagctatattaaggagatccatcaaaagggcaatttgacagccatgaagtgtagtggcatcttccaaggcgggtaattttcagagctattgcattgagtacagcagcatcccacagtacattccctcgcatagaaagccatatggcacgtatgcaaaagccatttctgtatggtagcaaataaagatttttaattaggactaatctgatcaccaaaatagccaccatctcagcaatacaaccgctactgctaaaaactacgcactggaccacatgatggtacatggcaaaacattagactcatttcatcgaaaagaacaataggctcattcctttcatccgtactaacaattaactacaagcatcagtccgaaatcttccatacggttgggcttggttctacacgagcagtaaaagaaatgctgcaaatacaaccagtcaagaatacaatgagtcacccagaaaaaaaggggggaaataaaaggaaaacaataaacgagaggaagctggcagttccgctctattctaactccccacggaagcagcgctttcatctctctccgtttcctctgaaagctcgtatttttagctctcctaagctctgtgcctcatcaagctctatccaagctctcgccatggccaagaacacatgcaagctctgctaccgccgcttcggcaacccccgcgccctcgccggccacatgcgctcccactcagtcgccgcctcgaggtcgcagatctcctcgacgtcctccgcgtccacatccgtcgcggtcggcgacgacgacggcggcggtgatgccaagaggcccatccagggatacgtgctgcgggagaagcccaagcggagggtccgcctcgccgagtccgacttctcggatcgcgagagcgagacggagtactactcctcgccgcctcacggcaagcgcgcgaacaccggatcgggcgatgtcgagcaggtgagctcggtgtccgacgccacgtcggaggaggacgtagcgctgtccctcatgatgctctcccgcgacacctggccagccacgccgccgccgccgccgccctaccgtctccgcggcgcaggctacgacgacgggagcgacggtggcgacgcacctccggctccggccgcagcggccgcgcagaagcggacgcggttccagtgccccgcatgcaagaaggtgttccgatcgtaccaggccctcggcggccatcgcgctagccacatgcgcggcggcaggggcggctgctgcgcgcctccgcctaaccctcctccttctcccgctacgcctctccagccattgccggagtgcgacggcggcgaggaggagggcgcgaagccgcatccgcacgagtgcccctactgcttccgcgtgttcgcgtccggccaagctctgggcggccacaagcggtcccagctgtgctcagccgcggcggcggccgcatcgggcgacgatattccagccatgattaaaagcaacggcttcattgatctgaacctcccggcgccgttcgacgacgtggagctctccgccgtttcagatcctttcctctcctcgaagccaggttcttgaaagcaagcagagcatgagagagcgagcatactggctgttcagtgctctctctcctttcggttgattccaaagaagatggttagagctatggattcgagagaaagagctgcttaaccaggcagccgaaaaggtaaagaaaatatcataaaaaggagacatctttgctttggtagttttttttttctcagttgttttgttcattcagctacaaaaattgcttgatgctgtcctccattctgttctgtctttttgtttgtttcaagctacccgaacagtgtacattggggcaactagcagagcttagcatcttgcttacttcttgatcataatctagcatgaaaatattccaccgaaaaacagagagagccacaggagaaaaattatagctgaactgttgctttctgttgcagtctccagctgttcttgttccaattgtccatggtacgggatttggccaaacaataggcgagatagtaagcagtgtagtagaaaagaaaagcaacaaaatggcagtaccaatgcaggatcagcctagtagtccctagtgtgttcatggttgcatccacatgcagggtgcagcaacagcggcattctgctcctgctttctctcctccctgcttccactgcccaccaccacgaccacctgcctgcccggtttggctgctgcatatgccgccgtgacggcgtccccccttcccttctcacgctaggagcaaagcagaaaagaaagcctcgtactttgcctagtccattttgtccgtctcttgcttggctgctgctccgttcattcctctcactgtgcgatgggccccacttgtccggcgcaaacatatgcgctggatcctaacaaatcgtctgtctaatgcaacagaattgctgttcctaaactaagcatgcagcactgagaaaaaaaaatgtagaacttttagttgtttaaaaatgcttgggagaattagttggatctcgatggacagtttgtgtggtttcggcagcaaaactggagctcgattttgcaggagctgctctcctcgtttggtgggcaggtagttataagcatggcccacgtctcgcgtccacgtggcaccgttcttttctcctcgctgggcccacctggattgcatcggcgtgtcagtggccactgactttgcgcggtgtgggcgttactgacccagggtgggattagcacgacaattaacgcagttaatcaggggttaattctcggttaatgagtctggccatcgtacttctctcccctgtggaagctgtgtgggcacgcatcccgaggcggatctcccggcgtaatcggttggtccacaccgagcagcaggacgggacaaggtattgatacgttggcccgaccttgtgctgtccccccgtgtccgtgtggccgtagcgcggggcgcgcctggacgaaggcagtggggtttgctcatttgctgtctcacgtggcgacacgtgatggatcatggttggacggctgcgatcaggtggcgcttacccttgcgctttttttagacgaggcaggtgatctccctccctccttctcgcgctctctgcttgtacttttcttgccgctgttaagccgcacctaaattatcttagcaaaaaagtggaattcgtacaagaagcattcgttcacctcttttctttttacggggagagtggcagctcaggaaagaatcgctgaaaagtaccacaagtgtttttagcgctctcttttctttttttccccttcacttttgctgcgcgatggggtcactagcacgcaagactttcgtgagtcgaagagaacccttccaggtaagctaagccacggcatgcagtccttctgcaccatggttcacgccatagccgtcccatccccggctagaatttcctcgcctttggagtttggaccggtctcccactggcactcaaaaggcgaccggctaatccacccaaaactcgcggcactactgaatggtgtagtagcaatagcaacctttgctctacgatcttatccttctctcagttgttctcaccaatggtaaaccggttaagttgcacgggtcaaagcgactcgacggtaaattcgggcgatggtaaccgctgtggctatgactgttccgcgcaccgcgcgcgcgaagggggcaagtagcctgtacgattgactacggagtcgctgttgattgggtggtctagcttacgcaccggcgccactggtggctgtctggtgaatcccacgcccctgaacagagcgcgcgccgcgggcagtttaacgaccatccgtttcgcacttgcgtgcacagtgcgcggcgtcgttcgtgtgcgctctggaggaggaggttttccgtaagaagaggctcagaataacgctagtcgtacgggctcgatggctccatgggttcaccaatggcttaattagaggctggatttacgcataatgcatgcatggtgcaactgaggcgtggaagaagacaatgttctttttacctttaccacacgcttatacccggtagagagagacctgatgcaagttttggtttggtttttcggcaagctagaacgtacaagatcgaacataatatctagatcaatagatcgggttgtacacatccccgtgagttgaatgtaatcgtttactttctccagtatccctgtcccaaaaaggccgaggtgtgtaataaataccaacagctagctcgcgatcgaggccctgctgccgctgccgacgatcgatcgggcatgtgtattatggagcagtgtggtactactatactactccatgcgcacggaggtgtgtgcgcatcaatgagagctaagtccctctcctccatggagctagctagcacagagtggtcgctgctaaccgtcatacacacgaacgcacagatggatggatggatatatgcatcctgaattcttgaagtttttggttggtgcagctagggcctgcagactgttgaggagctactgttagtaggactggaagatctagcgtactccaagtggcacgtaggattcttgcttgcttctgcagccaagccggccctctctccaatcttcgtctctagatctcagtatctcacgagcaagtgatcaactagagcgaacttggattccctcacattcaatatcataaaaatcctagagggaaaagaatagcctagtgctgtctctgctacgtggaaaagaaaacatactgtcaaggatgcacgaaaggagtaaaaggcacctttgtgggggctaattctgaaacttggcttgtaagacattatgtgtatgccctatttttgtgctatcaaatctgctacaatgaatgcttgttcttgcccgttatcattttttagtcagatacatatgctttaactgcgttttaactgtaagcagtaaggatagttcactggaagtctggaaatgaacatctgaagccgagtttttactgtccttgagcaactgcagtaccaaatcgtgactgttgattcgagatcatccaacggtccaaaaggcgtcggtacctcatggtaccgcacctcccattgacgcggtaccgtggtatggagggtagttttgtactttcgcgttgtataccgattcacggcttcacgcacgcggcatctgtttcttcgctgtttcgcgagagaggaggaagcgctgggctgaagcgagagaaagaaccctagatggcggcgggaggaggggcatgtagcgaatcctggatcagcgactcgatggcggctagatcagggatgggtggaggtcatcagcggcaggcccaaatcggccaaccgtcgggagctcgaagatggttgtggcggcgattcatcgacgacggttagggctgtcaaaaaagctcggagctcgcgagcagctcgagctcggctcgtcgcaagctcagctcgagttcgactcggcaaggattcgagccgagctcgagcttgtctcgaagctcgcgagctctaccgagccgagctcgagctattcggcagaagcttgaaattttcactcccgctacctatcccaatttctcccgcactccaattccaaaatcctaccaccaacagcagtccatcacctaaccatttatttcccttatatccccatcccgtatccaaaccctagctcatttgctctcttcctcgaaacatttctcttctagatctacaatcctaggctgctctagtgctccactgaccactgctgtggatctagccaagcaccgtccatccatccttcgcctctcctgtccaggaagaaccccatggaggacagcagcagcccaccgcctccgccgtgagtgacgaaccgacgactcggatctgagtaagtttcctcttctttctttgttttacatttttatttcttttgcacccacatgtatctagggccctacatgtattaattgtgtagtgtttagttgcttgatggatgttattgatttacattgaattttatggactaggtggagacatagagtagtacttatcttgctgtcctcctcttctgaagaaagactgaaggttgcagaacaccgtgtgtttgccatttgccaaggtaaattgatggcaatgcttttcttgttgtacttgtttgattccttaccttgtgcagaatatatattgatagcagttggtatttttattttttgtagatgtctgtaaacctgcaaagacagctatctatagagatcgagtcaccgagcaatagggatggcatagcagcaacagaagcacaaccgaatcagcagctagtaccaggtgaagtaaggggagaagagggccaagagggaaacccaactaaagccaccaggaaaaagaaatctccattgtgggatttctttgaagaatgcactgtgccatcaaagaagaagaaaggagaaatggaaaataaggtcaaatgtaaggcatgtgaaactctgctcaccaagaatagtagtggcactacaacacattggcggaggcatttagagcagtgtgattatcacaagcttcaacaaaaatccataaaacaacagaatatcaatttccctagccttgatgaaggtgatgttgatcttgatgctccttgtgtttctgtccctggttattatgatcctacaaagatacgtgagcttatttgcaaaatgatcattgtccatgagttgccattttaccttgtggagtatacatggtttaatgttttgctaaagaggctaaacccttcttacaaaaaggtctctagaaataccattagaagtgattgtatgaggctttatgaatctgaaaaagaaaaactgaagaggactttcaaagatgttagaaagataagcctcacatgtgatctttggacctctaaccaaacaatttgctacatgagccttgttgcccactacatagatgctgattggtcaatgcattgtcgtgttattaactttcttgagttggagcctccacatactggtgtagttattgctaatgccatttctgattgtcttgcttcatggagaattgaggacaagatagctagcatcacatttgacaatgcctcaagtaatgatagtgctgctaacctgttgcttgccaagtttacaaaacgtggttcactttggttttatggaaaattccttcatatccgatgttgtgctcacattctgaacttaattgtccaagatggtctggctgtgattaagcatataattgacaaagttagggacactatcaagtacatcaagaaatcaaacaatcgagcatacaagttcagtgctgatattgattctctcaaccttaaaagtgacatgggtttggctattgattcctgcacaaggtggggctcaaccttcaaaatgctgcaatctgcatttttttataggtctgccttggatgtatatgctgcaggagatgcaaactataggtggctgccaacaccagaggaatggaatctatattgtgaagtcaatgatgccctttctgtcattcatgcagccactgaggagttctcaggttcaacctacccaacatctaaccttttttattctcacattgtcgatattaagagagtactaggtcagttgttgaagtgtcacgccccgagctagtcctgactggaattagcccgtgacgctccaaattaacctgttaatcgataccagtcccaggaaaacagtgctggtatcatagagagacagaatatcacagcaacagaggtctctttattatagagtagaagtacagtcatgttgggctgcggacagatcccgagctcacaactgcattacaaaagggaaacggaagccagggcttggaccaaacatcataggcgcgacttgggaactaggtcgaaaccctaaaactcatcgaagccggcttgctcctggaagaactcttcatcagcaggatccgcttcatcttcttcagcaactgggggggttatttatatagagcaaaggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacggccacccgggccaacaacttttcaaacggccacccgggccaaccactttcaaacgcccacccgggcctagctgatcccgtcagctacagatttttcaaacatcaaaccccttttcacaacagcaatttcacaagcagtagtcaaacaaaactacgctaagaatcacctcacatccgcccatgaccgtgggcacggctgttcgaacagttagttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggctaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttagaaattcatttagttcgcaagcaccgacccaggtgtcgggttttccaagtcttttgtaaaaccaagtttacccaagttgtttttcagattttaagtttgaaggcgaccgtcgatactcgcacagagtgcacgaatatcgaggcgcaactgggtggttacaaggggacatggtataacaattaacaaaggaaggatcaaatgcacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattaggtagatctcgagatttggggaattttggaagttgaacggagtcaatcggatttacggttgggaagatattgaatttctaagattattggatttttggtctgaaggaaaaaggatttaggcccgggtggccgtttgaaaagttgttggcccgggtggctgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacccttgctctatataaataaccccccagttgctgaagaagatgaagcggatcctgctgatgaagagttcttccaggagtaagccggcttcgatgagttttagggtttcggcctaattcccaagtcgcgcctgtgatgtttggtccaagccctggcttccgtttcccttttgtaatgcagttgtgagctcgggatctgtccgcagcccaacatgactgtacctctactctataataaagagacctctgttgctgtgatattctgtctccctgtgataccagcactgttttcctgggactggtatcgattaacaggttaatttggagcgtcacgggctaattccagtcgggactagctcggggcgtgacatgaagtccaaagacccaattcttaaagaaatggcaaatgcaatgcttgaaaaatttgagaagtactggggcccagaatgcaatactttgtttgcagttgctttggttctagacccaaggtttaagatgggtatgattaactacacattccctgctttgtatgaagaaactgtacttcctaagaaacttgcaaatgtggaatccacattgaaatctttgcatgcatcatatgaaagtgaactccagagcacatcaaaggaaaatgatgccaccactcaatctactagtacatctctgggcactactagtagtcatttctttgctgctagccaatttcatgagtatatgaaatcaaagaatgctgctagtcttcctaagtcagatttaaagaggtacttagatgatcctgttgaggatattcctgcaaaaagtttcaatctacttcagtggtggaggatgaatgaattaaagtatccaattgtggcaaagttggccaaggatattcttactattcccatcacctcagtctcatctgaatcagctttcagcacagggggtcaagtgattagtgattatcacagctctttactcccatcaacagcacaagctttggtgtgtacatctagttggattagaggaggccaccacaaaagcacatatttagtaagttcttatattttcatgtttctaaccaattaatagagatacacaatctaataatctgtgtttacttgtttgttgcatactaggaggatgatactaattctattatccttgtcccaactcaagcttcaactgcaaattcggttgtgggcagcaattagactcgtttgtcaggtatatgtttgaggttatataaattatctattgctaccatatcaattcctcatcactgatgaaacattacctataatctttgcacatggtttcagatttaactttacgaaacattaatgcaggcatatagtatagcatcaacaattagtttgaagaaagtgcttggaggtttcacattggcgtactgccattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaattctattatgacttatgcactactatgaatttgtaatctttctagtatatacctgtcgagaagctattatattctattatgaatttgtaatcctactttggcttgttaagaagcttttattgggagataagttcagattgctgaaggaaacagtcttaacgagcttctacgaatcgagctcgagtcgagccgagccttgatcgagctcgaaccgagcctaccttcaagctcgaaggtaatgctgggcccgagctcgagcctgtaccgagcttgagcttaggtaggtaagctcgctcgagctcggctcgttgacagccctagcgacggtgagctcggaggtttctatgctacatcggcgagctcgaagatggttgcattggccgttcgtcgggagctcggcgatggttgtggcggcgtttcgtcgggatctcggtgaccaaaagcgggagggagataggcagtcttcagtcttcactcgttccctccagcccaggcgtcgccgtccagtgctgcggctgcgcgcgtccgtgcgcggcgtctcagggtctagctcgccgttgaccatgcagcccccgaacggtggcgagcgggggcacggcaatccgggtcgccgccgtggatcttcaaggtatgtgtgcctgctcccgtccttcttcaaggtccaagtgtactgcttcgaggtccttttattcaatcagtgcttttcgagttttatgatttattcatgacaataccagcatggacaacgttccgaggggaaaaccagtcattttgatttctgacagtgaagatggtaaaccaaattctttttcctacttattcatgtcctttcttctttgtttcgaactaaaatggtgcttacaaaccaaaaacacgggaaatattattgtagatgatgatgaagttgctaagatatatcaaagcgtgcgcaagtgctccattgaaagaggtgattattttcatataaataattaataagtccaaatgtacagaatgttaggtactgctagtcagatgatgtgcttgtcaaacttccaatttcaggtcaatatggacctcgcaccttccctggatttgataggtagtactggtatgggactgaacatgcagtacaaaattgctcacattgctgtaagcaatttgcctaccattccactctatgtgtatgagatccagatgactaatttgacaaaagggaaaatggtatggttcacaaatctgactgccctgtatttgcatttgtttatacataaatgtcctgagtctaaatgtcttgtttatattttttaggccttcagtttgccatttagcaagcagtacataaacaaccacctttcaacaccaattgatgatttacttgtgactctggttggatcagctgaatcctttgagatgagactgaagaaatccaaagataagcgggctacctttacaactagatggaacaagttggttcaagccaatttattcgagcttggtgatgtttgtgtgtttctgttcactgaagttgatgatgacctatgtattactcttgaggttctcaactagtgtaatggatgaagaactttgatgtgccccctcataatgtagtagtatgccccctcctagtgtagtatctgcaccttatgtaatggatactatgcagcagcttttgttcaactttaatggaggccatgcagcagcttatgttctaagttaagacaatgttattctgatgtaatatatttatcatctatttccctaaaattacctagttgtttgcatcacttcaaatctgatatggcaagtgtacagtttttatgctactggagttgttgattgttgttggaatcactgctacaaaattaaaatggctgcccgttctgttctgaaaactaaaaacatgctacggaagcttcatcttgattgttgctggaatactatacttaattgggctgaaaacacacagaacagaagcagctggcatgaatacaaatgagtttaagaaactttagttggctggaatacaaatgtaaggtgcacacacaagagcgtcggacgatgcaggaacaacagagaccacaacagcaggaagcgacgcccgagtattccggctggatgcgacggtggatgcggcagggtggaggcggcgattttgatgcgcctggcgtcgtcgtggatgagtcgatgcgcctgcggatggctggatgagacaacgagttcttgcgacggcgggatggatgcgccggggtggaggctgccgctgtatgcgacgacgggatgcgccgctattgacgacgggatgcgggttggacgtctgccgcggcgtcctcgacggcggcagacgcgtgttcgacgcgcggccgcggtggcgtcgagggtacgtcggccgcgggggaatacctgcgatgagacggcggctgcggcggacaagatgagacgccggcaacagatattggcgcttggcggccgccgcagactattggctgggatgggcggtgattaacgctaccctaatttgtttagccccatcatacccttcctaaatcaacggtcagattacattggtacctcatggtaccttcttaaggatgggaaagatgctctctgaagccaaatctcaacagcaagagcaagctgcttgtagctctactccatcgagcatgctttatggagatttttagtggccggagctgataacatattattgcactcagggaaataacatcgatagtgtgactagacaagtaggcatccaacgaatcaggttggtaaaagacagaagaaaagtagacggcataaatgtttcttatcttccttcaagttggtaactggtaaaggttaagctagtaaccaaggacttagcctcgacctagtacatagatgcagccattacagatgaagtcatggaggggatatttggatgtcatggagctagttggagaaagaataaataagtagacagcatgttttctgaaaaccaattaagggtttctcttttgatgggtagccaagaaggctagcctttcttcaagcatggacggccaaatttaaaacttacagttaattaatgtgacatctcaggcttttaagcatatggtaaagctcctgtaactgtaccgttggttttacacttgtaggaaatgttgaactagttgctatcttacagttttatcaacaacctgcaagtcaaaattaaacactggttatattccagcagagcgaaactataagttagccaatgtcggtgttctgtgtgctgcttgttgtttacgaggatattaccaacatttgggaatatatcaagcatattttgctcactttgcccataaaagctcaactgatgccatgccgaaaggagatagcttgttctacatcattgccacaatgtcacagaacaggaaagcacagcagaggcacgaagcatcaatgagaagagttcaaaaaaaaaaaaaagggagaagaaaagacagagaatcagtttgtttttgcttgtccggtagccatcagtccctacttccagccactaacaacagaagagaggatcgtccttttcagcagccagcacccacgaattgactaggtgatcgacgatcaactgagctgcccatgtagggatggcaattttaccatgagtctgggtatccatggatacccgacctgacgggcatgggcgtgtgtgtgactttttacccataggcacgtccgtccaagatccgaagatgttatgggcaataggtgggtttcaatttttacccgtgagtaacccatgctcaacccgatacatatgtattaactacttttgactcatttcttaattcttataccatttctctcggttcatttgtgatgctaactgatactaagttgtgatgtaattcaaattattgttgataaacggtgatttggtaaattattgattttatttctctttcttaaattacatatctttcaagttattattcatgtgagatctattgggtacctgccggacatacccgcgcccgctgggcatgggtacgggcacggaattttacccgctaactctagtgggtagggtttgggcggacaatgtcgggcatcgggtc

SEQ ID NO: 74891 - DNA, 11538 bp, Oryza sativa
cccaaataatgatatcccgtaatctagacaccacgtctaactaccagatactactctaatatcatcatcatgacatagagtaattgcataagcaaacattatacccgcaccaaagcatctctcagataagctagctgtatattcagtataacatgaacataatgtaaagtaggcattcatatactcagaaagtactcctatttaagaaaattattccccaaacgtttgacaaattttgttttcatccttcccaaggggcttcaggaggtctcattgttctttggaacaaccatcttttctctgcaaacctggtttctagtcatccttatgagattactatgcacttttgctccacgttgacaacagatgaaaattggcttctcacaaatatatatatggaccctgctcaggagatttaagaacagaatttgttgactggctatatagtattacttttcaaccagatgaaaaatggattttcatgggagattttaattttatcagatcaacccaaaacaggaacttgccaggtggggatatgaatgatattatggtttttaatgaattgatcagtaacattgaccttcaggaattgcctcttaagggcagaacatatacttggagtaatatgcaatcacaaccacttctgcaacaactagactggttcttcacttccccctcttggacagttctctacccaaatacaatggtcactgctctgagtaaatgcatttctgaccatacaccatacccctctgagaccacagttccaaagacagacattttcagatttgaaaatttctgggtagagctcccaggattcatcgaagtagtgaaacttttctgggatatccctgtcagagcagacagtcaagggaaaatcataaatggaaagtttaaaaatctcagaagaggactcaagatttggagcaagaggctctcaaatttgaatacactgattggtaattcacatgaagcaattgactttttagataacattgaggagcagagacctctctttatccatgaatggaacttcagaaacattgtcaaaaatcacattttgaaacttcttcattacagaaatattttctggaagaaaaggtgcacaatgaggtgggtcaagtttggtgatgaaaacacaaaattcttccatgcttcagcaacccaaagatatagacagaacaaaatctcccatttaactctaaatgatggcaccattattacttcacatcaggaaaaggcccatgcctttctaaacttttacaaaggaagaatgggaacctctgaaggaattcaaatggcgatcaatctgactgagctgattactcctcttgctggcctagaaaacctatcaaacatgccatccaggcaagagcttgaatctattatgaaggcaatgcccattgataaagccccaggtccagatggtttcaatggtatgttcatgaagaagtgctggaatatcattgctgaagatttttacaaattggcaagagagttctttggtttacagtcctcgatccaaaatttaaacaactccttcatctgtctaatcccaaagaaatcttctccagaaactgcaaatgactacaggccaatctctgttcaaaatatgagtatcaaattcttatctaaaatcttggcagaaagactgcaggctgttattcttgatcttcttcatgaaaatcagtatggcttcattaaacagagaacaattcaagattgcctggcatggacttttgaatttctccaccagtgtcatcaaagtaaaaagcaaattgtgattctcaagatagattttgaaaaagcttttgactcagtggagcattcttccattttagcagtgttgaaagcaaagggtttcaatgaaacttggctcaaatggatatcagacctgttaacaacctcatcctctgctgtacttctcaatggaattccaggaaagaatttcaagtgccaaaagggtgtaaaacaaggagatccaatttcacctctcctctttgtcttaactgctgatcttctgcaatcaatgataaacaaggctcatgatacgggtattctttccaaacctattccccgaccggacaccaaattcccaattatccaatatgcagatgataccctgataatcatgaaggcttgtcaaaaagaaatttttagtcttaaaggcattcttcagtcttttgcttcttccacaggcctaagaataaactttcataagtcttgtatgattcctatcaatgttcctgaggaaaagactgaaatccttgctgggactgtggagattatgggtaccccatacccacacggcatggttatccgactagttataggggataacttatatatatgtaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgacacaatatgatcgtcagatctatactatacccggcggattcaaatccccaaacaggagtagggtattacctctcattgagagggcctgaacctgtctaaatccttgtctccacatccatccacttttaggtctcgtgcgctacccccttttattattgccgaattcatgtttcgacagggacctttggatgtaacattggatctttgccattcacctacctgggtctgcctgttggaactacaaggcccaaaatcatagactttgtccctttaattgacagagtagaaagaaggttgcctgctattaccatgtttctaaaccaaggtcaaagactcactatggtaaactcagtcttatcctccctccccacctattacatgtgtaccctcaaaatcccaaagaaggtgatagagcacattgatagagcaagaagacactgtctatggagaaaatcaaatgaagttgatgctaggtctctttctctagaagcatgggataaagtttgcaagcccaagcacaggggtggccttgggataattaatttggaatttcaaaactgtgctcttcttatgaaacacttggataaattctacaacaaaaggggactcccatgggttagactgctatggaatgcatattacaaaaacaaccctcacccacgacatgccatgcaagaaaaaggatccttttggtggagggatgtttttcgtcttattccaatcttcagagggcttagtgcaattcaaattaacacaggagattcaaccctcgtgtggaaggatccttggacagacatcatacctcagtttgccttcccgacgattttctcttttgctgccaatgaagacgtatccattcagaagttcatgcaaaatgatctagaccagaatttcttccttcctctctctgctcaagctctacaatagcttagtgaaatctcaaaccttctgaataatattcacctctctaatcaaagtgatagctggacatacatttggggaccatctttcaagcccaagaaggtttatgatatgttctttgctcatctatcaccttaccctgcaatcacatcaatatggaaaagtaaatgcacgatgaaagtaaaagctttcctttggctgctatttatggatagacttaacacaagagatatgcttcaaagaagacaatttcacattcagaatggaccatcatgtaggatgtgcaactctggagttctggaggatatgcctcacctgttctttttctattcttttgttcaatcttgctggaatttactaggcatcaattgggatgagaacctagagttctgtgatatgattcaatcggcatatatcaacttccatcaacctgttttttagaagttgtgggcactgcttgctggcagatctggacaaaaaggaattctttaattttcaacaacatccagctttcaatccacttgtggaggattggtttcaaagaggatttcactcttcttatgcatagagtgaaggaggaagacaaacaaaaataccaatcatggatagactcaattttctagatcccttgtaaagttttttttctttttttctctcttttgtaaatatctttatatatatatatatatatataatctattatcacagtaggagcctctcctactgtttctcgtcaaaaaaaataccataaatgtatatagaagagtattctaataaaagtacaaaacttacaaaatagaagagaaaagttactgatgctaatgagttgcagagggttgtgctgtggcgtggtgtggcgtggtgtggactgatgctactgtgctgcttcttgcttgctgcacctttttttctcccgatctgagattgggtttgcgtcacccaccgtctcgtcgacatatgtacgtctccgacatcggcatcgactctcttcaacttcatcattctgcctcacgcatcttcggtttgatcacccattcaagcgcccggctacaatgacttctaccgccaatcgtcttcaactatgcgtctacaccatcaagcttcgggttgccgctgcgtcgccccctcgggccacagtgccgctgcctgtggtccacacctcctcaagtttttgcaatgctgagaggcaccctcctcagcatggctacatcaccggtggacttctcgccactgcatcgacatggagctacagctgtgttgtcctcggaccgtagctttgctgctttcgtcgtctttatcgccgtttgcacatcgacaacctcgtcatccgcactagtcatcgtcagccacttgggttcttcttcatctacttcaagcattgccgctctaggccggtgctccagctacctctacatggctgttaccgacgacgccgtccaggccgttggtcccgctactgcgcctttttcttcgtcgaacatgtctcattgccagcgtcgtcatatcttcctcgactacacttcgctcttctccggcaactgcgtgctgcttcggcaattctctatctatgcaattctttcgccgcgactgtcttggaggccttctctactagtctcctccgacattggcgtatgattcatggcggtctccaaccttgcccgcacggtattggcaacaccgttgcgtgcgttcgttccaagttgtccccgggtttggcaaacccgacatgacgtctcatccttcacggttcgactacatcggctcttcaacgttatcttcctcaacgactgtcgcgattgtgtcaccgtctttgtctctagcgcgtcctcgcacaccttggtccacgacgccctcccatgcgtccacaaccactctacggcgccccatgctcgccttgtggcctggctacctcgacatcagcttcccgacttcggctacatcgaccacggctactctacacacggcttcatcaaccacggctccctcgcaccctttgctttagcaacatcgactacggcacgaaaggctatcatcgtgttgagtactcttgttggttttttctctagtccaagtgtccgcgctgctcacgtttggactgcgggggatgttagagtatatggtagttagagttttattaggataggattgatttgtgtggagtctttccatatctgtaatccttccttatctacttcccatgtactcctatatatatcggtcctctgagactcaatacaacgtgtccaatattcacattatctcctctccctatactatccaacatgatcgctgatctctgccttctccagtggttactgccttactggttggcgattcggaactcagcgtccacgaccaccagaccacgactcgatgtctagtgtgctcagtcgcaggctcggtaggacggacacactgtcgatgacaatcgacgaggagatagagacaagatcagcagtcgatgatcgctgtcgaggcatgggcggccgggcagtgggcgtcggggcgacggcgcctcggtggttcagcgctccactcgttcgccattcatggtctgccaatctcgtggcctcgcgggtggagtcaaggggtcaggccatcaagctgtcgggtgaggcgatcgttgtgcagcggcggtgcggcgtagggctcctcgatcggctcctcgcggcggtgcgcgtagcggcatgttggcaaggcgtggcgctagggctgactagactggctgcgaatggcgtgattgcgggcggttgaagcgaaaaatgaggagttgatcgcgacgtgaggagaggtgcacatgtccgcgcgacgcttcggtttccactttccatgccgcgatcaccatttgtttttttctgatatatggtagggtcggttgccattttttcggtggttcaatgaccacgtggaccaccctataaatccgcctaattgacacccaccgccggcacgctctggcttgcagctggcctatcgacgacgtcattatctgctgactgaggttaggatctttgctcgaatactggtattacgaaactaatatttagggattgaattgtatgcattgaaataggctcaaaggagcatataaagtgtacaagcagacaaaaaaaaaattaaaatacccttgctaacaatcagcgtgaggaagctgttcatgatgagctccttccactagtacacaaacgatttttccgtgacaaaatgcatttttccataccgaggtcccgcccgtctacccaggtgtctacaaaaatccatattttcacgtgcgggcggcctaatcgcacgagataatccatcttcccgtgtgttgacggtcattaccatattcatgttagaacaataatattccactagtattaggtttgctaaccttttgcatagaataaccataaagtggaggagaaccgacatcaaatcagatgataaataaatcggatggtgtcgagaatcagacttatgcatgaatgggccaagaactcagaaatgacatgacgaattaggccaaaattcacaagtctgcggagaagagcatgagatgaggccaccagccgaaatttgggctggttgggccggccctaggttcggccaaaccatcctcagcgttgtttgatccaggtctttgcctggacggtgtagatcagcccccaatgacggttggagggtatttccaaccattccaaccatcacaaccatcattgggaggcaataaaaggagctctcatcctcacttcattcacacacttcaagcaaaactctctcatattctctcaagtttagtttagtgttcttaagctagtggagtatgaatagaatagaaatcggagtccggaagcattcagaagagttcaggtatagctctagtagctcttatttcctcttttgcaagcttcgtactttatttagaatactcttctttatacatttctgttattgaaatactttccgagtatatgaatgccaactttactttatgttcatgttatactgattatactgctatcttatctgggagatgcataggtacatatataatgtttgcttatgcaattactctatgtcatgacgatgatattagagtagtatttggtagtttaggtgtggtgtctagattatgggatatcattatttaaggttatatgctgcggatgagaggtgggccgctgatggtgtcagctcagtacgtgtatatagtcctaagttaatttcctggggagtgtactcctccgtatttatccccgattgtatggttatgacaggatgttgtaaggaactcggcagtcaggggtgacttctcgaagtaccaggagggcatcagatagagggtattagctagttaatcatataactagaatgtatgtatactatgtataccagaagtatagcaatagattctctttctttttttctttccacttagcttagatattttagtatgagaatgagtagctccatgcttgtgtgtcactctaccctttgatttatcttaaccctgcttagactatgattattacaagtaacatataaattgttagtacggttctctctactatgatctttccacggtattaaataaatacaatacccttggaatactctcgggtgaaatgctacaatggtatatccgtgcgcttgcggatgaactctataaccataatataccgggagtatttctgcgccattgttgggaattatatttctagtaatgtcattaagaaataccaacatcgtacggtcgggttgagtggaccgcacaggataatcgattatcacgtgcagtcaaattatactgcccacacgcaaaaaaaaaaagaaaaacccaaaaaaataaaataaaaaaatcccaaaccctaaccctaaccctagaatcgcccaccgacgtctctcgtggtcgccatcgtcctcatcgtcgcgctgctgccgctcccagccaccaccgctgctcccgagcccgctgctcctaaccccgtctccgccgtgaccggttgtcgttgccgctctcgggtgccttctcctcctcgtcatcgacgcggcgcggatctggctggtcgcccgccgcaccgcctctcggtcgctagccgccgcgctgcctacgacaacagctgctgcgctgcctcccgcccatcgcctcctcggcggcagcggcggcaagccgggcgcctcccgcgccccgtgcgctcggtggggaggcgaggagaggaaagggagagagagaggactgattgagggagaataaaatggaaaaggaagagaaagggtgaaaggtttgaagtgaatgagagggaaaagatgcagaggtattttcacgtgcggtccacttaagacacccgcacgcgaaaatcaatttttgcgtgcgggcctcttaagggtccgcatgtgaaaataggcttatttttacatgcggaccgtttaggggcccgcctacgaaagtcgatttttgcgtgcgggtctcttaagggtccgcacacgaaaatgggagaccgattttcacagacgcacgcgaaaacggtctgtctggaaaaataggagctcctcgactaggaaagtcttttgtgtactagtgttccaatccctatggttgcggagctgatttgcaggtggacgctcatgccggagttgagggctatgatcttcatcacttaatcacgttgccatggatggtgtcatacaaccggctcacgctgaggttctcctggagagatttgctccagtccaacaaaaagtacctcgagataccgatacctcacggtaccaaatcattttcgattgttggatctaacaaagctcatcctgtccagctagatctaacgattgaaaatgttttggtactgtgaggtaccagtacctccatgtatttttttttttgaccagagcaaacctctctcctagaacaccacagcgaggaagaggaagtggggtggggcctcccagcgagagagctattaaagggcgttcgcggcatgggcgatctatcgtgactgcttgtcgtgccccttgtaaatcaatacatggattcaactgtttgtaccttaaggatgatagaaatgctcctcccataaagctccgtaccaatggatatgaacaaatcaactaccaatgttctttcacctactaattttgtttttcttccttgagaacgacatgttctttcgtacgtcattgtttgtatgcacacacatcgcttgctttcatctaagcttggtgctaacgaaagttatttgtaggtgcaccttccaatggggatctctcaacacactccgatagtagcaaccactcgtacaaacaaagcaactaaaccacctgacccctgaccaaaagagatcgacacccacagcgatcgatcgatcgatattattacatatccctcaactactcactggccgtagccctttgttgcagctcggtgcatgtgtttgcacaatgagctacctcctctcctacatctccaagatgctgtgcatcaagattccgtcggaggcgaggcaagccagcgaggacggcggcagcggtggcctgacggagtgctccgtctgtctctccaggatccgtgtcggcgaggcgacgaggcgtctgccctgccggcatgcgttccaccgggactgcgtcgaccggtggctcctctcatgcaggcggacgtgcccgctttgccgggtttacgtcgtcgtcgacggtaacaagccaggggtggcagcgaagcacaccggcgagccgccgctcgctgaagacatggtgatctggttctctgccatgctcgtccctggattctgacatgtatatctctgatgtctaagcgcaatgctttttatttgtttgtttcctgcctggaaaccggtttgttttttttttcttatattatgcaaattaacatgacgatttcacgcttgtagcgtttgtatgtacgcttacgctcacatcgtcagcattttttttcttttgcaagttttctattgggcgttgattacctattcaagagaactgaaaaaaaaataagtaggtatatataataaaaacggtttctttagatttcctttaacagtttttttcttttaatctgtcgaattttattttataccgtgcgatatacacacagatgatactagtctggtttatcagttcagcatttctttctggtttgcttggttgaaccatcatcactgttgagttgtctgtccatgtggagataaaacaaggggaaagtgagacaagggaaggaagctcgaagatgctagagaaggtcgtacaaatctgaacaggaggtgtttcttgccacgtcgtgagtcctcacccaacacgctgccatccactcaccgtcactaccagactttagcagctacctgtaggcatgaaacccacagaggaaaataggttttaccgtcagaaatttttaacctgtgaatggactgatatgaatcgccgacagaaaaatgaccacagagaaattccattttcctgtaggtttcatattataaatcgtttgatttttttattattataagacatttgactttttttatcaaactcctttaaatttgatcaagtttatagaaaaatatactaacatttttaatactaaacaaacatattatcaaaatatattcaatacaaaatttaatgaaactaatttggtaatgtaaatgttgttatttttttctaaaaatttgatcaaacctaaagaactttgactaagaaataagtccaataactaataatataaaacaaatagagtagttgtcaacgttctttgcatctatatttgttctttagttcaggtgttgttccctctgttcccaaccacaaccgctagtctagtgagatgttagagcatctccaacagcatctctaaattcgattctccaaatacccatacagctaactctccatctgatttgggtaatcaatctaggtgttgactccaacaggctctctatttacatctccaaaatgacaaaaggacccacatgtcagcctctattgctttcttcttcctcttctttctcttcctctttctcttctcccttctcatcgacccatccccgtgcgaggtggacggcgacagcggcagcggatcctcc

SEQ ID NO: 74892 - DNA, 7261 bp, Oryza sativa
ttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcagttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactatccctcgggtggagcgtataagtcatactcctaggtctttagtaagcttcctagaagattcacccaaaatcttcatagactgcgaccaacagtcaagctcacaaaggtgagttctttcaagaatgctttgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactatttactttgacaattaccgtttgattgtcacagttcataaggatagctggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaaaccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattaacttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcttcattgactgcaaagcctgcagatatcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcgctacagatagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctgatggtgtgattgaactgggaattatttcagagggttggttcgaaccactatgtgtatccttcattgggaaaaagctctcaaagaaggtagcatcacgagactccataattgtaccaacatgcatgtctggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaatttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtagaagttctagtggtgccaagtttctctccttggcagccttgtgaggcttgcgaggttgcttcgattgcacacaactatggcacttagaacttttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattccggtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccgactgcttggtcgaaacttttcgcagatgtctacgaaggcacgaaacacgcgagcgaagaggaagacgagccgttgtgaacgaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccctagattgatttcgcgtatgttgcacgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttctcctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagtttgcaggtgacttgaggtcagccttggtcaatggtgaggaccgagactatgttcagggaggaatagaggtctagtgcggtcgggataccatgtgagaaggtgactagagtcaggattcttggaggtcaacttcggtcaacggtgaggatcgggactaaactcggggaggagttgaggtccagacggtcaaggatgccgggtgacgaagttggatacgagatggcgcatggtggatggacaccgtgtgggagagatcttcgcaaatcgcaacgggcttcacgaggtgtgcgtgcaagcgtcggtgttcgcgaaggaaattgagtgataatatttggaggtatatggtgctacagtacacgaggtactgtagcatgcaggttatatgtatgcatgtatggtgctgtacatgtgcagtttgctgattggttggctttgaggtttgcatgtatgcgttggctgtttggaaggcagcaggcagcatgcagcggctcggctcagccaggaagggagcgagaccaagcaggaaacggcaggcgtgcgcgcgagttggagtctgactcggttggacctggttcggcaggtgcggctgagagtttggatattgtaattgatttagaaattgagcatagagtcctagtgggactagaagttattctcctactttgagtaggaggtttttggtataaatagagagggagcgtgagactttcctgtatcgcttttcagagcgtggagttgatagtttagttagggtttcgagtttagtcaagatttttgtaaggagtgctgttgttgcactatgtaaacatagagagaagcaataaagttgtcatgtactttgagagttcttcgatttgtgtttttttgtttcaggcggcagggaggcgatctaaccggcagcgtgcaagcggtccgactggcggcgacaggactacgtcgagatttccatcgatttgagggtaacttttatttccgctaaaagtttttgggtttttggttttccctaccattcaccccctctggtaggcttggttacttgtgttcgatcctacatcgtcaatttcagagctaaatatagcatttgtgataaaaaatccgagtaaaaaaaactcataaggatttatcaactgcggaataaatactgactgacaagtttaaccaacctaagtaataacttgagcctgtatcagataaattaaacatacaaatgtttttagaaggaacaatagtcttaaaaaaccaatcgtccttatcaaaccctagcagccttgtgaccatatagaaaaagccagcaaaacaacatgacgtttttaactgtcaggcacctttttatacgtatcgtagtagttacaaagaatttactaactgcagaaaaagaatttaaatggtattgggctttacattttgtaggcaattt

SEQ ID NO: 74893 - DNA, 4491 bp, Oryza sativa
cccaatgcgcacaacccccttatctatattgagctgaaaccactcccgcaaatgttcatcggattttatctcaacaaaaccatcatccaaagaacgccacaaactcacatattgtttagatccccacgtgtagtgttcagcaatgaaattaacaacttgcagcagatcatacttatgcatgtcaatattttgggttggcaaggttttaccctggaggtattgctttggacctccatccggcaaactgaaaaaagactcaactctaacaactaattgcaaatcgctgtgagtaggcctacaaatcacaacacaagtggcacatttaggtaaatcgtcctaaatagcaaagttatatagagagacgaaaaagcaaccgtactgaatgcagccctaagattaaaatgcatactagctggtagttcaagtatatctaagtatatgtaagtatctaactctaagtttcatctaggtttagctagctctaagttttcatgtccattttcataagatagcatgacaagaatcaaattacctgttgaactcttccatcaaaattagctccattgatatgatttcctccattgccaacaacttccccttttctgccttatcttgccctcggctgtgagaggccgcctccacgtggaagagaactggccgccggctgtgaacctcctgcgagcgggcgccggcgcacgccctcggccgcggcctcgcgcacccgcggcagcggcggcggccaccgcctcctcgcacggccgccgccgcctcctcgcgcggccaccaccgacgccgcctccccgccgcgcgagctccctcccgcgcgtgccggccgccgcctcaccgccacaagagctccctcgccgccgcctcccttgccgccacctccccgccgccgcctcgcgcgcctctcgcgcgcgcctcggccgccacctccgcgccgcgcgggctccctcgccgccgcctcaccgccgcatgcgctcgccgccgccgtcgtcgcgctagcttgctagggttttgagttgactcgacccagggagtcccgacgcacgggaagagaagaaccctatccattcactttccctcaggggtagaagtgtcattacataattcctaaaaccttttttttaatttctttttgtatttctttaacacataatgtgggacccaccaaacggctgtcacaaatgggagtagacggctgcttcaaattcaaaaagtgggggtaaaaatgcaaaccctaaaaaataggggcaaaacaacaattggctttcaaagtgggggcatggatgcaattgccccttattattattaatatagccaatttatcttttgcacatacttaagcattaattgccaaaattttaaaaatattggtttcatggattctgggacagcgtatacttaactctgtatggagtagctgttaaatttttaaaaaaatcacaccaagtaattaattaatatctatgtcatggatatgtggctgcagcacattaatttcttgtgaaatagatattttccttagaaatattttagataaattgccatactaaatttattcgaacaagtatatgctgatgtatcaattgagagaaattttacagtctttaatagatattttaggtacttgagaaagtcattataaattatgctactatacctccgaatactaaagacgatggtaaacttacccattaattaaaccatttaatgtgatagataaaaacaaaattacccttaaatgttactctccgtcccagtgcctataacctatgaccggattgatacataatacaaatacacatactataaaaattaattcggacagaaggaccatatagattcatatatagtctaaagatatgtctaattcggtgttagattgctatattttgggatagagagagtatagtacatttttccgtgccacccggtgtggcaacatatttcgcacatcgccacagtattttccaaatctttttagatatgggttttccttaatatcattataatgttaaaattccgaaaatcatgttcttcctaacgaacaattctacattggatgagaaggaaacaagatatatactgtacattccaatataggagtatatggtggttctctatggcacgacgccatgattggtggatagctgcgttgccagcaaatgtcattttttgcgtgtacccctgcgaacagtgctgtccttgcacacagtggcacttgctgtccttccatagttccattcattctaagaaaaactcactgtcctttcaattcgctctatacttcaattcatgcgtggatttatttacatcattcgtaaatatagatgcatccttaagaggcacagtcgcatgacacctgcacatatgtagctgtgttatgtagtggtgtgtgtgccctcttgtgcatctcttttgtaattgtaattgaaaaaaaacgtgcaatgtaaatactccttccgtttcaaaatatttgataccgttgactttttagcacatgtttgaccgtttgtctaattcaaaaacttttgtgaaatatgtaaaattatatgcctatataaaaatatatttaacaatgaatcaaatgataggaaaagaattaataattacttaaattttttgaataagacgaacggtcaaacatgtttaaaaaagtcaacggcgtcaaacattttaaaacgttaaaacggaggtagtaagtgataatggcttcatttctagttagcattgctgtaagcgcggtgcaatggatttggtcattaacgcaatactccgtctgtttaagaaactccaaatcttaaggatgaatctggacaagttcattgctagatttttttttatttttaacagagggagtaggtcacaaacagtttttgccaaattggtccaattagggtcatgaacagtttccgctcgagataggttaatttagtttgtttcttgtgccatttatacttgtattttatagcaagccaaaagcaaaattacaaacttcaaatatttcaagttatagctaataaaaaattagttttttaaatggatcctggtatagatgaatagcatctgatgtcgtgggcaaatgtggtgcaaccacataaaacagatcgatttgttcatgtgcaaatatgtgtggtgcacctacaaattaaaacatatggatatttgatttatcacttcaatcagctctttacgatggcatttaacattatacctcccctagctactaactgaaaaaagggaaccttgcattgctcacacaggtacagtgttgccaaagggcaatataccacagtttgtgctcaaatgtgtatatctgtagcatgaatgttctgtgttcatatgggtccacgtggtcaaggaacaggagagaatattgtttcaattaatatatctgaaactacaaatttgttgtaccacctacctaggggtgacaacactgcacatttggctatttagggccacgcatatatgcatgaaaaattgacacacgacgttacttgagaacctattcatgcaggtctatgagaaaaccccaccaaaaaaaacagatgtgcaaaataatgctggattttcatatgctataaattaagtactactttaatcaaacaccacattgacacacaatgacacaaattaaatactcttacgaattcaagtcatatatactctaatacgcacgtgcagcttgttactcaaataaagaaacagggcaatacggatcagtatatccaaccaggctgcatgtaggccaagaacctgacaattcgttttccttggagaaagcaaagaacgtttggaacgtgtgatgtacatgcagatcgaggaaaatagctaatcctgctctttccctttccagcacaaaaaaagattccttcgtagttcgcactgcatttatactcaaacctgcaaggctcccaaacagtttgaaccaaggcgagggaaaaaaaaaacatctccatagccaagagaaaacatactgtacatgtcaagagattccctcttcatattcttacaatcctatttactcaaattaaatcttcatatttcacttcgtaaattccaacggctaatttggtcagcacaaattcagcatctcaatcaacacaatttcaatgcatgaaggcgatcaagctcaccactctcctgccatacaagatggaccgccaccgcttggaatttccgcagtgacggcaacacgaggaagaggcaacactagcggatgtatgaaggagtctgccaagctcggctatttccggcgagcttgagagtataatcgagatagaggccggtggaaagacgaaaggcggcgtactcttgggcttagtgtggaggcaacggtggcggcctcgcggagaggtgacaacaccttggcttggcatggcagagttccacttctcaacagggatgcatgacactcctaggtaagaaggcggcggtgctggtgggtgtgggtggaggcacatggacttctctcaacaataaagt

SEQ ID NO: 74894 - DNA, 10493 bp, Oryza sativa
cgctgcgcaggagagagaatcgatcgatggaagaacgcgacaggagcaagctagccagcctagctgtagcgacgtgacagcagtttgatctttctttttttcttatgatggctaagcttatacgtaagccgatcgatcgatggcgagatagatcagagattaatatacaggggtaattaatgtactaattacaattaagtgtgtggacgagcgagccgtgtggagttacagctagctagcgcttatgctactcctacttaaggcgagaccccaaactccaagcatacgatcaggtagccaaaccacaccaccataaagctagcttgcaaaggggatagagtagtagagagagagagagaggagaggaggaggaagaagatggggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgcggccgcctcttcgagttctccagctcatcatggtacgtatagcaccaaaccaacgccgccgccgccgccggcgtgcttgttccggcgcagcagcgcatcatcatcgatcgatctaagtctaataagataatcaattaaccctaactaaataaaatgataagaacagtatatatggttatgatcagtgaaacactcgtcgatctgagggaaaatccggtcgagatcgagggagtggggagacaaattgaactgcaggctagctaatttaatcgtgtcgatcgatttctagcttttgttgatctttatatatacgaacgcatgcactttcccctttgtttttttttcccttcgatctgcttggagctcatatgctatagatcttggggcatatgtatctgtcagctttcgagagcggctatgtccatcgatccctcttttttttctctttctttttgtagtatcagctgccatgcatatatcagatttcgttttcgcgtgcttttagtgcttcacttatctgttcgccatatctgatttcttctcatcctttgccgacgtcgtctgagcagtctgacctccaagatctggcgaaataaacctcaatcgttgctatttcttgccttgaatctgcataaacatgacaatagatccttctattttttttcttcaagacaagatcttgctgtttcttcccttgctatttttcattcaaagattcttcttttttttctaaaagaactatatatatatgaatcgagtttcatcttcatcgatctgtctctctccttttgttttctgtaaacacacacacgagcgtacgtatatatactctcatctctacttttatcaaaaagaaacacacatgttctagcttcagatcccaaaataatcaaacaggaaaatatatataatatgcaattagttcagatcccgaggtagatttcttgattatttccattttccaaagtgaggcgcgcgacaactcgacgcggttcctctttgcacacacacacagtataactgtacgcaaggggtaagaacaaaggagcaatcccttctgggttgctgcttgcttctcccatttttagctatttcagaatttcactttctgagactcatctctctctctctaccagctgcattatttcacttcccttttttcccatttctgcctattacacggatggcctctttgtggactcgtccaaattgaggcacggtagctggtgtcaaaatgaacctgcaggcccagcccggttatgtatatgtatagctatatagcttttcttgcaagaggtatatacactttgtagttttagccagtggtccagctagccatggatggatatattatacacacgtatatatagtacatgtatgtacgagtgttaattaaactcgtttagttaatttccaaagtccttttttattactacagctagcctgatctgtgttttagtgtgttactgttccattagttactgttctattgaagagagcgcgtacacgttgttgttttatttctctttttccgatccggtgttccttttttttttcttttggtcatcttcctcgagtcccgagcagtagaaatactactactgccctgcaaagcacacacatcaagtgatgtgtttttcttcagagcttcagacgtgtcatatcaagcaggtcagcacgcattacatgcaatataatactcctatatggacacgcagaactcactttgatcatgtgtgaccaagctggatgagccgttaatttgttgttgggacagggtattgaatcattaattgcggtttttcctctttttcctgtcttgttctactcagagaattgaacggtgaactgtataggcagagctagtcctgcatgcatcggttttctgaaattattaactatacacacacatgcacaattgctaaatctggtatacatgtcttgctgactcacatattcgttcctcctaattaaagcactcatttatttattttacacggttttcaatgatatactttaaatattaatttgtttgatgttatatttctatgaatatgaaattagcatcatatgaaaatactttaaaacaaatatagtgatataacatgcataatacttagcatatacttgtatgattagcatggtcattaatcaaaagttgccgagcttgaattttctaaaggacagggtgccttgtaatttgggacaaagaaccattggaaaacgaacacaaagaaactttcattacattaattatctgaaaaagaaagaaactttcattaacctcgtacagtaaatagaaaagaggaactatgcatgtataacgaaatagctaggatcacagcaattaattagttgttctctggctttacttttcttttggagtaactttaatttttctttggaggatgaagtagttaattatacaggtttccaattcttgtttggtagatccttttttatgttcctggaagagctactatatttttgtacttgagatggagctgaggtaccgttatctagctatgtcgcatctcaaggagttacgaattaacatatatcaccaatatcacaaaaatgctccatacaaaaagatcataaaaattcttgaatttgcttgctgtgtttttttactatatatgcttggaattaaaaaaatgactgaattaatcgtttgcaatctttaacggtgcgtgcagtaccaaattggaaaggtatccacttgttcaaacttaaaaatattttttttactgatattactctctaaaaaggtgcatgggaaatgctattggaactactagttttcgggacattataagaaaatgtatgcatatatatatatatatatggacttatgatatgggccagatacctatatatatagaagatatatgtgtgctactacctccattcaacaatacaagcatttgagccagttctggtcaaggatataaacatcctgcactattagcttgtacttgtcaaattaatgatctctaattcaaactttcttgctactttacccccaatcacccttcccaaccatcttaatctttgctaaacattctagaaatgcttattgttggatggaggaagtagctattaactactcctatagtttttttaactacctcatattaattttgtaatcctaataaatgcactatatatgcccacttttaccgtgtttccaaactggcatcaagctaaaatgaatgttaatttagtttccccataattttatgagaatcgcaaaattgtacctattttaaacaaatcaaagtcactgaacaaatgaacggaggttaattattatattcacctgatataggcagactaggttgggctaagagggacattaatttgggcatctaggttttgaaatgggagatatggagagtgaaccaaaaaaaaactgttagtgaattagtacatgatatatactagtattattagtgggaacctagagaaatgcaaagaatgttgcgcaaatcatcattttgtgtaaattaaaatgggatatacactatggggaactatagctgagtgtcaatccccaccttttgtttgtaattaaacatgtgtttatgctacaaattactccctccgtactcataaaggaagtcgtttaggacaatgtttaagtcaaaccttgggaatataaattatgaataactctcaagttgttgagtttgaaaatgtaaaaaatatatgaatagatttgtcttgaaaaatactttcataaaagtatacatatatcacttttcaataaatattttatagaaacaagaagtcaaaattgtgttttggagaccgtgtcactgtccaaaacgacttctttacgagtacggagggagtatgttctacatattggctaatattgttgaacccttcggatcaatcttagacacagtagccattttacccactgatgcagcaacccaattaggtatctactaattagcatcatagtgcaaatttgtacttttcaagtggaaaatagaaattatttgtcctcctttactttaatttcttgataatatgatatatgtaacataatttctctttgctcccaagcatataaaaaacttcaatttgatatgtccaaaaaatgtcatatatatagcatgtaatcctctgtggcaaacacgtttttttggctcaaattaagaagaggaaaaaatggtatatatgtataaacctaacaaaaatgccccaacaagaatagctttattttgtgaacaaggtcatatagaccagggaacaaaaaccctgtactgtgcttctattttgctatgcattttggataagtgattctacagaaatatgactatataggagatattctcaaatctgatcttttctattaattagcccatacgatatgaagacatatcttcctctgttctgattctatttgttgtgctaagatagtctacaggatttgctaggttgccacctgccgtcaacaaaattcagctcatcagattttgttatagttgctagcacagttatattatacgtatatctcttttgagaatatattattacagtccattgatttttcttgtagagtggaaaatattattgtgttttctaaccgtaggagttcatgtggtgttatttattttggataatgtggtgtatttttatgagaaatcaggatcgcgtcaacatgaaagtttcatctaatacattattaagtgcatcgtagcaacaattcatatattaactcaaaggtagctttgaaattaagatgcatgtcattaatgcataatagagaaatcaggttaccaaattatattaagcccatatattaactcaaaggtcatagctttgacaaatgctccttacagatttctccttgaaccaatttgtaaaatatcctctcctttttttttgcgcgaacgctaaatatcctttgtttaacaacctcgtcaatttgtccatttcatatgtgtgaacatccttgtacattcttttttgtgccgtttgaaataaaactttgaataaatatgcacaacttaaatgcttaaatgtcaattggatttggatgaaacaaaaccaaagttttagaatttacgatctatcattatgaatttatgtatgatatatcacactctttctgaataaacttcagaataatataaattgcttaattatggtatacatgagcatatatagcttgcgcaaatcaaaactgtacagtaggtgtgtgttcaattcagaatagtattctatttcgaatttaaattaataataccttctgtagtaatttctatattagaaaatttatacatacaaggagcactgttaattagctagctagctttatgggttccactaatcaatttatatataataatgtgctaaactatacagcgtccatgcatttttattcttcatgcctaattaatttgattcaccattaattaattctacgtacaatgttcgaatgtgtgactatatatgctgcatctgcagttctgcacctcattcagtactaaattcaagttcaggttcattaattaattcacttattccttcatttttcacttccagcatgtacaaaaccttggagaggtaccgcagctgcaactacaactcacaggatgcagcagctccagaaaacgaagtaagcatcctcttagtttcttaattaacaatctttgacaaatcaattacttcttactagcagaacatatattatgatttatgagtcagttattcgcttatagtattctctactcactaaaaaggattatgttacccttttttttcttatgagatgaagggtcgtgttatctttgttaattttttgggacattgatgttatccttaatgtcgaatgcatatatagggttttctctagcttcatgttttgctctgatatgtgcagtgatgctcatgcaagtgaaaatgagctgggctcttaccgtgcgtaggttaacaggccggcccattaatagctaacagtttagatgggccgcaatgctagatgccgcgggggacgaaggccttacattcaatgggccgtagggcgagatacggcccacgtcggaggttgtgggccgtagggcgcattgtgactttgggccgaatatgcttacttaaattgggcttagaattgtgagaggtttctgttcggatccgaagagattgatgccatgttgtctatgttaacattcctcatgcataagtaggtttagctgatagtctaaaacaggagtgaatttagtagacttggtttgcaattagaatgctacatggtttcctgaatactttgttgtgcctacagtttgttaaccatcttttttttccccttcggccaatatggtctgatatcttgtagcttcaggagtcatgagctaatccgtgtgtctgcaattttgttgtttaaaccagattaattaccaagaatacctgaagctgaaaacaagagttgaatttcttcaaaccacacagaggtagtcttcagagatgaatgtggccaatcatttcagcttcttatctactacagagttgctatgttcttcctgagggacagagtttctatgacttactagcaagcacttcacaccatgcagaaatattcttggtgaggatttgggcccactaagcatgaaggagctggagcagcttgagaaccagatagaagtatccctcaaacaaatcaggtcaagaaaggtaaaaatgtttgttcgccatgttacctatgcaagcaaatggcactttttgatatgctcttcttaaacactgaacctagattagattaataatgagcttattataattttttactgcaactatcatgtaattcggtacttattacccctcaactgtatggatttgtttatgtgcatggcttttaacacaggctcaatatttctgcagaaccaagcactgcttgatcagctgtttgatctgaagagcaaggtactgaataaattctggttcttttcttttttcctctgcacctaaattaaatctgtgcacatatgacaaacactaaaattgattctgcaggagcaacagctgcaagatctcaacaaagacttgaggaaaaaggtaacacagccatcgatcaccctgaaagtcattgcgtgcatcagtattcggacaacatacatctttttccttgctaaagtcccaaccatgatcttttcatggctgctaaaatgtttcacgaaagttacagtatttgcacggaataaacctttttccccggtacggcttaaaagttaatcagcttctcataccgctgaagcgtttgtttgttcgtgcagttacaggaaaccagtgcagagaatgtgctccatatgtcctggcaagatggtggtgggcacagcggttctagcactgttcttgctgatcagcctcatcaccatcagggtcttctccaccctcacccagatcagggtgaccattccctgcagattgggtattcttcttttcttccagttacagttaatttcttgcctgaaaaaattcccaaaatgcagaggtcatgttctttttaaactattcactaaattattaaacagagtatttgctcaagttcgaacaatacactttcttaaaagatggtttgctatgtattacttagaccacttatctcgatttacttgtatattttattttttttcaaatatttaatttataactatataatcgagtatatcgataatcctgacaataattcgcccaataatctagatcaaattgggcctaattttgtctttgttattcagtaatttaaaatttatgtatatatactccatcgttttcatagctttaatttaatttttccttggtgaaggtatcatcaccctcatgctcaccatcaccaggcctacatggaccatctgagcaatgaagcagcagacatggttgctcatcaccccaatgaacacatcccatccggctggatatgatgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccaaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctcaaaaacttgtggagattatgttagggagtagtgcaagaaatgttttaagacggcagctgttatctcatgagatattgataatgatgttgtctctgctgctgtcgcgatcgccaaattatgctgtttttttagattataccgaaatatgctgatggatacgtggttttgatctgtggccgttgcgaagtaagcgcgatttatttctgcaggcgttcgaatcacgttttactgttggcggtagttactgcacggtgactgttcgacgaaatgccaaaacaacccgcaggctgcagccagtcgacatgtgcggcggccgtcgcccgatcgcgcggctagctagtagctgtcggcaccgccggttggttacccgcaccaccgggccctcgccgtcgccgtcggccgtccttgcgctgcacggacgcgtcacgcgcactgccgcctgcctgcctttgcgctgtcgggcgggcgcgcgggcagaaagcgaccgcgcgcgcggaggggggcgccctcttccacacgcagcgatgcggaggcggcactggcacggaactcccaccgagccgacgggcccgcccgcccggcggccggccgcgccgcgccagcagctggacgaacatgcgtgcacagcgcgcgcgcaggcgaggcgcggcgcgacgtggtgcttcggctcgcgtcctcgcgtacgtacgccgccacggccaccaccgccatcagtgtcgcgttatgcacttactcatactgaacactggacagagcacgatatgcagcggtgtttgtaccgcccggcccaagggacggcagactcgccggcagaaaatcaaattaaaattgcaatgttgcaagtatatgcagaagatcatgcatgatctactgaagcaatggattgcctgcagttagcctgatttctacctgaaaatcctactccctccatccgttctaaaataagttcattttttatccatctcacacgtatcaatacaaaatcaaaaagattaaattaattttatttatcaatcacaatgtacttgttttctatatattttaccctactctcaatacatttatcttctactttaaattttgatgtaaggattacttaaaaataaatttattgtcggataaacgaaaagaacttcaaaacaaacttatttttcctattttgtaacggaaggagtacttaatttcaattcgatcgccactgaaaatcttactgcacagaccaacagtgcatgcacactgaactgaattttgacgacgctacctgaaaattacttctctaccgtctcgatctctcaggttctctgcgcatccttctggagttctggtaacggactgattattcaagtaatcaactgaataatactgccattaaattaacagcgcaatatgatctcgtggaaccaaattaaagcgaaaaaaggccatgcaaattgacactccaacatacatcatggaacgaattcgcaccaagaaaacatatggtactgtaatatagtactatctgtcttaatcaggctaacttttgtgactttaatttctagacaaaaacgtatgggatagagacggagatacaaaggaaagagactacaccatcgaatggtacatcagaatatctaagctgatgtatatctgtgtccaatacggatcactctataaactgggtcaaaagatggtcctcacactctaaccagtagccagaaat

SEQ ID NO: 74895 - DNA, 11448 bp, Oryza sativa
cggagctagattgatttttagtcttcaattcacaaatttcaatataattattatttactaaagaaattaattccgtcatcaatttattcatctctaactctactattataaaaattgaagttgtttttcgctgatactttggtacatcgtttgcatttgagcaggtttttaagttcgttcacttttgacaaaaatataaggtttttaagaaatcattttaaaatactacatgctaacctacgatgagaatgagacttctaattgcttaagaattcttgccagacaataagaaaacaacgtacaggatatggccatcatcccaataagagttccaaatagatatcattactatcaaataaaaatcccatttactttttagacaaaaaaaatctaataacaatatgattaaaatagcattcacctgttgcaatgcacgggtattttttctagtcaatattaaaatttaatggagttttcactggcaagcctgggcaactgcctaggctagccgggcggtggctccgccactacatgcagttaattcagagaaagcatatatcctactaatagttgtttttagatgtataagggcttacgtgtttggttacctgcttagagggtggctcgcacgcacatataggtgctcggtaggggaggtttcatggcatgcacgaccatcggggctaggccgcacttgtgcaaaaagcgctcctaagccaggcctgcgagttgcgagcttcatttgttccatctccacatgcatgttgttgtcgtctctccattggtcgttcagatctagcttggatccgatcgacttgggttttcttcatcgactggatttggccggccgcaaccgtcatcgctttcgcctccacctcttcgccgacggccacccccaactagatctgccatcctcgtccttctttgctagatgccacgcccctagccatctccaccatcatcgctggctacacctacaaatccgacgatggagaacccccaaccagcggattggttctatgatggtggtgagcaattgggcagtgagtgggtctggctcagcggcggcgagcccacgaagttgccccttgtttttcctcccccaccccctccccctagcccttttcctcttccttaatttttcttttcaccaatcaagtagtcatgtacatatgtgatgatggttttgctgttcatggatatatggatatgaattcaatttttattttaaaaaaacaatgaatttatttgacttagctgcatttatatctgaaatgtgtgtattttataataatttagagtatcttgcacttggtaatatttctatttatgggtagtagggataatcttaccatccacatagaaagatgagtatactcaaggttcatttatccaaccaaacgaataccatgcatacaagttttcacatatcgatccaaccaatgaaacaacacctcatataaaaccaggttaaactaatacatgcaaccaaacaaccactattacaccttgctaaccacaccaaggtcagcctgaatgatgcacatatgtaaggcaagctgagagtatttgagcaaccggccccggccctatgaaacgcaagatagaaaaaacacaagaaaaggaaaaaaaatgcagaaattgtgtagttgcatgtttctttaatcgtacaaaaaaagcgcaggaaagatgaaaaggagctcttcgctagcattgtaggaactaacaaaggaaagcaaagtttccaagagatttgacctcttgcttatttttcccctataaaattgaaccatagcagtgcaatcctttatgaaaaatttcctatccttcctatgaatcaaagggctctataggaaaatttttccttaattaggaaattgaatcctccaaattacttatggcaaacattcatttcaaagtggtatggtgctatcttcagtaaaatatctcctttatctgaaaaataaatttacagataattgtatttcacatatatagagatagatctgcactgactactgattgcgtgtttatatatgtgaaaacctgcaaacatgcgtattttacatatgataattaattatatcagttgtcaactatagtatgaaacttgaacacatgacatatactttgcacacgatttataagatgacaaatatatatatatatatatatagcatacgtacgtatatcgtacggtagcagcagctgggtcttatagggggtacatactccatgcaacaacaaattaacaagatcaaacataattaactaataaacacaaaacgagcacagatatatgctaaaggggaacgatgagcatgcatgcatgagctgagctgacgacggtgataataagggggatctgaaatttggtactctccccagtggccggcctgcaggctagctagcttcatacgagcttcaccgccgatatagatcgccgccggctccggccgccgccgccgccctagccgctgcgctccatctgcttgaagatgtcgaagctctcgaccacctgctcgttggccctctcctgatataacatcaataatatagcacataattaaagaacaattccacggtgagatcatatcacacaagaactatctaaaatcataatcgttttgtggtggccatgcatcaaataaatcaaatcatatagagaaactgccttaattatactctcattttgtgtgtatgtatatatgatcggtgtctctgttgctatggcaagttaattatcgtcaatatgatcatcacctgatgaggaatgggagcagctactactctgggctcggggttgctgttggaggtggaaaccgtcgatgagcagcgggggtcgcacttcgcccactgcataaatgcagagctgatcatcagacacttgcatctccatcggtgcaagtaattaatattattgtactagtaattgatgtgtaagcaaggtgcgagagatctagagaccgatggatcggttgattatagctaataactgtcacaattatcacatgcaaattgggggccgggagatattggggatgagtagagcttacgttcttggcagccatgctgaaggcctccctgtgagggatatctggcttggcagctttgatacgctgtatttcctccctgcatcatcatatattaattataattaattgatccgctaaaatatccatgtgcagatttatttctgagaagagagtgtagtacgtacgtaggtacatgcaatgcatatatgcatatggttgtgtcgattagatataaactggcattgtctacatatatatcccagtttagttgtcccatgcatattttattccctttggttaattacttcatcgatgatatatcgaagtacgggtctgtaaaaagattaattgatactctctccatctcaaaatataataattttcagctcttagaatttatcctaaaatataacaacttctccaccaacattctctttccaatcaatcacaaacttccaccattcacttttcccacctatctccactactcatccaatcacaaccctccaccactaacttctacctactttcttaataaccgtgttcaactctaaaacttcttatattctaggacggagggagtactaaatgtgatttatattacagtagcattagcatatgtacaataattagctcgcacacattggataataatgcatgtgtggtgttttgctaatatatcatatgttctaccttttgatactacttatttgtgttcaagctagtatattgtcccattttaattttccacgaatctgtgaaatttcccctgcatccaactttcaccataaaaatatatagattggtcctaggcttattcagttttagtgaaataattggtttactaactcaattagtatttaattaaagaaatggtcaatctagtagcaatgcagtatcaaattaacttaaatttatagcacccactattttatggaagggtcggttaatttaattaaaactatcccatggatgggcatctaagagcatgctgaaacttccataagttgtacacgttaagatggcacatataaattaatgtcttttattcaaaatgatctagtttttttaataaactgttatactacaagggcgcacaaattaacagccccatcttttacagttacgttagtaatttctaacaacaaaacaatgaacacttaaaaggcaagatggcttgcattatcaggaatttaacatcaacaagtgtgtgttacttatagcaggtaggttggtaggtgaaactacttttaaattaagtgtgtttaatttagttaaaaaatttcagaaaaggatactccctctgggctgataatacttgtcgttttggacaagggtgaggtcaaactttaaaatctttgattatgaatcattttcaaaatatttgtttttcaaatatggtgaccacatgtatagattagtctttaaaagtactttaataagatcatatatttgttaatatttttttacatattatgatagaaaataatggtcaaagttgtttttttgaagaccgtgcccttatccaaaacgacaagtattatcaacccgtactactagaaaaattatttgttgccacgaaaaaaatcgtggcatcaatactaaaattgtggcaatagatacatattgccacaattttaaaatcgttgctagccgtggtaataaatagtgtagtaataggttattgcaataatttttatttagtggtaataaatttagatgttgccacggaatggatgtggcaaaaaatcatattgcaacacttgatatcgttgtaataaaaattattgccaccactccatatgtggcattagttctacgtaccaaattaaaagtacaaatattaatctatcatcctatctattaatttctttatacagtgtcttggctaggattcgaacccatgtatattgttccatttgagcctacctaactaagatttgaatatctaaaagatttcatatgaacaagttatcaactataaaattatagatctcgtcgagagctataatttccatataaaatttgtctcaatccgtatccatatgaaaaaaattaagttaaattatgagacgacaatttttttattgcaacgaatttgctgattgtggcaacaaaaagtagtgaaaagtaccattattatgtaaattgccacaaaaattaaaattgtggcgatagaacatattttttttgcaacagtaagattttttgtggcgatatctcattttctattgcaacaaaagtactaaataaaacaacaattgtagatcattgcaataaaatatatttttttaccacagaaaaattatcattgcaatagtacaatatattgctacaaattattttttgttgtaataatttggtggcaatagctcaattatcttgtaatgccggagggagtagcatttatacttagtgtttatatcgaagaaattaaacataattgtatccaattgtttataaaatatatgtaacacgtacgtattgatgtaataatttgtcgtaaatattgaaaaataatctttgactagttatttataaaaaataatgatgattacgttctataacacaaacaaaaggtagttcaaatatcaggaataatgtatgaaaatattaggattgttggtgtgaacaggaaacaccaaaactctttttttttactttcattttgttgaaacaaattaaccatcataactgctttagatattgtaaataaatatctagcataggctgcaggcatcagatataagatgcacacaggcattaatagttatatatgggtaactatgatataagtgttttttttcttgtgtttataaaattatttgggaatcaagatgaacgtactgcccagctcattgaattaaataaagatgtattttgtcaaaaaaaataaagatgtgtattggtcatgtgttttcaaaggaaaatgtgtttactaatttattaattattactatcatggcctggaatctgttccaaaacctgagcaattaacagggaaaggaataaattaaacaaaaataaatgtacttttgttaaaaataagtgttaattaaataataaactaagttaaatgtgtatatcaacatatacatatatgtagagagagatagagatatgataaaatcaatgcaaattggcaataactaggaccacattataattatatgcagagatctcagctaaataaaacagctggacatggaagcctggaaacagagagacccttcactatatatcaacaagaacaaaatatattaaagaaaagaacatatatagtggcaactaaaaaaaatgtaaaatggggtatttattttagatatacaattcattcaccatatccatgtataaacccccaagctatcacaaggtttaaatcagaccatagatcgatgccctaaaaaaagtcagaccatagatgcactttatttctttttttttttgaaaatatccacaaaatgacaaacaagctagatatccataatatgcacaatggtctagctaggtaaattactggagtagagtgtttttgtttgattaacagaaacaaattaattaatattcttcaattcacaaaattacactagctatagtagcctttatttagtgtactgagatttacaatataaaaatgtcctgaccttggatgataaattattttatgtatattcttccttcttttagaaggggataaatccccttcaataaaatcgaaactttctcccaaaacaggtgcagatctcatagagtttatagtacaggacaaataaaaaaaatattgaaccactactagctccctcaaaaaaaaactcagaacaaatagaaaaaatatatataagatcacatgagtgcaaaccatattagggatcacaagcatatatataagataaatgcatggacaaataggtaaatagtttctcacctcatgaagcggttgtaagcagatgggaggcggtgtttcttctctggggctacaatggaagacataaaaacatttgtcagaggaaacacaagatatgctagctagctgtttgttcatatttatatattccatgtgaacacaagacacagagagctagtgaaggactcgtcagaagaagacagttaacaattagcaagaaactaaggagagactgaatgactgatataaatgagcagtaagcaagcaagaaatttaattagaaagatattgatatctactctagctggtatatatgcacgtgtatgatatagcaagtgaagtgtgcatatagttgctttgctacttacgcttcacaacgaagggtgctcttgggctaccctcatttgatgtcggcgagaccagcggcagcggctggttcctcctgcagtcagtgcaaggtccctaacaccaagaaatatccaacacaagaagcaaccaaggttaattactagcttccagctctagcacatttcaagatctctcaaacgcttgccatgcatggatcagtgtagtagtagtagtagtagtagtagtagtagtagtagtagttggatgatgataaaatcatcatttcctaactattttctcagatctctctctctctctctctctctctctctctctctctctctctctctctccctctctctctctctctctctctctctctccctctctctctctctctctccctgcttgggtagaagtagctatactagtcaactcggaaaacaggcaatgaatgcatctttccacaccaaaataaaaaaaaagaagtaaataaataaaaatgcaggtttaatttggagaggcatgaatgccacagtagagcagctgctagcagcatatgctgcctgagaaaaaaaaaagatgaactggccggccgcttttgcagcatgaggctttcccaggccacagatgggcaagagagaaatcttttgcaatccagctttgtttaatcttgccttgcaaacagtattctgagtggctccataaagccgagacaggacacagagagctagagagagaagggaaaagaggagagagaaaccgaacaaaagaacaccccaaagctctgctaaaccatatttcatgagaaaaaaaagtcccactctccatgtgcaattaataatttctttaattatatgtcttccctttcttgtataaggagaaagatttatcgccagcctttctcctcgcaagaagctacccatatgcagaaaagagaaagtagctagaaacagcaacacgagaactgaagaagatcaagacgacgaagaagaagaagaagaaagaggaggaaaaatatcaagaactgcaaggagattcagagaaagagagagagaaaagaatgaaacgctagcttaattagctagaggagaggactgacctgaaacgggcccaaggggtgatcagttggggagagcggctgcaccatcggcggccgcgggctgaggaaggagaggttgttgcagtggccacatttcacggtcacggtgtccatcagcctcttgcatgggactccaacctgcagctacccaaaagacgaaaaattaattaatcacatcatgcaattaagccaatactttcttcgttaatttcatctctttgttgcatggcactgtccttaaggagaaaaagtagaggagaacagcatatctgtgtggaaggaatctagatggagcaagcaaataaagtgggatatgcaaaacagagagggaaaaagaaaaggaagaagagaagattcagtagtacttgttttttaatggaagaacagaagatgcaggtactactaaattggattcttgtccagtttaaaaatgcagcctgcagctggtaacaatgaaagaaggggatataatggaagcgaaagatggaacatgacactgcgagagaaccagctgagtagaacattctaccacaaagcatcatatcaagagctatggccaatgaattttatctaagaaagaaaaagagagctagccaataaaacaccatgcaggaagacagcaagggcacatcaatcacgtgtcatgaacaatccccagtggaagtttccactagcttagcagctagctcctcaggacacagagagagcaagcaagaagctggatttggtcccagctatctagctagctctctctcactgtgtcctgtgtgagagtaagcatatgccatgatgcacattaagcaagccaaaggattggaccaaaccaaagtgagagccctctctgcaatctgcagcagcaggagatcacgagacagaaccaacactttgttctttgctctcttgtccaattcaaaagataaccaaagaacgaaggccatggtgcagctgcagctagcagcagcatatatcgatcgttctctgcatgcgaagctaagccgctgctccggtttctcgaggagtttaccgcgagcacggtgttgcagtaggtgcagcgcacgtagcacaggtgctcggacggcgacacgagatccattgcggcggcgacgacggcggcgacggcgacaagcaagctagccctagcactgaggcggaggaggaggaggaggaggagcaagtgtgagcggtggtgcgggggaatcaagggcaataagaggagaagaggccggaggaagaagacgggaaggaggagagagagagaggggggggggggggagagttgggcacagcgggaggaaggatggggtagggtttctattgttgcaataatggcgagggggtcccacgcacacatggaccccgtacgcacgagaccaaccacagtgatcgggagagcgagcaccagaaaagtttttatttttccttttctttctttctttctttcgaggcaaatgttgcaagcaaagctaagatagatagcgagatgagatccatggttggatggatggatatatcaacatacaccgctctatcttgtcgaaacgaaaaagagaaacatcttttttaaaatggtaattttaccatcattaaaaagatacctagagaaccatatttactaacgtttagtatctcgatattttctcaagaacggtaaaatttctctttttgaaaaaatatagagatggtgtgtaagaagcacgggatattctcttataacgtgtagaaagactttttcatgtacgtatatatgtgtaactcagcatagtgatctgacaggtctcttctatctctctctctctctctccatatgtgtacatgtacactacacatcgtaatatcatatgcatctcgaggctatgggaacagtatatgtttgctcctatagctagctatagcatatgcttacagtaactagctagagtggtgtccatccgatccggtggcgaagccacagtagtactacatcccatccagttgtgccttgtactgtgccctcaaattgtgaatggtccaattgctccctctctctctgactcggaagatagtaccggtactgcttgacatatacccctagctagccaggttcctaattaaatatctaggtgttagttctcagagcacctaaaataatctctgcagtttatagatttttgaaatgttttttgaaaattgaaatatctaggagtttcttttttctatggaggatcggaaatgaaactttggagcttgtgtggtgtgaaatctttagagaatatcttccttaactggcatttgagttgttgaggaatgtagtaggtttctcagttttattttgtaattactccctccatttcatattataagtcgtttgacttttttcttagtcaaaatttttcaagtttgattaaatttatagaaaaatatagtagtattttcaacataaaacaaacatattattaaaatatatttaatgttcgatttaatgaaactaatttgatattttatatgttgctaattttttctataaaattggtcaaatttgataaagtttgacaagaaaaaaagagtaaaacgactacaatataaaatggagggagtagttgacagcaccttgtgtatacatattttctcttcttaatataacaccagttgggctggctcgatttcaataataataattttcttatagataattctttaaatataaatatatgaaaaataagtatatgatttttcaaataaaaatcgcattagtaaaattaataataaaaatatttctattgattatgcgtgactagtgtacttccaatcttttttaggagtgttttagaagaagtaaattcagataaattatagtagttaagagtatttggaaaagctgatcgtggacatttactacataaactaattgatacgcatacccatacatggtaactaattaacagaattatcgtctgtgttaagtaattaccctgttggaaactgcaaggaagtcgatggcggatcgatcgagacatttcactagatcgatcattggttgctgccagcttgtttggtcttgactagatcgagcatgatcagcg

SEQ ID NO: 74896 - DNA, 8970 bp, Oryza sativa
ttgtaggtccagataacatactttgatgatacggccgatcgacactagctatatgtgttcattatgcactcgtgactaatcgattatgttagtaggtgagtttttcacatgagagttgcaggtacgtttaggcatgctcctagcttcagtgaaaaagtacacgtaccgctaattaatgaaagcttatgatgggctgccttttactgatgtttcttcggtgaaagaaattgaaaaatataacggaaaaagcaacagttggggatcatttggtttaactgttcatgacaaaaacaagacgagcagggaagattttctatctgagcagcagctagctagcgggaaaaaggcgacgggctcgcatgcatatgcggtcgtacgctcccaaaatataattctgtgattggtaattatttctccctgagcaggtcgccagcatgtcgcagttcattttctctattacacatgtggagacaaaacagtgcacaccatgaatgatatatggagtatatagcggtacatgcatgcgtatatatattcccaccctgatgttgttgattaaattcagtgaaaatgtactgtctaattaattactaccagcagtaattttattctcgagctgaacaattaattactctcccatccaaaaatatactactacctattttagcatctaaattttatccccaaaacatatcaacttcttcacttactccctcgttacaaccttcttttatttaacttttgatctttttatgaacacgcaaaagaattgcacgtcaatatatattaaaagaaagcagagtttcagttacacaacgcaacctgcaaccattgccgggggacaagggaaaattaaaaagaaagaaaaaaaggcaatcgcaactaattataaccattcttatttaactcttgtcttaatctagcttcatgaaaaattctagaaatatttatattttggaacgcgagagagtacgtgtagagctttacaagaattaaactcatgatttgccaatgatgtgtcccactatggatgatagagctagtagctagcaaggctgcattattattgtgcaccatgggtgagtcaaagcgaaagtcaacaggggaatatatatagtatatagtaatgttgatccccttgatagggccgggcatgcacaatagagcagagagaaagagagagagagagagagagagagagagagagagagagagataactagcatatatatgcggcggcagctagctgatcttgctgttatatgagttgtgacaacacaaaactgcatgcactaagctcggacacacttgggggtatatatcatgcatggtgtatctctgccgacatatgatatggaagcaaagtttgattcctgcgaccgatcgatcgatatggccaattggccatatgatatggaaaagtagtttgttatctctcgctcgatcgtcggtcggtcggtcgatcgatcgatcgatcgatcgagagtagtagtttctgtacatgtgccgccggcattgtgttcgcatgcatatgatagagagatcgataagcctaaggagagcatgcatgtagccgccgcttgcacacacggatctgtttgcatgagagcaacactagtggctctcgctagcgatgggttgtgttacacgcagcatagcatgcagctggggccatccacggatgcaagcatgcatgccaacatattgatcacaattagatctctgtagtagctgatctctccctcatcatcaaaggctctctcgctgctcgagccgcatgcatgcagctagcgacatttccaacctagatctatctcaggctcaccagcgagagctcgatcgattgagagagatctcaatatctcatcagccatgtgtgcactttggccagcagtttgatcgaaatcaagagagagagacagtcacacacagacatcacagaggattgattacgagtactgactgatcatcaccactgagatcagaacgcacacgggagcacacacgaatctgatcgatcggaacgccgcgctgcgcatcagctagcggcgccattcatgcgcggcaaaagcttgatcaaggcggatggcgacaccgggagcgcgacggacggacggacgcccaccaccaccaccgtgacctgctgctccggctgatcgatccccctctcgcttgctgcatatgctggcaatttgcaagctagctccagtgtttgcgtgtgtacgtacccctagctcgcgtgctgctagctgcaggccgtccaggccggtgaatgcgcatcgatcgcgtgcctgcacaccaatcagctcccgccgcgacccggccccacatgtttgacacagtcagacacacacacacagtgcgatatctgcgcatgcgaggagagaaaagattattacagtgtggagtagaagtgtagagacatactagctagccgacacttgtttggataccagccgatgcgtcgtacactgatcgatttacgcacacatttagtaagcgaggtcgctgtccggtggaggttggcgagaccaacaagcgcagctaaagctagtgacgacgacgacggcgacgactgcgaccgcgcggcctgtgtttgtgtgggtggtgatgtgacgaatcctcagtttcctttccaggaaaaagcgccccaccccaactctgcccttctagcttactcccccggcgcaacgcgcccctgcagcctcgctctccccgtccatggcttttctcacagcgcggcgcctctaccacagaacccattaaactccctccatttcataatgtaagattttctaacattactcatattcattagattcgttaacatttatatgaatgttagcgatacgctagaaagtcttatattatgaaacggaggaagtatgcgacgttctattagtgtcggttagacaaaaaccggctccccgaaccaccagctgaaacaaaactagtacgtgcgggacatattctcgtactagttttgtttattttgaaatgacggagagagtactgatctgcgccggaggcgccaagaaaattaacataataactaagcaactgttatattggatgtgtggtgaaaagagatagtatatgtgcatgcaattgcagtagtagtgcgtgtggtggtggtggtggtaggaagattctaggatatcttgtcacctcaagcgccacctttggttggttgggcgctaggtctagcccagctacgtcgtacctagctacacctcgcgctcgatcgatccatcgctgctgtagctaagctatcgatcgagcaaagcaagcatatgcagcagcttattatcaggggcatgttttttttcagcgggatgcgtgtatgtaacccatctcgagcacactgtacatgtggcgtctgtgcccctcttctccattgccatgacatgccctagctagctattactagtagagatcgcagctagtagtagtatagtatagtactagtagctactatgctgcttgcattgctgatcgatgctgtgtgatggtagtacaggggaaatttaatagcagtagttcaactgtggcgcatattgcttgtcagctgcatgtgtcaagcgcatgtagtccatcgatttggatgctgctgctgctgtggctctcggtgggctgtgggctgtggctaagctagctgacaaccaagcggggacaaaacgagctcatcgatcgatcgctacggatgaacacggcgggcgccctagctatagctagcagcagctggacgttttggctgcttcaaattcgcagagatcatatcacggccggtgctaacacacaaccatcgatctcactggtgctaacacccatcccactggtcttagcaatgatcgcaacgcttcaccgtacgtgtcagctgcaaaaaaaaacaaaaaaaacactatttgatcatatcatatcactggaatgtatatatcgataatacatcaagagggatatatatagctttatattgggctggctgcttggattcttggcatatcagaggaggcatgcatatatgatactccatatatatacggttcaggcgcaaacagggatgcttgctgttactgcaagttgctaggcacgcagcagccgattgctgtttgtttgcttacaacacgtagctaggttagaagagagaccctgtttaaccagactggttgatcgagcacaatattgtgtgcgtgcgtggtacccacacaaagttaatgccgaacaaccatcctgtttcaatccaaacgaaatagtgttttgcatcttttgaaatatgagcacggctcgtcgttgactccctctccaaaccttccaggtttgttgaccaaacatttctgcagtggcaataagaggaagaaatcaaattgaagcaatgattaatttgagtgggcagctatttaatcaccaaagaataatgggacaacattcatggtaagctagctataggacttcattaaactctctccacaagcttatcaattccattctgctattggatagaatgacagggaaaatagggggttccggcgagccaaatactgtaccttttaattcaagttgttccagtcgaattctggctagtatattgaccggaattgatataaattgttccaagcatgaattataaattcttaagccatgttgtattataaactcatttatctatatcatattttctctcattatagtaccattttaaatataattacatctgaaatttcgatgaaatagcatatttatattgttttattaatcccaaaatggtggatcattatcgcctagctggtatatatctgaacattgagtcaaaccaaaatatcctctgtgattgaatggcaagcctccactacacaagctactccctccggtcataactatttgatgcacggttgactttgtccaaaaagcttaatcatttatgttattaaaaaaactatgtaaatattatttattcttttgaattattttatgattaaaggcactttgaccgtggtatatactctcccgtctcattttaggtgtagttgtgggttttcgtgtacaacatgatcgttcgtcttatttgaaaattttatgaaaaaattaaaaaaatcacacataaagtactattcatattttatcatccaataataataaaaatactaatcacaaaagaatttttaataagacggacaatcaaacgttggacacagaaattcacaactgcacttaaaatgggacggagggagtatattttttcgtatgtgttctatttttttaataagataaataatcaaagtcatgactaatatactggctagctagacacgtattggcatgttatttgtctacgagtgcatagtttcagtaaatatatgaggttttaattgacagaagaatcaaaaggctaataaggttgggaaaatattaattgtgatcgcaatgctctctttgtaaagcagtactgtttgatttgaacaataaaactagtaatttaaaaaataattttcttgttgattttcaattcgtatacatagacagacatatatacatccatgcacttccctgtcaccatgttggttgtctccagtgccaggacaggtgcactgtcatacctttttaacgaaatactggtggtagtgcatgcatggacgcatcaatacggggtcgttcacatgcgtgttttctgttcaacattgcatgcataattctatgttcataatgtaagaggaagaaaaatatgaagacacattttcctaatagttcgttactctctatccatccacaaagataagcattttaagatatcaatgcaatctttgaccaataataatacctatgaggaaataaaatactttaaatgaaaagagttgtatataacgatggattgtttcacaacaaatttagtaacatatcattcttaagtcactaatctttataattgttttttttctattgacgatcaaagttaaaagagaaatgcttgacttgttaacactattataaacgtgctcatattatatatttgtgaacataggaagtaaaacacacaattaaacggatattaaatccagccatttaaagccgaattgatgggaaatcataagaaaaatgatgatggatgagtggggaatcaattttttgcaatcaattggagaaggaaatgcatggagagacagatcgacgtggcgacggaggtaggattagcctgggaagaaaaaaaacagtgacgaaaagaaaaccgaaaaatcggaagcctgcaagaaaaaaactgcaaaaaaaaaacagcggtggaaaaaagtatgtaaaaaaccatgacggaagaaaacagcgacaaaaaaataataaaatcgcgatggaagaaaatgacgacgaaaaaaaatcagacggagcttggagcataaaaaaccaaaagccttacaatttttttattaggtatatagattaaaaccgtttgaaacatggacgacgtgccaaaattctggcagaaacatcttcaatttttataataatagagatatactcacaaggaacaatattaagtggttttcgattacctaggttatattaaatctgattagaaagaatgacccattagttcctatatatatgcgatgtttttttaacataatattcactttttccttttggacaggagggcgcagcccctttatgtgctctcatgcatgcaatcactgtgtatagcatgccatgttaaggtggtatgcatgatgcatgatagttaatgatcgaagtgggatatgatatggtagcagtgtatctctacaaaacaaacaaattgagacataaaagagaacttgtgagaagtaaaggtgtattgtgtttgaaaccacactagcttgtataaacaataggttggaattatgtttttagacatcaatacgttgctacttttccactaattaatttagaaaagaaatatggccactgtctattgacttgcttataattatgaatgtaagatcattttttgttggatatatgtacatatgctttcttgtgctctccacgcggtgtggcgcaaattaattttgttcaccacaaagtatagcaaattttgtaagagtttgcgattaattaggttgtgcgggggacaggataaataagctagaaaagtatagcttgccacaagtattgtcgcaatatataaaataaacatgttggtaatataatatatagtcaaacttccctagctacaacaaatgtggcaagttcatatccaaccaaatgccccttaattaaatcgttgaaaacagtttccttttttattcttgagttgaactgtcaaatgtaagagaggtctccccttatacaaatttaacattttcttttgttttaatgtcattcatgttggcatacactgtagcaaattaaatatgttgttttgaggtttttccatgtggtcatgttcatcaataggaccttatttgtatgcttctatttgatgcttgtcgagccagagtagtgaacatggaaaatacgcattaaatatataggtgtgttattttccaacaaggaatatatggtggatgaatgcgcatgcttcccaagctcttaaacgatatgatttgcttttctttaaaaaaaattatacgaatttcttatataactattttaatttcatttttaactttataatattttattaacttgtcaatagaataattatcacaaatcacttcactatttcaaccatttaagctatgccatgccgccattcagatattcagtctcatacaaagacgccattgtgatgatataccacacctattaaggtcggatcaagctataatggtttaatttgctccaatatctcacatatttctccgagatgcattcaagaaggaagtttagattggcatcgtcattgaatcacaagctaagacactacgaaaagaaccaaaaattaatattacttccgtcccaaaatataacaaaacttataactatgaatctagataaacatttatccatatttatagttagaaatgcttatattctgggacggaggtaactaatactcgaatgaagccaccacacaggatgaccaccgcaaaatatatattcccattccccaacggccacctaataatcgtaccaccttgaagccacacgattgggcatttatatttctaagatgtacatcccatgcctagtatgtcctcctatcaaaataaattcattttttgactcattccttgcataccaatacaaaacaaaaaactaaaatatacatattttatcaaataacagttcaattatttctttctttatatactcccaatatatttatcctctaccttcacaaattttgataaaataattacgtaaataaatttattttagaataaacagggggctaaaactaaacttattatgaattactaccataataaaaaaaacaagatttggagggagatacatcacatcaaatattttttaagaagaaactataagcatgttagagattgaacacttattgtatatactccagtaaccctatagtaacgatcgggtacttacaatcatatccttgactttgacactttacttgcctcggagacacgcacacatgcatgtaggtgcgcgcacacgcgcaatgatggtgcaatgagacacgtcggtacgaacgacccgcgctggcctaatcggccaaagaaaaagccaaattttaaattttcaaacttaattttgagattgattttaagatattttcaacgttgtttctttttcaacattgcttttaagttaccaagaacacatttataaaagttttacttacaaatttatttttattttctaataagctgttttggcttattaggccaaacgatggagaccgaagtataaagtatagccgtagtaacagcaattgcactttattagttgtacatgtcgatccgttagagacatgcgcccacacaacaagcacgtatatatgtacacatactgatcgatcgatcggcctcc

SEQ ID NO: 74897 - DNA, 4911 bp, Oryza sativa
caccaccacccacagccaccgggctagctagcttccggccgcgggcgcggacgtacgggcggcgggcgcgcggcgtggggagtcgggccggtttgaccaccggggagacgtacgcctcgtgcctgatgggcctctcgtcgctcgctcgatcgatcgcagttgatcgggagctacggttgatttgcttggtgctcgatcggagatcgagaggcaggcgggcattattgtgcttgatcattgggtgcatgccctagataactactgtatccgtcctaaaagaaaactcaatctaataatagaatatggtacatcctaatacgataaatctaaatatactaaattgtttatattctaatattagattgtttcgtcccagggagtatagtgaagctgaaagttgttgtaccggctgactagtactgtacttgttcagagcgccaacgctgcaggacgtacggttttgattaagggattaattagctatatactacgtaactttcgacaggtgattaattaatctacacgcttgatgggatttgaggaaccaaataatactactactactactaatcatgcataaaatatggatatctcgtataaataaaaaagagaagttaaatatttgtatacacgcacgtacgcatgcattcaagtgatcaggaccttgatcacgggacacagccagccggggtccctaccaacaacactccccctaatcgatggttatcgcagtagtgggcacgccacacatgactaggtttcgcgctatttccacgacatgccatcgctgcccgactgccggccagccggccggccggcatgcagctgggtctgttctggctggtcctagcggccggccggccaaactcgcgacctcccctcctcgctgatccgatccgatctctttctttaatcagcgcaaagcctgcgtctgcaacgtactacgtgtcgctcgagatcgagctggatcgatcgcgatcgatgcgcacgcgtacagggcgcttacgcgacgaatcacacgccctgcgccgcctgacgagagctagctgagctatcatgtcgatcgtccggccgcggtcggctctccgctccgcgccgcgccgcggcgtgcagtgagtgccgcgacgacgggcgcctgggccgtgcgcatgcatgcgcaacacgagcaagcgaacgtactcccccgcacggtcgtcggtgatcgagctagctacgcgcgggccattgatgatgaggttgatcacaatctggttggccggccggcgtcacatctctcctgaggtttcgcttgctgcctgcctgtgctgcgggtccatcatgaactcaatttgatcatcagagattcacttgcacagtagttagtggaaccccacctcgctgcacgaaaatgaaaataagttacgtaaataccccttgcattatatattctaccgaaagaacagtttttattgattccgatttcatgcatgtgcatgggttggttgcaatggagtggtttcattatctaaaatgaataacatttccaaccaaaagataagtcgaatcaattttgctatatatttgtcgacaaattttctcccaaaaatttaacagatgtaatatgcagtacaatcgtagtgtaattacacagtaactgtatgtaattacactttaactataatgtaacttatatgtaactttcaaaaatctctccgtaacatgttatttcggtaaaatagaggtcgtgggaacaaatcctttcacatatgtgtgtgctgtgattttttttctttctcaccagaacaaatattgtaatggatctaacgattcaaaattacgtgaaacttgcatacaagttacactatagttacatgcaagttacagtataattacactacgattgtactataattacataatttttagaagaaattttgtcgacaaatgcataggtggtcccaagtcggataatgccatccactagtaaatagcacgacgcttcttcgtgaagctcattatttgaatatattgaacatcataccattgcgaaagatactccctcgtttcagggtataagatgttttaactttggtcaaagtcaaactgtttcaagtttgactaagtttatagacaaatatagtaatacttataatactaagttagtttcatcaaatcaataattgaatatattttcctaataaatttttcttgggttgaaaatgttactacttttttttctgcaaacttggtcaaacttaaaatagttttgacattgactaaagtcaaaatgtcttatagcctgaaatggagagagtaacaacaatgtttgaacgagctccttaggataagggctccttcaagcaagaaaaggaattgtgaatgcgtctaattaagaagggtaagcaattaattccgagttagagctagggacagatttaaggtgtgttcgctaatggggtttaggaacccatctcctccgcacggaaaatggaacagtccattagcgcgtgattaattaagtattagctaattttttttcttcaaaaatggatttatttgattttttaagcaactttcgtatagaaactttttacaaaaaacacattgtttagcggtttgaaaagtgtgcgcgcggaaaacgaggaagggaggttgggaacctagggcaaagaacacagccttagagtataccgaatcactggtggagaaactgtctttactctcggtttgtaacaccctgtagtcctggttttctaaccggccgagtgaaataaccggtagttaagttgtatctttagtcccggttggtgttatcaaacgggactaaagagagggatctttagttccgattggtaacaccaactgggactaaagagagggtaggggcagtcccggtaggtccattttctttttattttctcccaaatcgagtgccatgtatatatccaaatcaaacaccaaatctccaaatcgagtgccctgcatatacccaaatcaaaccccaaattctcaaatcaaaacaacatcccaaatcattcacatcacaaatccaaagttacttacacacaaatcaaatactcccccgtcccaaaaaaaagacaaaccctaggtttccgtgtccaacgtttaaccgtccgccttatttgaaaaaattatgaaaaaaaaataaaaagataagtcacgcataaagtattaatcatgttttatcatctaacaacaatgaaaatactaattataaaaaaattcatataagacagacagtcaaacgttggacatggaaacccagggtttgtcttttttttgggacggagggagtacatcacaaatcttaaaaaaatacacacaaatcaaatacatcacagatcgattatacatctcagatcgatgcaatgaatcacaaactgtacaaaaagaaattatacatctctcaatcacaaattatcaaaaaaaaagccggagagaaccggcgcgctgccgctcgccatggctgctgcttgccacggccggcgcctgccgccccgtgcacggcccccgctgcccaccgccgcgcgcgctgcctcgtcgcctgttggccgccgccgccggccgcctgcccgctgccggatgtgaggaggagaggggaggggagaaggaggaaggagattcgaggggttgaaggatatctgattttatctaaatatctcggtgaggaggaagtctcatctgggacttaaccgatcatatatgggagagaaatatttactcacggttggagactccaaccgggactaaagatagatgtttagtcccggttggtaattaaactttagtcccggttggtagtatcaaccgaaactaaagatcctcgtctcctggcatgcctctgacaggccatgaaccgggactaaaaatgatctttagtcccgattggtaacaccaaccgggactaaagatcaaaattttttatgaccgattgtttttagtcccggttcttattagaatcgagactattgtagaaaacagctgacccagcaaatatcacttttccagcagtgaatgagggcttggtctctagcaattttacaccgatcgatctagtgggggcaaatgcgtccttatccatttttaatttctcattctatgacactcgcccccacgtactcactcattttaattcctgcggatgcccttgctctgagttcaatccaacacggaattaccgtacctctcctactttaaattgctagggcaataaaaatctattaggtgtgtgatatgtatgatggttatccaactctataccttacggctaggttgattatattgccgtgggagctgcccgtgcatggtgggaattctgttgtaggcataattattttggagtatcatttagagtcgacaagggtcatatacggtgtttggtaataatcacaaactaaaggttaggaaaactcttttgataggaggttgggactcgtgtcattcatacatatatctctctctatatatatatatatctataattactctctctattctaaattaagttaatataatacgtgatgtgacgaatcattgtaacacgaatctaacgagacgtacatgtcctgattcatcgacaaatggatataaagctagataaactctttgaatcgaaacaagaaggcatggtgacgagtcaattgatccaccccacatgtttttgtgacccagtagttctattgtatagatatttacgccaaatatgtaatctatatatgcaagattagctggtgcgcacagggatttaattagttctatctctacaaacggtgcattaaacagtcacttgcaaaatagaatatatgcatctagaatttcctaatattcaagaaatgttacaatcattttaaggggcaatgcaattttactttggatcacttcatttgattgcggacttgcagtgccaagtgg

SEQ ID NO: 74898 - DNA, 5586 bp, Oryza sativa
ctgcaccccaaaatatttattgaaaagtgatatatgtatacttttatgaaaatatttttcaagacaaatctattcatataatttttacatttttaaactcaacaactcgagagttattcataatttatatttccaatgtttgacttaaacattgtcataaataattttttttacgagtacgaagggagtaagtgattatattttgaggcggagagtataactttagcatatatatatacacatatatccagctggggaaaaaatgaagtatatatatatgatgggacagatgaagacgaagatcgtgatccttaatttaatttcgtcctcgcaaaaacaaataaatgaaggaaggacttaatcagatcccatatgagacttcgacgatggcaaataaattactggtttccctcagatttggcaagtctaaaatgggattaataacaagatggagatctcagtggagatgcggacgcacggaaagagtcacaagtaggacatgactgtggggaaagtttcatactcctatatatctggtccctgctgggacaacctgatcaggtgatgttatcttttttgttattggatttgacagcattaatacgtgtaccagaaagatgcagttgtactacttgaagggagcactaggatcttatctcacccccaaaaaaatagggggcaaaaaacggagccacctgtgaatgatgggattagagacatactacgtacgtatgacccggccagccctgctccctccgttccttaaaaaaaataaatcctggtttccgtgcctaacgtttgaccgtctatcttatttaaaaaaattataaaaaaattaaaaagacaagtcacgcataaagtattaatcatgttttatcatctaacaacaatgaaaatacaaattataaaaaaattcatataagacggacagtcaaaattggacacagaaacccagagtttgccttttttttttggacagagagagtatgatttttagtttgaaccaactgcattttttcgttctacacatgtttttttcttgtctttgttgcagccctagaaattttgtttcccctaattaactattatacatcctcaaagatagagtacttgttgtatatatgtcctcccgaatgtatacgaatataattaagttgcatatatatgtggctattgtatgtaggcatgtcattaattcccgtagtctttttttaaaaaacaaaatggatatgctaattgccacttgctcgcatgggatgtcgaccaaaagcttaccattattccgcagatatataggttctctgtccccaaactttacacctggaactgtagtgatgccgtttgtggggttaaaatgtatttactactttagtaattgatcagtccttcagttccagtgaaattaatgtctttcaacaccgcacgcccagtgtattttacatacagctaataaaatctgttatgtaaaaccaacatttcatttatttacaactgcctccatcgtcctgcatgttttattgtttctttaatcaaagtagagaacatgaactgcattgtttctttaataaaataacttttcatagtttatgggcttgttctgtttgttcccaaaatttggcattaatatcccccaaaaaattggcacactttggcattaccatttttttttggcaatgttggatgtgcttggtttgccacctttctagaatttggttatgagatgttggttgaaaagaaatgctctcatttttgacaatgtccaaccatctttcaatacttggaaagctgatttcaaggaggatttcgctcttcttatgcatagagtgaaggaggaggataaacctagatatcaatcatggattgacaacattttttaaaattttcctcttttgtatatatatattttgtaattttcctgtaactcctgttcatatattaatatatttaccacacagtaggagcctctcctactgtttaaggtaaaaaaaagaaggaacttctgaaaatactaaattttggtagagtgataatggcaaaaaatgtttgatttgttaacttatcaaattttggtaaaacaaaaaatcgtagggtcgaaagtggtagcaaactggacaagccctgtgactatatatatatatatatatatatatatatatatatatatatatatatatatatatatatatatatatatatatatatgatcataccagagacaaacttaagaacttaggactcttttaatattaattacatatagatcaaagatgcacacgctcctaacaatgttcttgttggactccaataagattaggaacaaaattagcttatatgcgcataaaaatgatagggaaatttcgtacattaattatggtgttttgttggatctttatgcccataaaatagctatttttttgtttactagtaaaatatattggacacaataagtacatatttgaacccctgtgttatataacatgtttaaaatttgcaaatagtattcctgaacattgaaagaactgtggcatgcaggaaatatataatactaatatacgtgtgtgtacgcgcacgtgcgaggggggtcagtcatataatattccctcccatatacatatatatgcatgtgagcccgattgagattacaaagataataaactaaagcctatcaccgataggtcttatcggtgacgggcttaaaatacatgcacgggtacggtatatcttttttacgagtatatttttgtcggtgtttattttaacctgttagagatgacgacactgtgacggtctgtaagccccatgcacgggaaaggccgttacagataagtagttctgtactagagtgtgatttttttaaaagaagaatttcttcacttgctctcattacatgcactaacacgaggaccccatgccctgtatgtcagtgagcaagtaattaagagatttaactaaagctggtatatataatttacgaggaaaaaccaaaggatcacagaaaatcacagaaaataactaaagctggtatatataatttacgtggtagtactgattgatcgatcagttctctgctggccgatcaaacgagttgatgagcagatgtgtgcgcgcgcatcgagcaaagctagcggcatcatcgatcgatcaggaccacaataattattcgatctctgcaaatacgaactaaggacagtccaatcctcgtagggtcgcacaggggcagtgcttgtcccagattagcattggcacctgatcaatgtgtatgtccatgtcagttagacgcttacatctcccagaaatttccctctcttttcattgcgagatctatgagtgccctcttctttttttatcaggcccactgatcacattcacactagctcggccagccagcagctgcttccacatggaaaactaaggcatcagcagggttaattctggagttatgcatttgctagattggcttagcatgcaaccgttcaactgagaaatcatcaggtgcgtgcgtatatgtgtgcgtgggacaaagccaacggcaaagcgtcacatctcacgacaatctgggcgcagaagggcaccacgtactgctcgaattttggaaccacacgtacattttatcgactgacgaacaacgtcgaccgaatagccaggaatcatgtgatcgatgagtttggggtcatgagagccccatgtacattggatgttctgaataagctcatcattatgctggagctaatgtacgtacggagtatcaaacaaaattgctgaatggagatgagatgtgatcgagtgctggcacaaaacgagtatgtgtcgtcgatttccttttccttgcacggatcggagcagaaatcaagctagctagcatcctgacagttctctgacttctctcctataaataaactagtcaaactaaatagacccaatagatgtttgccgttggagtttggagataatttctccattcactactagaaaaatgatccttgctgggtcgggtgatttccacaatagtcccggttttaataagaatcgggactaaagattgttgctagtcccggttgatactaccaaccgggactataaagatcataattagtcacagttcatcccctatcagaggcctgttagggggccaagcatctttagtcccgttgatactaccaaccgggactaaagatgaccagtaccggttggtaataagtaaataccatttaccaatcaatcttcacgggagtaaatatttctctcccatctctgatcggttaagtcctagacgaaactttcctcctcactgagatatttagataagattggatcgatcacatcccctctcctcctaacccctcagatcccctttcttctcctcccccctcctcccctctcctccccctcctcccctcccgtccagcagtcggcggtggccagcggggccacgcccggcgggggcgcgcacgggtgtggcgagcgacggcaggcggggccgcgcacgggcgtggcgagcggcagtaggcggggccgcgcgcggtgacagtagcagtggcaggtggcagcgtccgttcttttttttatatataatttgtgatttcctgagatgtataatttgtttttttagaacttatgattcattgcatggatctgagatgtatttgatttgtgtataatttttttaggatttgtgatgtatttgatttgtgtgtataagtaacttaggatttgtaatgtgaatgatttgggatgatactttgatttggggatttagggtttgatttgaggatatgcatggcacttgatttaggagaaaatacagggattaacatattataagactttctagcattgcctatatttatattgttgttaatgaatttagacacatatatatatatatgtatagattcattaacatatatatgaatgtgggcaatgctagaaagtcttataatatgaaacggagggagtagcaaagaaacaatgaaaaaaaaaagaaaagaggagattcaactttactccggttatttcacccgggattaaagatgggaatctttactcctagttcccaaccgggagtaaaaacggttaccccagtagtgatttgtccttaacccttgccacatacaaagaagaagaagaagaagaagaagaagaaaattcatgtgtatccctgagattgcatgtgtttgtgatatatatacatgcaagtattcttaaactgagctgaataaaactttttttttgcgtggtgaataaaactaatttgatccatcagttgacctgtgtgtgtctatatcctcatctcccaacttccccagccctaattgagcacatgcaagctactagcacacactatccacgtactccagtacagaagtactacgctctaattaaatactactattagttaaactccctgatgaggccagttagcacggagagcagtgctagctagcccagagagagttaagaaggcccatctttggagggggttggcatcctacactctagctagcccacagtccgctgccggctgccggccagcgcgcgcgtgcaagtctgcaagcaaagagttttcagatgcagatcgaagcaccg

SEQ ID NO: 74899 - DNA, 14184 bp, Oryza sativa
ctcgctcgtggtgcaataatgcaaaccgcgcgcgcgcgcgcgcccgcgcccgtccacgcgcacgtccctacctaccggctcacgcagcgcaccgggacgcgcgtgttttgacggcttgacgcgctcgcgcgcagtcgcacacgtacatccggcttgtgtgtggttttgcctgattggctccgtcgccgccggttgtcccgcttgcggcgcggagaggagacacggggtcgttcatccgtttaattatttgttggtttcctccagcgcagaagctggagagtgaccgatcaccgttccgccctctccaggaccgttctcgccacgttctagtactacctaccgcgtgcagaagattgctgtaccagtttttttttttctttttggagccacatccgtcacaccgtcctctctcatcaatggcgacatgtctgtcggatcaagacgttggcctgcagcagagtagaccatacatatgtgtcgaccattcgcccggggtggcactgtcactagtcttcgccaagatttgtactttgtaattgaggaggaacatatagaacgctagctatatagttaggtccaacgaaatactttatatggactgacatcgatacaatacctaggtaccatacggatgttaacataaacctcacgtttcaattaattgcatactgtacatgttgcagtatttctatttgcaatcggctaaaaaacagtcaaagggttgctaatgaaattagagggagactacaaaaaggatcccgttagaacgggatattttaaatgactccttccctttctttctgttagcttccacatgtgtttctcctagcacctggtaccttggataccagctagtacctagtacctggtaaatttggtaccgaccgatacttggtacctggaaccttggtactggctggtacctaggtatcacaaactttggtacctaggtacctggtaccttggtatcggctggtacctaggtatcacagactttggtatctaggtatcaagcatgatacttgtgggtaacaggcttgatactgaggtatcgcgattaatacctgataaagatggccgtggcacggacacagaagatggtgaggtttggccataagtcggcggcgaccatctacaggaacatgcgcggcagcaacttcatcttgaagttgatggcgaaagagaggaggtagagattctagagtaggttatcgtcggcgttgcggcgacagaggcaccgggaccgccgacttcttcttcttcttctgcggcggaggaggagccacctgtgctcactagcaaggaggcggcgggagcagcgggcaaggacgatggtgctggtggctcgcgaggcaacggagaccttggcgaggagtgtgagggaggaggggagaggcctcgacgcctacagtgacggggagcgccagtggaagaagcggcgccgcagcaggcggaggacggcgtcgaggaggcacggcgagatcaccctcgacactgccccgacctcgccgacgccgggccgttgtcgtccacctcggccgccggagacgacgacggcgaccccttcctcctagctggcttcatttccgcgctcttggagagagagagagagagtttgtggaggggaagggaaggagataaggtagaggagaccttatcccgttgtgacgggatactattgtgtagattctctttttattaaacaagtggtcaattacccgtgcattgctacagaacaatatatatcaagaaaaatgtatgatttattttgctataatatttgaaacatttttaaacaaaatattagttgtgcataggttaagaatggtttctcagtaggactgtatactgctcatacgaccaaaacagcaccccggatctgtcaaaatttacgatttgtcacatctaaaatatacaaataataaaaaaacaaatgggccggcatactgtgaatattattacggcccaaatgaaaaacccaaattgaagcccactcataaaacaacttaaacatattaaaacaataataggcccatcatacaaagaattttgagcccaataaaaattgtccagattaaaaattcaaaaaatatttggatcaaggccaattcatccaagcccatatggaggccaattatataagaaaaagaaagatagtagcattttcttaacatgtgtgttgagttgttgatcgactaaacatgtgacgaaatacaatttaatattagaggtggtgaaggaggtacaccaaggatcatgcagggcacatcaagctgcacgggcggtagcatactagcaaccaagatatttcgccaatggctatactggccaatcctgctacatagctccgaagagcatatcacgcaattcgtaggtgccaaaaacatggtatatctcactccgtcccatagtacaacctttagctgatcttgccggtctggccgttcgcacactgggagctactccggatgtggattttcatccctcgaggggacatctcctcgttgtttgcatgtcatctaaatagttatcaaaaaattttaaaaaaattggcaacatagattaatacgaaatatatcactccacaaacatgcgagaccatattcaacttctataagttgcaacaaaaataacaaactaaactgaaaatagttatcgcacattcgcaactatatttgttatttttgttacaacttgtagaagttgaatttaaacttgcatgtttgtggagtgatatatttcatattaatctatgttgccaatttttttcatattttttgatgactatttaggtgacatgcacgaaacgaggggatatcccctcgagggatgatttcactttcccgagctactccctatgtttcacgatgtaagactttctagcattacttatatactatacatatagatgttaatgaatctaaatatatatatttatctagattcattaatatctatataaatgtggggaatactagaaagttttacattataaaacggaagaagtagatataattggtcctttcccaacgacaaagaatagctacaagttgcaatcaagtacttttgaaggtggattgaagcagaattcttggccaccatcacttcagccaccgtataatgatttgtgtggaagaaaaacattatatgtcgctttgcattggcgtattgaaataattcaccgcgaagggtctggctcataaactggaaacaggaaggcttaatataaaatagttattgccaacttaatatattgacattggatttatccttgttcagttgccagcttggttttctactatagtatatacgattaagagccttacctggtgaaggtaggtgggcctggctcaccacaaaacctttattctttctcatgacgtaaactagtggagtcctatcgatatcgatcttatgttgctatatacttagcatttgtgtctacgtaaaccaacataaaagaatgtaacaaataattaatgattgcttaccttggggaagatctttttagctcagatcttcttcgtatggtcacctgaaccactatttacatgtgcgatgcaataccagcttaagcataacgaaattctcagtaaactacgttgtaggattctatgtggcccgtatctaaattggttttcttaaaacacgatctactgtagtgccgtgatatagaataaaccatattgcctccgtttcataatgtaagtcattttagctttttttatatttatatattgatgttgataaatctagacatatatatgaatctaaattcattaatattaatatgaatattagaaaagctagaatgacttacatgtgaaatagcttacattgtgaaatagaggaagtatatagtaagcatgtaattcaattttccttcgcctcttttctttctgatgactggttgtctttccatgacgcaagccaccccacggagagctagtttgcacctaatttatctgtctataaattgtaatgtaaacaatgtcatatcaggcataaaccttctgcaccactaagcataaacgatgtcctggcttgctttaaatgtcttatccagcgaacactaacacacaaacgttgctccgaaagtctatcttatccgataacgattagcataaactaaccttaggccggtgtctaaatgactttaacatctcatgtgatttcttaagtgccgtcagcatataggcaataccaagtgattttagatggtttggacgtttggtagttttcaattttcatccagatacctctcttgacaattccatccacttgtctattcctgtcctgtgtggaaatgatcatgtctcgattctagataggcaaaatcaatagatatgcagttacagaagttaataggacgaaatggtaggtcctatataaggataacgttcaaaattatatataagcccctgcgtaccatgtcaaattatcaattgagactttgaaaaggaaagcacaggtctcaacatggcagatatggagtgaaggatcatcgtggcctcttcctttatttctgtgcatttttatgcttcgcttttcatatactcggacaggacattgctacggaagaatagaagatggtccctttagttttacactccatttttttctggtttgttggatgccactgctaacattaaactatgcaaacagaacgttcaccaaagaaattaaaaagaaaaccacactaacctccgcagatcgactctagctaatccatttttactagtatgatgttcaaaggccaatggtaaatatatggtgaaaatcccaatttaagtagaaactagtgtaaacccatcaataaaaaatggaaaccagatatttcaaactgtaattggaattccacctctaatattaaaaaaatgatagatcccttaatattcttgaaaaaccatggataactagtagcttgaaaattgtttacttgcccgttcgatagtaaacaattttttgctcaacttacagccttattatatcaaaatatatttcatctttctgtcaaaataatatatatttcatctgagatgttggtggcctgattgaacttatttctacaatttccacttgattttgattctaaaaaacgttaacttttctttttagaccaatactatactacgggttggtttggtttgtggcctaaatagaccttaccaaattttgtcaatgccaaatttaggcaagttttggcatgactaattttggtaatgcaaagttatgtttggattgaagccaaaatagcctaagttctctattgaaatggcctatttttttaggcatgctaaaatttggcttcaaaccaaatagacactaaacactattgaaattgctaaatattggtaagcctaatttaggcatcaaaccaaatcagccctacaaaatcatttaataacatacgcggattgacgtggatcacaaacacatagtgcaagacacctacatctctgagtttgcgtctttatcacaaacgtagttttttctccacatctgtggtatatacttttatagactggggagacctgtgtcactatatttgattgtagtcacatctatgacttgacttttccgagcaactcaaaaaaatgtcgtattttactagatatactaggtactccaagtattcatacacatgcgcaggtcacatgatctttctcgaacctcccagataggtggcttttcctatgactcaattttgaaatcaaaaataaatttgaacaccttgactcctttagcctcgcttttgtttgtaggagtcgtcatgcattcatactatagcaataacatagagactaaaacttgcactttgtcctcaataaacatgttaatcccttaattagtcgcattgttaacccaccaggggctagatgcacttctagcgagtagattgcattgagatctacaattttgatatataacatgtctctgtctaatataatttaaaatttttgtttttaaaaatagatttgagaacttgtaaggatactgagacaaaagtctataatgaaaagtacttagagacacaggtataacctgtgtccgtcatagatatcaggcacactttttatggaaccaagtttgtgatgataaacctcattcattgacacgttttctttatccacatctatgatttcttagcccatgtgttttatttcgacatgtatctgatagcttcacagacctacatctctatggtcatttcagagacacagcgtcaccaatttcgtattttgtggtagtggatgttaattgtcatgaaaataccataacaagttaacaacaaaatcctcagctgaaacccccacatagcatgaatgataacatccctctgctagaatgatggatatatcaatggggtcgtgacatcaaacaagagaaacagggaaggcattaaacactcttcatcctaattacatgggataattgaaaagatgatttgttaaaataaagtgtatccaacacattgcataacagaccgttgaaatataggcaactctaaccctagtttgttgcctccactactttcctctgtccttgccaccgccaaaggggtgccctagaatctggctgccctcgaggaaggtggtggcggggtctcttccttttctggcgtgtgccctcttccggtggtatcgtcacgaagttatcttctttttaatcaaggccttcactctaacctacaaactagagtcatcttggtttcgattttcgatgtcgtttacgtcgatagcttagtgactcttcatatggaccgtacggattgtggaaatgtgtatattgccttcttcgttttataatcatttgagtagcatatctaaagatgcttgtagctattgtgtttctgatcgatcgaaattgtcctaagggttggagggggtggaggttatggctcgcagcgacgaggcaacaatattggggactttgattacataggtggcgctctttgggtaccgatttcttgagtctaaggttaaatctctaggtctgaccttcaaaatgatcgcttccttgttcaaggtaatgtctggagtcagtttttgtctccagcggtttagtattatttactaattgatcaatgggatcagcagcgcatatgcatcattccctttttgaaggcattgttttaggagagcatttttcatagtctaagttttgctttggtggtatttgagaatgagtatcaattgtggttgtattttgctctacggcatgacattctttccatgtcttccttttttttctttttaataattataggttatgtgcatcttaattatatagaggttatgagtgatttttagaatagttgtatcatcttgatgtaattgtttaatatcaatatagtttcttttattaaaaatattaaaagtatggctacataaaagagcttttcacgatgaatctagctatcaatataattttaatatttccaatgaacgatgctagtatatggtgaaaataatgttgtgaaaatataattgtctactatttggatggagtaccggttggcaagatatcaaactcgtatcgtaccaaatcgatttttttctgaaagcctcctgaactggtatgatgtcatgatgcagtgcatgtaaatattgatgttcaaggcatggcactttcttgctgatccaccaaggaagtgtcacctgtcaagcaggatatatagcttcttatgcactcaaagctgaattatcttggccatcggccttccaagctaaatgagcaatggatgtacagccactcattatgctacaactgactactgaggtaaacatccattgccatgcattatgctaaacgcactcgatcgctagaacaaaaaattggcagcacagccacatatcatcgagaaagtccctcttgggacgtatagtttactcactaattccccttttgactggatagtgttctcttcattcgtaattgattatcgtattatcaaaaaaaaatctgatttgatcatgacaacaacattgggagctagcgaaaatgtcctttttataacatgcatgtatgcatgactttaatgcggagattagttaaatcaccgatcgtctttaaccatatccaatgcgtgcatgaatttaatgcggagattagttagttaaatcaccgcttgtctttgctgaattaaagtaaaactatatttatttagggatggagggagtagttttcggtaataatccaatgtggtggttactccaattactcactccgtattcgtaaagaaagttgtttaggataatgttcaagtcaaaccttagaaatataaatcatgaataactctcaagctgttgagtttgaaaatataaaaattatatgaatagactttttttttgcaaaatactttcataaaaatatatcacttttaaataaatatttttataaaaacaagaagtcaaagttgtgttttggagaccgtgtcgctgtccaaaacgattttctttataagtacggagggagtatattagaaagatactacacggatagcaaagtgaaagtaggataaggctattcccaactcaatgactaggatgatgtccatattattaaataagctaccatctaagatgaaaaatgatgtggaagtgaatacgtgaggaaagagaaggaaaccatgacttgcatgagacatggtttctacacaacatataagacattatgtgagataagtagcattaaatttaagtatgtaatagtggtgtttgtattggaagagtagtgtctagtactagttttttgatgatgtagagtttatggaaactatgtctagttccttgggttgagaatggcctaattaactagttaggttttttttatggtataacctgttcactcaagttcaaacctcttcgacttaatatgggtagtcgtatttacggctaattattttttcaacggtagacaatatagccatctgtaatgaggtatatatggtgattttaccaatccctaaaagtactgaactaatctgttggaagtgtttataggagtatggtgaaatacgccctcagttttcaattgaataactattgccagaactactttaatggatcactcgtcttttataaaatgtacaaatatttctaattataaataacaatgatatcatattataaaaatgtattactaaggttttgcaagaccaaacaacgaatttattgcatccaaattaactcgatgatataaagtgaacgtagctcatatcagctagttaagtttcatacggtgaaactagctcatcaagtttttgtaaaatcaaaagtgtttttgattattattatgtgataaacaattggcatctgagattattggttttgaaatttggattattgtcgaagtggttttggagataattggatttacaggtgttaacaggtactgctgctgttttgatctggtcagactgggcaggtgctgccggtcggaccggcgtgtattgcgcggtcagactggctagcccgcggtctgatcggctaacattgtgtcggtttcggtttcagttgtttgtttggatatccgtgtttgtttcatgtttatggattctagacggatactatgcatatgtaatactgttgtttgctaacaatgagtcaagttggagatagcttggttttggaatatggtttctttgtttgattcatgtgtaggtgacttgatgcctcgggagagtatatccggtgatggatcggaagtcgacttggggataaggcgatgtctgtgacgatcatatatcatacgggatacttaggctaaagttcaatgcacgtgattggtgaagattccatatggcatacgacggaggtattgtgtgcgtatgggatgtggagtcgaatttggaaggagtccaaatttggtatggttagagtttgtaaagtttgtttcttgtgcgggaaggttttctaggtggattaggacttctagaatgagtttggttcgtggctttaggctgcctacctcatgtataaatagagagggagcgtgaggcttcccggtatcgcttttgagagcattgagttgatagtttagttagggtttcgagtttagtcgagatttttgtaaggagtactgttgttgcactttgtaaacatagagaggagcaataaagttgtcatctactttgagagttcttcgatttgtgttttctcgggttcggcgctctaaccggtgaaacaccgtcggtctaaccggctgcattgcggcggtcagactggcggcattgcggcggttagaccggcgtcggcgtcaggaggctgaggcgacttcggagcagtcagatcgggcaatctacatcggtcagaccggcggcacaggcgcggtcagaccgacgggactactctagtcagactgatctatatcgattcgagggtaacttttaattccgctaaaaaattatgttttttggtataccaaccattcacccccctctggttgtcttagttcttgtgtttcgatcctacagttttaaatcctgtaattattacagatgctcatatttacggctaattattatttagtggtaagtaacgtcaccgctaacagtgagatactcatgcttatagagataaagcttacatgtatatatgtttatacaaatgagtataagtatgttacgagcgtctatgtatgtttaagggttgtttctaacgagaaaagaaagtgactcaaaagatgagctggttgtacgtactaaggtctatgactgggcacgacattaattgcgtccaagatgatcctcatgtgggtgtgtcacacatttaattttttttagatatgttgttcattggttattgttagctaattattaattttgaatctcataattaaattagttagatagtatattctttcaagaatataaaccactaagaaaataaatatttagcaaaatgagtgtaactcaactggttatgtttcttacggtgaaactagtaaacacctcggtttaaatccgagacttgacacgagtcctcgtatttttatactatttcaaatgttagtagttgtggtgttcgttctgccacaccatccctacccactaacatttggtccccataatctatactattacatcacccctcaatgacaattattcaataacaaaaatcataaaaatacaacttggactaaatatgtgcttaattgacttagttagctagaaactcaatttgttttccgctgcaatgcacgagctcttccatagtatttctaattattctttaagtgctaggcaacatatctatcaataacaagatatctgccgtgacttgtcaatctcaatatacgtcgagcatgtttgtactgtgtctctaaaaaagaagatcaacatttataactttagtttaaccattaaactaacaacatacattagaattcctagtaatggtggataaaaagtaattagtcaaatatgtggttttatcagtttaacatatgagtatttatagtaatggtggataaaaaaaaggtaatttggaaccatgccattataattttttaaagtttgagatatgccatcggtatcacaatgacatgtaggacctacatgagtcaatgacatgtgggtcaggatggcatatatcaaattttgcaaaattataatggcatagttacaattttccctaaaaaaataattagccaaatatgtggttttattgcaagggaaggcttcatcaatctcaatatgtatcagctgcgttcgtactatgttttaaagaaagaaaatcaacatttataactttagtttaacaattaaactaacaacatactccctctattcccaattgataatcacatatatttttaggttattgtcaaatgatcaccatattagtattcgttctctaagtctattcgcataggagtaattaatggatattggtgcatatatccatgcacacaaccatttataaccaacatgcaatgttttggtttgttattggcataaggtaaacaatatatggctgagtaaggggacccatcccacatgacattgtaaaagaatgcaacatttaatagaaatgcaggatatttgtaaattgggtacaatatgatcaattgtaatgcatgactttccttgctcttgcactgatgagaccacagcaacgtcttcaagaaaccgcggatcgacgaaacggccgaaatctacgcgacaaacagagcacacaagcaaaacacactataagactactgaaacaggaaacaaaaccatttttaatggattctagggatttttatgaatttactgagacttgaatggacttaaacggagctcggatgaattacttatgaattttagaagataaactatgtttttactaataaagaaaagccttaataacttttattgcgtaatattacccagggctgatgtcagccgggggggctcggcaggtgggccccgcatgtcagcggcacaaggggagagggagggggtgccggcacgtgggccccacgggcaatggctaaaagggggggtggtccatcggctggtgggccccaccggggcagcggcacaaggcgggggagggggtgccggctgctggctcggcacggctcaagctggccggccatggcgtggcggcgacggcgcacgaccgccggcaacgacaagcggcggcgcgggaggcggcgcggacggcgcgaaaggtggcggcgtcggctgaatgcgacggcgcacacgcggagggtggcggcgctcatgggagggaggaaaggaagaaggagaggggatccctcaccgaggcgatgacggcgatcggcgcgggaagagacgagcggcggcggcggttcggagaacggtggacaaggtcaggcacaacctgggaaaggcgatgaccgggttaggagaagggaaggatgaccacggcgactagaacggccggccagagttgggcggaaatggagagctcaccggcgtgcgagggaggcggcgctttggcgacgtttggcggcaagcgagcggcggccgaggtgtgccgtggggagagcggcggagtgcacggcggaggccctagcggcgacggcgtgtggccggagatgggcggcggcggcggagctcgggtgtgccgtggggagagcggcggagtgcacgggcaagcgcggcaagagcgaaaaaaggtcgaggggggctcgagggagtgatttataggtacaggagggggcggacgtggcctgggaggtggccgatttggccggcgacgtggggtggagagagagagtgcggggtgggattcaaaatgaatctcgcccatttttgggcgcgtgcgagggcgggaggagcgggggaggggcggcgacgtgggcgcagggcgcggagtgggcacggggaggcgggaaaggcggcggtgtgggcggttgccgccggggtgcggtcggctggaggaaggggacgaccccgacaggtggggtccacctgtcggcgtcccggagggagggggaaggggaaacgggccggtccaacaaggagaggccgagcgcggggtaaggcgaggtggactgggccgatggcccaagaagagggaagatgaggaaaataaaagggaaaaaaatgaattccctgggatttaaaattgcactttggtgatttttaattggtaaaaattatttccaaggctctgaaaattccactaaaaatcctgttaatatattgcaacatggggaactcaagaaaaattccaccacgccatttccgattattaattgcattgattaattagggattcaactctaggttaattaaacaatttcttcgagcaatttatttaactaattttttttagcaagaaaagggggaaacttcagggcgtgacaatgtcgctcccgccatcgctgtttggcgctaccgcgcgagcagccgcgcgaacttcgccgccgctcggccatgcgtcgccgacagctcctctcgacgttttccccactgtcgctctcccagagaccccttcaacccccctcctttggccgccccgcctctttcctctagccgccggcctcccatccccttctatcgccgccgctctgcttccgccgctgccgcgcacaaccgcgcgccgtcgtcggccattccccgtcgattcctctcgcctccgccctcttggagctcccgtggccctccccgaaccgccgccttgaccgccggccttccttctcgtgcccgcgccgtgccaccca

SEQ ID NO: 74900 - DNA, 4418 bp, Oryza sativa
cgagcgggcaagaaaacgtgcgctctgcttgtcaaaggtcactcccggctgtagactagccctcattgtaaaaagcatgtttcctttcttaggcagctagaggcccatgtggtgacccctgaccagataaaaaggaggcccaggcctaagagagaaggaagaaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattcctcagatcgagggcgaagaatctcacttagcgcccccggccgaaccggcaaagggaggcctgcgcggtctcccggtgaggagccccacgctccgtcaatatcatattataaacataagattggaaacatccaaaatttgaccaaaaatttaaaatctgatatttcagaatttttgcccaaattttggaagtttttgtttcaggggtagtcatttggacaaaattgtacattactaatgaaagctaatcggatggcaatggtaaatcatagaagttaagtaaaagttgatggtatattatagaacgttataaagtcagtggcaaatcgtagacatgtgacaaactcggtgccatataatggattctctctatgttataccatgtccggggcatttcgttgctatgctggcagggagctgctaggggcaagctagtatagtgcaatgttccgtagcatccaagattccctcattatttatagcgtgtatatcaaactactagtatatatagcatgtgccgcatccataatacgcatgtaagaaatcaagctacaattcaagtttatgtgcagctagctagaccactaatgttaccatcatatattttttctagaatcttttactgaaatatatgaatagaggcgcagccactgtggtgggatggggtctggccttccccaacagcccagtaacaaccagcccctcctttcctacaccccaatagtttacttttgcttttaaatactaccttttatcaacatataagtaaaaataaccatgtactattttctttttaaaatatatgacaccgttaacttttcgcataacgtttgatcattaatcttatttaacaatttagtataaatatgtaaaagtataagttaagattatattttatttgatgataaaacaagtcataataaaataaatgatatatatatataataaaacaaaatagtcaaacattatgtgaaaagtcaatagcatcatacatttttaaatggaatatattttttatatcattagttgtctaacacttcaaaggtataatttcacctctccaattaaatttcaatttttctaaaatattagttaatacttgcatgaagatgcgtatatagtttgtttctcattttactaaaatatagttttttttggattgcttgtcaatttatttggaattttagctcggatgatactatcaccgcttatgattgtctgcttaatactcataggctaaattgaaatgaataaatatattcggtatatcaacatacctaccttttttattatcatgtgctattttttagttgatacgatatattacgtacctttgggaaacattacgtatattttttacactatatttttaataatcataatcgctttgtgaagttcgtcttcctcgtatctaaatcctagcttcactacgttgcatgtacaaaatgaggggacgtacccttaactttaatgaacaaaacgacattttacgaactactgagctacgagcaaagacactccacgaaatcgaaatgttaacttatatattttttttttttgaaaactagagggtgcatgcagcggtcgaagatgtagtttttgctagtctcattatagtctcttacactcattatagtctcagttcttcacaatatatattgattactattgaattatattcccaggtttcggaggacccaaacttggtaaaccgaatcgttgcatatttgaaggagcttcagtttccgatatgcttagaggtaccgagttctactccttctccagacgaaacagaagatgccgacaccgtgttcgatggcctcattgaagaggaccagatggtcatactccagggagaagacgagctaggcgacgtcgtcgtcgctgagtgcgagaccaacggcgccaaccccgaaacgatcaccatggagaccgacgagttctacagcctctgcgaggagctggacctggacctcggttcttatcagctagtcccgacgtcggcacgggagacggtggctgcggcggcggcggcggctaacgatgtcgacggcgttgcatactctcacgcctcgtgtttcgtgtcatggaaaagagcgaacccggcggagaaggtggtggccgtgccgatgactgcaggcatagagtcacagaagttgctgaagaaagctgtaggcggcggcaccgcatggatgagtaatattgatgatcgtggtagcgtggcaataacgacgactccaggaagtaacatcaagagccatgtcatgtcagagagaaggcgccgagagaagctcaacgagatgttcctcattctgaagtcactactcccctccgtccgcaaggttagttaacttagcgttccatactgaaagttatataggagtagtattattcatcgagctgtggattgtccctgcaggttgacaaggcatccatacttgcagaaacgataacctacctcaaagtgttagagaaaagagtgaaagagctggagtccagcagcagggagccatcgcgttggcggccaaccgaaattggacaggggaaggcgccgtaagatcaccgggaaggaggtctatgagatcggtgtcagtggtggtacctcgtcggtacctcgtcaacaccgtacgtatatgatatgcatgtataagatcaccgggcaggaggtctctgagatggatgtcatacggtgttgacgaggtaccgtacgtatgatatatagttatcgttttcattatggaaaaaaaattccgaattacctcgtgtactataaaagacgcgaatattagggaagaatctaatatcaaataattagaaggggtgaggtttcgaatccaggtcgtctatcacaccaccttgtgaagctagccggaaaacccttaagcgtttctctacctccatgtactattggtgccatctgaattaccgcttactaatagactcgattctctccacacaagctcaatatgatttcagcacatctgctaggttttgtcccttttattaacgtctattatagctagggatgcatttacgagtgcatgcatgtgtaaacatcttttatataattgcaaatagaagaataaattccataaaactatagactgcgaataaagtatcgcaagttcacataattaagatgatgcatcacttttattacagatcgaactacatatataagatggagtgttagaaagctacagatttaataataaaattaccatgaaactacaacatttataaatccaacataacaatgcttttatatttaaactctaaaatatatagttttgtgataacttaattattaaatgtgtagttttgtgatactccgccaatttgatatatagtttcatgataaatttatactaagatgatacactgtctcaaatatatatttttctataaaataattttagtttcttaaattttacctattttaaataatataatggctatatcagttcttggagacaaaaggaaaaagccaggaaactcaagttggaaaagacctcacattttcataatctaggaaaagacctcacatctattatataattaaaggaatataaaaggaaacctccacgttcgctctcatggcctagaaattctcacattaatcggagaaaaagaaaaaacagagtccatatagaaatacaatttagaaatagctgaaattcggaattaaaaaataaggaatattagaagaggagactagagtccatatagaaatacactttagaaatagttgaaattcggaattaaaaaataagaaatattagaagtagagtatagagtccatataggaatttaaaactaactaaaattcgaaaaaaaagagcctccacgttcgctctcatgacctagaaattctcacattagtcggagaaaaagaaaaagcagagtccatatagaaatataatttagaaatagctgaaattcggaattaaaaaataggaatattagaagaggagactagagtccatatagaaatacaatttagaaatagctgaaattcggaattaaaaaataggaatattagaagaggagactagagtccatatagaaatcctatttagaaatagctgaaattcgg

SEQ ID NO: 74901 - DNA, 3540 bp, Oryza sativa
tgcgccgcaccgccgccggacaccgcgccgccccaccgccggacgttgcgccgccccgcgcgcgtagccgccgtgctggagaggtgaggggaggggaggagaggtgaggacaggccagccgtgggtgaggggaggatttgagacttagaaaaaaatcactcctatccaagtctatttatattcgagtctattttcgcaggcggaccacttaacgccgcttaagtggtccacctgcgaaaatagattttcgcaggcagacggtagatttcacctcgatttatatttttataggcggtcatttggctctaagggttatgtccgcctgcgaaaatgagacccccatgttgggaaaaatgctttttctagtagtgaaatatctaacatttggatccaggggatttctagagatcaaatgaaaaggatcaattatatgagcagcataggagggaattttcttttggtatcaatttttggtaccaagaaaaggaaacatattgatagaattttggcatgacttacaactctgcactcacaaaatgaaagttgcacagatagattttcatcaaactagtttttaatgctgagagaaaaaggggtgttacaacgaaggtgagaagttacattagagttgtataatatgtacttataatctgacgtccaagaatttgtaatggagttgactgtcgatgttttaaatttttaaaatacaattttgcattctattttaggaaaaagtatattttacatcttcagctattattgaagtccaaaaaatcacccatgtgttagcgatagcgctattatcgcatgtgataatatatgcatgtcgtgtattagagataagagagactttggataagaaacttcttgtactacaatgcatgtatcttctatctctctgtaagccatgttggaggctatttcgaaccaatacaaatacatatatgcgacctctgtatgaggtgagaacgcttccatattttctacagagaatatatggtatcagagcctcctcaccaaaactagatcgcatctagccatcgtaagtaactccagcgccgccgtcaatccattgtccaggcattctgcccctgagaagttgacccggggcaatttcctttccatggaaggcgcagatccttccaaacctccgtggcgcgcgtatggaaggttacatcaccggcacgactcgcgctctagctgccaagatcgaggtcacagagaaaaatggcaacaagacgacagtcaaggcgctgaatccggcgtatgacgcttgggtggctgcagaccaacatgtcatcggtttcatcctcgcatccctctccaaggaaatcctgatgcaggtcgctaccgtggagaaggcggcccatgtttggagatcaatctcatagatgctctcctcccagtcacgtgcgcgagctcgcaacacctgtctcgcactttccacaaccatgacagaatacattaacaagatgtccactgccggctaaccctgtgacgatgaagacatcatgtcctacatcctcgccggcctcgacgacgactatgaacccgtggtttcatcactggtaggcaagaccaagccagttcacatctttgtagtttactctcaacttttatgttttgagtacagggcaaaattgcgtcaatcggcagcaaaccaggtctactcctccgccaacagcactaaatgtggtggtgggagaggtggctacaacaacaacgacaacaacaactccaactgcggtggatgcgatggcaactccggtggtggctgtggagatcgtggccatggccgcggcaacggaggcgatcgctacaactccaaacctcatatggtgtgccaattgtgtggcaacactggccatttggctggcgattgctggtatagatttgatgatacttttgttctagatttagaggtaacaatggcagcctcatacaacgttgatcccaattggtatgtggacactagagccacggcatcaccggcgagttggagatgctaacaactcgggaaagtacaactctaaagatcaaacatatacagcaagtggtgcgagtatggagattaaacatatatagaattcagacacacacgcgtaatctttatctttgaaatattctacatgttacttaagccaaaaggaatctcatatatgtacattgataatcatgcttttattgaagtatactctcgtttctttgccattaaggatcaggcaatgaaaagtcttcttcttaggaggcaacgccgcaatggattgtatcatctaccgaaaatattgcttccttcatccaagcaagttctcggagttgttaagcctagtattttgcagtggcatagttgtttgggtcatccctctttatccaatgttcaaaaatttattagcaataactagtcgccaacccgtgcatttcacgggctatgattgacgtgacataaatattaaattttaaccatatatatataatatcttataaattgtaaatacttggtaaaaagttactttgcatcgatggctacatgctgatattaaattgaaagtataaaataggaccatatttcttaattaggaaattagaaactattaaattctggaaaggaactaaagagttggtagtaagtgtacggtactactacggagaagttgtcagcttacactggtaatactttgggggtaaatgatgcaactcagtataggagtatatttggagctttacagtacttaacattgactagaccagatatctcttttgcagtgaataaggtttgtcagtttctacatagtccaacagtacaacaccggatggcagtcgaggatattgagatatattaagtcatcagttaatctattttgagaattgataaatcttattttactttgttagtgctttttcagatgcagattgggcagttctgtagatgatatgcgatcagttggaggttttgctgtgtttcttgggtcaaatctgatatgatggagtgctagaaaacaagctattgtttccaagtcaagtacagaagttgaatataaagcagttgctaataccacaacagaggtaatatggatacagactcttcttaaagagatagggatttctatgcctcaaactataagtttgtggtgtgtgataatttgggagctacatatttgtcagtggatcccctttttcatgctagaacttatcatatagaagtagattattattttgtgagagaaagattttctaggaagcaattggaaattaagtttatatcttcaggagatcggatagcagatggttttactaagtcacttgctgttcaaccatttaagaattttgtatacaatcttaacttagataagttattattaaacgagaaagtcagcgatggcgctattatcacatgtgataacatatgcatgtgataatatatgcatgtggtgtattagtgataatatatgcatgtattctatctctttgtaagccaagttggaggctatttcagtaacataccgagcatttcacctaggaaaatttttgaggaaaatgaaa

SEQ ID NO: 74902 - DNA, 17170 bp, Oryza sativa
acggggccgggggccgtcgtaggcgatttcaacctcattctcgaagctcaggataaaaacaaccttaatctcaatcgtcgtatgatgggtcgttttcgtcggctcatcgacgagttggaactccgggagctgccgcttgacggacgtcgcttcacttggagcaatgagcgtgagtcgcccacgcttgttaagctcgaccgcgtcctcttctctgcggattgggaagagcttttcccctcttgcctcctccaagcggcctcttctatcgcctctgatcactgtgctcttctccttcatacctgcgtcacctccccgaaagcgcatcgttttcgttttgaggccttttggcccaagttcgacggctttcttcaagtcgtgtaggacgcctggcatccccctgccaacctaccccctcttgccgctcttgcttggtgcttctctaccatggccaagcgcttacagagctggagtgaccgtcacattggcagtgttcgtctgcagcttcagatggcgaaggaacttgtcttccggcttgatgttgcgcaggagagtcggtctctttcccccttggaaacctggctgcggcgagatttaaagttgaagtgtcttggtcttgcctcgcttgagcgtactatcgcgcgtcagcgttcgcgtttggtctggcttaaggagggtgacgccaataccaagttcttccacctgcacgccagagctcgtaggcggaagaacttcatcacgcgcctttatgatggtgaccagcttgccgtctcccatgatgcgctgcaagagcttgcctcctctcacttttgcgccatcttggggacgagcgtcgagcgtgaactcgccctagacctccactctcttggcctccgccctgcgtagcttgaggggctggactgtcccttcacagaggatgaggtctgggcggtgatcaagtccttgccctctgataaggcgcccggtcctgacggttttacgggccgtttctacaagtcttgctggccggtgatcaaggtcgaaattctggcggctcttaactccttgttcctgaccaacggccaaggtttcgcttccctcaacgacgccctaatctccctcttgccgaagaaggacgaggctgttgacgttaaggatttcaggccgattagccttattcacagctttgggaagctgttctccaagatcttggcctctcgtctctctcctcgcctggacgagcttgtggcgcctaatcagagcgctttcatcaagggccgctctctccatgacaactttcgctatgtccagcttgcggcaagggcgctccacgccaaacgcgttccccgacttcttctcaaggtggatatcgcgaaggcctttgacacggtcagctggcctttcttgcttgaggtgctagcccagcttggcttcagtcaacgttggcgtgattggatctccctcattctcagtgcctcctcttcccgggtgctggttaatggggtgccaggtccacggttcccccatcggagaggtcttcgccaaggagatcctctttcccccatgcttttcattctagtcatggatgtgctcaatgcgatgctccgcaaagcctctgactcgggtggttttcttcccctcaatgatcgttctattcgacatcgtgcatccctctacgccgatgatctagttctcttcctttcccccgttcggcaagaccttgagttcatccaaggcatcctctctgtcttcggtgccgcttccgggcttcggaccaacttcaccaagtgctcgattactccgatccgctgctcggttcttgacctggagctggttcagtcctcttttccttgctcgatctcggagtttccctgcacctacctcggcattccactgtcagttcgcaagctgccaaaagcggccctgcaaccgcttgtggataaagtctcccattggctccccccctggaagggctgtctaaccactctggcgggtcgctcggttctagtccagtcggttctctcttccattccggtccatgtttctatggcgatcggcttgccaagctgggttatcaaagccattgacaagaagcgtcgcgccttcttgtggacaggtacggactcggccaatgggggacagtgccgggtgtcctggacgagggtttgtcgtcctagggatctcggtggactgggcattccggatctcagggtggctggctttgccttgagagttcgctggctctggcttcagcgctcgggacacccctactggtctgatctgaaggcccctgttgagcggagcgtctccgacatgttcgtagcatccaccttctctatcctgggagatggtcagtccacgctcttctggactgatcggtggatcgatggtcgctcgatagcttctatagctcctgacctcctccacgtcgtgcctccacgcttccggggatcgcgcacagttgctgctgggttagcgaacaactcctgggttggtgacatacgtggcgccctcactgtcccggtcatctctcagttcctgttagtctgggacgcggtggttcctacccagctctcgccgggtgttgaggatcacctcgtctggcgttggacgggtgaccagtgctactcagcgtgatcagcgtatcaggcgttcttccttggccagcactcttttgcctgtgccgacttactctggcacgcgaagggccctgctaaatgcaagttcttcctttggtttgcatttcagcagcgctgctggactgccgatcttctccaaaagcgtggtatcgatagccactctgcttgccccttttgcgctcaggagcttgagacagcgaaccacatcctcatcgattgcgtgttcgctcggcaggtctggctccgtgtgttgtcccctcctggctgggctgccctctctccccctcgtggcagctggctccaggattggttgtcatcctccagggtatgtttacctgagcaccttcgcagcggcttcgactccttggtactcctagtctcctggcagctgtggaaggaacgaaactccagggttttcgactctgcgctcgcttcggtcgcagtggttctagagtccttccgctcggagggccagctgtggtctttagccggtgttacttgttttggggatttcttgggagtgaagcgtggctctgccccctcccgctgtttggagttgcgtttttaaccgtcgtagtagttcctagcttcaagtccccccctttagacataagccagtctagctgattgctttgtgtaacaaaaactcttttcctgctaatattttgacgtgcaatccttttgcgcgttcgcaaaaaagtttccacttgtgcatgccatatatactccatactagtataactaaacatgcatcagtgatcagtcaggtctgcatctataattatatttcacttcattttgaattaaagatcacaaatgaacctatatgttactccaactattttcaggttatgagacgttttgactttggtcaaaatcaagctgttttaagcttgaccaagtttatagaaaaaaataataataacattttcaacccaaaacaaatttattataaaaataaattattattgatttgatgaaaataatttagtattataaatattactatattggtttacaaacttagtcaaacttagagcagtttgacttttaaagtcaaaacatcttataacctgaaacggagagagtatttaattaattcccgtattacgtaggacactatcatactatgtccatcgtattaattcatacaatatgtataaaacactacatgtagagttctgacttggaacgatggattctacaacggcgaggtaaagacgaggaagatatccaacttagaggacctcaccgctgaccagctcgtcctgcggagaagcgagcaactgagcgagctctactactctctcctgtccggcgagtgcgaccaccgggcaaggaagcccgtcgccgcactgtcgccggaagatatcgcggacacagaatggtactacgttgtctgcatgacctacgcctttcgacccggccaagggtgcgtatctcatctgctaattgctgccagccaacgcacacatgcatgatgagatgatccgttgatctgccctacacatatgactgatcacttgtcggttgatctgctagcaactccaataatacgtttataaaaaaaaaactccaataatactccgtaggagagaacacaaagcttatagctgggtataagctcagtgacgcagtcagaaagatttttaagcccgaacaaattttgatataactagtatttgctattaaaaattttatttactcattaatattgaaatttaatgtagttttcaccagtgagtccgggaagctgcccaggctagccgggcggtggcttcgccactgcagcctagcaatgttcataggcggatctaagggtggttccggtgatttcgggaccacccaaaaaaattcagcccaatgtatatatatacatatgtgaaaaataaacttttgaaaaaaaaactcatttcatcaatctatacttttaactttattgtatttaaggtattttaaaaaattatataaattagatcacctatataaagatacgtcacttcaccactggcaatgtctctcatgagtcccatgttgacaagaatttgctttaccgtgttgttgttattgatctgctggggtacattctgccaggttacccggcagaagctatgcaagcaatcgatctgtttggttgtgcaatgctcagtctgcagatagcaaaacctttctacgtgcgctcttagcgaaggtacatatatatttcccatgctgtgctagctgctcatggcatcgtcccttatgcctccaaagaatataatgttcagttcccgagaaaaaaaggataatgttcatgcattctccttgatctaatcatcatatttagttgttatttatctccctgtcatgtcatgatctaactcgcatgctctctctctctctctgtgtggtccaactccgtccactaataatatcgtatgcaaagagcgcgtctattcaggtatgtaggtacagttgtacatagtacggagtatttcagttttcaaattgatgtatactgtacgtgtacgtcgatatctctgactccatctgaaatatctatacattttacagacaattgtctgcatccccttcatgagtggcgtgcttgagctgggaaccactgatccggtaagttcattggatcactcagcacgaaaaactatggacctatatatatgtagctagctcaatcgcctagtgatgatcgaccaacataagagtatactagtatgttataacagagtatcacatgcttggtatatgttatagagagaacctattatatgtcctgagtttatcacaggtctacgatttgtcattgattttgtcacgttctataatatgctatcgattttgcttaacttttatgatttaccataaccgtcagtttaaccttcgtttgtattgtatttttttcaaaatatgataaaaattgtaaaatatctgtcggtgacatgggaccgggggtatcgtgactagaggcttgggcagccgcggtcacccacgtggcctgaccccctcgggggggtgggggggcgggcccgagggtgacgtggccacccctccctctgtctccccgaggggtcgggccgctcccgtttcggccccgagggttggggcgccccgaccccctgtggtattggtgccacgtgtgtgggttaggtgggcacaacggcgctcacctaaccgcatttatagcggattggacgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgccggccattaaatgaagtttgaaatgggcgtcctccgggaaagctgacgagcggggcaggagacgtgcgctctgcttgtcaaaggtcacttccggctgtagactagccctcattgtaaaaagcatgtttcctttcttaggcagctagaggcccatgtggtgacccctgaccagataaaaaggaggcccaggcctaagagagaagggaggaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattccttagatcgagggcgaagaatctcacttagcgcccccggccgaaccggcaaagggaggcctgcgcggtctcccggtgaggagccccacgctccgtcatctggcgcgccaggtagggggcgcgcgtgtctttctaagccctcgtcctctttcgtgtgcgccaagcttctcccgctcagcccaatggccgaacgggcagtggcgcatagcctctctccgaacgctagcggcgacgacggggagcagaacccacgccgtcgggctcgcaccccaccgtccccctctcgtcgaaatcttgggcggggggaggcgctcggggaggtcggaggatccgcgacttcgccgcccgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccggcgttggctggatgacgtggccgacttggtcatgacggcgcagcagagcctaggcgccggcgggaggtcctccgccaccgaggcctctggcgctgccgccgccggctccacgtcgtcgaggcggagggcgcggcgagcggcggccgttacccgccgttcgtccgccattccctcatcaacgcctccgacccaagaagatgtgcgtggggggtcggatgcccgcctcgatatcgagcaccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgagaggatctgtaccagcagttcaccacgaacttccagagcacatatccacgcccaggcgaagaagcggacttgcacgcggtacagcgaagggacgatgagtctcttcgctcgtacattcagcggttctgtcaagtccgcaacaccataccgtgcatccctgcacacgcggtgatctacgcgttcagggggggcgtgcggcacaaccgcatgctcgagaagattgccttcaaggagccccagaccaccgcgcagctttttgagctcgcggaccgtgtggctcgcagggaggaggcctggacctggaactcctccggttctggtgtggcagctccggccgtccccgggtccgccgctcggtcagggcggcgggacaggaggaggaagaaggggtcggcccgttccgacgacgagggtcatgtcctcgccatcgagggtgcttcgcgggccccccgaaaggggaggccagcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaaggccccggcggctcccgccggcaaccggcgaggtgagaccaagcagaaggccaccgccgaggacatcgacgatggtgacgatgacctggggttccaggagcccgaggccaccgtcgccaccgtcgatgggggagcgtgcgctcacgcttctcgccggagcctcaagtccatgaagcgcgagcttctggccgcggcccctacccatgaggcgacgcggcgggcgcggtggtcggaggttgccctcaccttcgaccaaaccgaccacccgccgtgcgttgcccggggaggacagatcgcgatggtggtttcccccaccgtttgcaatgtcaagttggggcgtgtcctcatagacgggggtgcagccctcaacatcctttcccccgcagcctttgacgccatcaaggccccgaggatggtgctccggctgtcccagccgatcatcggtgtgacgccggggcacacctggccgctgggtcatatcgacctcccggtcaccttcggtagttccgccaacttccgcacggatcgggtggacttcgatgtggtggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcaacgcgcggaccacctcgccgcggcgtccaagcccgcgggtggcgacgagaggctcagcacctccgtcccggccgccccaaggcagcggatggtcacgtgcgacgaggtcccggtcaaggaggttgccctgggcgacgtcccgtccaagaccacacgaatcggtggtcttctggacgacaaataggaagacgcgctcgtctccttcctgcgggcaaacgccgacgtcttcgcctggagaccggcggacatgcccggggtccctagggaggtgattgagcaccgtctcgccgtgcggccgggcgcaaggccggtccggcagaaagtgcggcggcaggccccggaacgtcaagccttcatccgtgaggaggtggcgcgacttctggaggccggattcatccgtgaggtcatccatccggagtggctggcgaacccggtcgtcgttcccaaggcgaatggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggctaaagaatgcaggtcctacttttcaacttactactcgaatttctttgggtagccagataggacgcaatgttgaggcctatgttgatgacttggttgtgaagacgtgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcaaggctgggagagaaggcagtacccctatttaagctcctcaaacgctccgggccgtttacctggacggaggaggctgagcgggccctcactcagttgaaggcgtacctcagttctcccccagtcctggtcgccccggagccagatgagccgttgctactctacctggcggcaaccccgcaggtggtcagtgcggcgttggtcgtggagcgcgacgaggacaaccctcactccgcgcatgcctaccctgtgtcgactcgacccgggagagagcagggaggagaggcccccgagccgaacggtggcccaaggcccccgacggccggagttggccctccgcctgcttgtccgacggtgccaggcgcccccgacccccaggatggccccggggccactgcgggaaggccgcgcctgtcgccctccgaccccgaggtcgtcggcacagaagccgagtgcgccccgcgcggcctcttggaccaagagcgccatggagatgcggcccctggcgaagaggatcggccccgccgaaaggtgcagcggcccgtctacttcgttagcgaggctcttcgggacgccaagacccgataccctcaggcccagaagatgctttacgctattctgatggcttcgaggaagttgcgccattatttccaggcgcatcgggtcacggtggttacgtcgtaccccctcggccaaatcttgcataaccgagagggtactggacgggtggtgaaatgggcaatcgaactctctgaattcgatctgcgctttgaaccacgccacgcgatcaagagccaggccctcgccgactttgtagcggagtggaccccagctcccgagcccgtctccgcccccgaggccagctcgggcccctcgcagttgcctcacaccgccttctgggtgatgcagttcgacggctccctgtctcttcagggcgccggtgcgggggtcacgttgacctcgccgagcggagacgtcctcagatagctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggttcggcgtatggagcgccatttcgacgggatagagcttcggcacgtgcccagacgggataacgcggtcgccgacgaactctcaaggctcgcttcctcacgagcccagaccccaccgggcgcctttgaagaaaggcttgcccagccgtcggcgcgacccgaccccctaggggagacggacgcgcctgaacggcccctgaggcccgtcggagtctaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgctaggcaaacccatcagccggcccaggccctgcagaccatacctctttcgtggccgtttgctgtctgggggctcgatatccttggtccgttcaggcggaccccgggcggtttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgaactcttcggtgactactgcgaagacatgggcatcaagctctgtttcgcctcccccgcccaccccagaagcaacggccaagtggagcgcgccaacgcggaaatcctcaagggcctcaaaaccaagaccttcaacatcctcaagaagcacggctactcgtggatcgaggagctgccagcggtgctctaggcaaaccgaaccacgccaagccgagcaaccggggaaacgcctttcttccttgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctactcctagtgggggtcgggtgttatgtctcgggctcgggccaaccccgcgcctcccctgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcaccgtttgaggctgggacctgggcacgagcccttgttcaagctaagacacagaaggaccgtggcacagaccatcctcgtctcaaacacacaacaaacagaactgacgcagaaatttcctccttacttgattacagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccaccctcctcgtcggagtcgagggcgaacgcgagccgaggggccgtaccctcgaagctgtggacgatgtgatcggcggcgtcccggacctgcgcgcgcgcgccgtcctcggttccgggagggaactcttacagcgctgcccacggagagaagtcagggtccctggcctggtagcttgccagtacgagctccaccgccccccgggcgaggtccctcgtggataacttgatcgtctcctcgagctcctcggggagccgctggagggtcccggccatctctgagaggcgctgggcgaggcccccctggttggcggcgtacttcgcggtccgcccgccctagaggcccgcctgccgcccggcgcggtctagacgggagacggcgtcccgaagcatgccgggtcctacctcgctcaccaaacggagggcctcgacctccctggcggacgagtccagtgcgccctgcagcccggcgatggtgtgttcggcggctgcgaggcgggcggctaggtcgccgtcgcccgcggccgccccgccgctgtgcgctctcgcgtccagctccttcgcccgcgcctcgagctcagcggcccgctgatccagtgcggccctctcggcatgggcgccttccagattgcggcgcgcctgctcctcccgcgctgcttcgcggaggaacaggctgtccgccagccactgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtctttctccttcgtgtccagggcgcgggcgcgcttctccagcgccgtggcgcgagcctcaagggcctcttcgcgctgccgggacgccgcctcgatctccgccgcccgccgttcccgggcagcggcggcgtcaaggactccccgggcggcgtcgagcttcttctctagctccgccgcccggctcccgtattggaggcggaggtcgtcccgcacctcgtcgagcacggcgatggcgatgagggcagtctcccgctcctcctccacctccctggcgatctccgccaggtccctacgacgggccttgagctcggaggcgtgccggcggtgtgccttgcggcccgcctccaccatggcctccaccgagcgccgcccctcctcgacgcgcgcccacgccgcgtcgagctccgcccgctctgcctgcagggcctccatctgggcacttaacccgtccagcaccgtggtgttcgcggcggctaaggcctgcaggaggggctccgcactcagtggggcaacggaaggcagaggggagagccgcctcggtgtgggtgccgcgcggctcggcccgccgatcgacgtgccggacccaggggtgtcccccgaagctggctcgtcccaagcatcgcccgaggggtcgggcccgagcggcgcgtccgcggcctcgtcgtgggtggcctcggaagtcgtcgtcgcctcgggcggagtcgggtcgggggcttggcaggccgcctggcgtgcacgcgccgtctcctcctcccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcgatcgccgtctcctcggcctcggaccggccggacttggaatggcgggggggggggggcgacgggatctcgctgaggcagaagaaaaaccagaagacaaaaagaaacgggtgagtgaaaactcgccttgggagatgggagaatgaacacggccgcggtgggcgcggggacgaacctgcggggaggtcggctaaacgaccacctcgggagcgagatgaggttcccccggcatggctcggtcccccccatcttgcggagccgtttcttctttcgctccccctcaggctgtggcgtcggcacggcaccctccgggcgcctgctgctggcacgcaccgcctcgccctctcggggaggagatgggggggtcgtgccctcctgcttcctcttcccccgggcgtcggcagggcggctgccccccgggcccccgtcgcggggcccagaagcatgaccccctcccagggtagattgtttccccctgcggctcccgcccacgccatcgtggcctcgggggggccgctcccccgacgccccgaccgcctgcatgatggtcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatctggcgacgaaggtagtcgccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccagctgtacggtgaagaaccactggaacagccggagagatgggcgcaccccgataaacatctcgcacaggtgcgcgaagatggccaacgtcattattgcgttgggggtgaggtgcgccatctggagatcataaaactccagaacatccatgaagaaattagagaatggcgggaccagcccggccattgcgaaagagaggaagaagacggaccgccccgggtagtgtggcaccgggcgtccctcgcccagctcgaccacctcccggccggtggcagattccggcatgaatcggcgcggcaacccggcctgcctctcgctcacgatgcgggaaggcggcagcacgctaccgtcgagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatctcttcctcggcgtctttatacccttgccaacgctatgcccggctcctcgcttcccgcgcccactatctcgccccctcgtttctcgcgcccacgcctccactaatcccactcgcccctttgcagcgcacgcggcagatgtgcggccgtggcggttgagatgggacagatcgtgcgcgcattaactacgttcgccaaccgagaagagcgccatcatcatgtctccaggcgaaacgaaccggctcgtcccgattcgcgcgctgctcgagtaatgtagcggtcttgaagagaccgctcattattgtcggtcggtttttcccttgccgatgcgcgcgatttgcgaccgctgggtttctgcccgcctgtagagaccggccccgcctgtcaccaggcctaaggagtggcgtcacgcccgagcgcttccctcgaggggggtgatcgccctggcgtaacgccggcggctactgtcggtgatatgggaccgggggtatcgtgactagaggcttgggcagccgcggtcacccacgtggcctgaccccctcgggggggtgggggggcgggcccgagggtgacgtggccacccctccctctgtctccccgaggg

SEQ ID NO: 74903 - DNA, 2230 bp, Oryza sativa
tcaatgggctccttccgatgtcactgaggaaactctcaaggagatggtggagcacggagtattaccatccaaggagatcatcgaatagcgtccagcatttggtgaggcctttccaatccccgatactcatgaaatcgtagtcttcacccatttcttctatggtggctttgctcttccaacctctaaattctttaggggtattcttgaattttatggaattaatatctaccatctcaaccccaactccattattcatatcgcaaactttgttcatctttgtgaagccttgctgggcgttcgggctcattgcgccttatttcgccgaatctttttcttgaaaccccagccaaataaaagcaagccttgcattgttggggtatctagctttcaacttcgtggcaccctatgccaaaaatacttcacccttcctttcaaaacctccaacaagggctggcatgctagctagttctatatccaaaacccagatccttccctgcccaaatactcatgcatccctcctaagtatcaagatatctggaactcactccctatgggcgatgaagcttctcaagctcttgaactgctgaaccggctgttgaagttgaaagaacagggtcttcaaggagagcagatcacttggcatttcataaagtgtcgactggctccaattaaagaaagatctctcgcacggccttcgagtatgatggggagaatgaccccaacctagaagaccctgactccctcgaattcaagatcatgaaggagaggatgtataaagtcttttcatccagtattgcggtcagcttttcacatctactgtcagtcgtgccatacaacgccttcaatcctcctccagcggtaaatatctaaatgtttaaatttccatcatgcttgctgcctttggaaataatctttaaatcattatctccaggaaaatgccttgatgaaatctgagccaccaactactgttgacgaccaaatttggtagatcatgcatcaaattcaaagctaagatcgaagcggattttgtggaaggtcgtttctcagaaacatagtatgcatcggctacgggaggcatcgactggcgcctgcatcggctgacgttggatcagacaaataatagccgatgcagccgatcttggtaaggtggttctagaatcatctttgggattgattgatgtgatgcagaagtattgccacgattgggataagcccacagacgggcaattgtatatattaattaagatattttgaatagtttccttagagatatttatcggcaagagtctgcctaaacgacttgttcgtatcttacgtttgtaacatatttggagtcatgtccggcaaggacacattatgtattttgggtataaatatgacccaagaccatgtaaacaataacgatggttctataacactttcggcacatcaccacctttttctattttcattgtttcgacgagttcttgctttcaagttgggctgcatcgggttcgatctccgacaagaggtaaaacttgtcatggcggcttgcgttctcgggattaatgcttacatctctatgaaactctaatcttgtttatgtaaatcatcgagttatcatatgtgcaatataatctttatcaatattgctatctaaccctaaatcgaccaacatctatcattaggaaacaaccgatagggttaaatgtcaacgttgatctagattatatagtatatttaccatctcatagaggtcttcatcaattttcttagatcttatgtttctctttatgcttaatgctgcatcggttgagttcgatctattaagtaatatcctgaactataatatctagcttgttttatgatcatcgataaagatagtatcggggtttcagccgatcttacctgatttagtcatctggttctctatatgtttacttgatttactaaatttgccctttatattaagatcttcttgcattaaaatatattaggttcactgtttgatatattttgtctgttttaatatcttaatatagagtggtatcggagtaatagccgatacatattagatttacttcatcggctatgctataaatatatataatctttatcttaaagtatttttaaacataagtgatttatactgtctcggctcactgtccgatctatctcggtcacttggtttaaggatatttttagaaatagattatatatcattgggacgtgactacacagctagtggtag

SEQ ID NO: 74904 - DNA, 46809 bp, Oryza sativa
taaccgaatgcagtttggtgtaccagaagagagctcattgggtcagtattggcatccccatttgaatgatgttttattgttttgtttcacaataaattatcatggagacttagatttattttcttaacataatcaaatattggtgtcatcaggtgatggtttaggggaaggttatggcatgcttggacaggcaggaagtggaaagctacgcgtgtcaactgcaccaagcaaactttctgcaaaaattaccaagaagtacgcaattttgcttctctttgttacctgtcatcttgttttagaatataaaacaaacacttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattttatgttgctattcttgtacggtaagttgggtactgcacaccattgcatggttggttttgtcttgaaatctgacgctgtatgttttgtaggctaatatcagagttgatatgcgcctgcattgtaacatatttgcaattacatcgattagtatttttaatgtaacttttcttttcatagttaactgcgtaggagtcctctcgtcattttgtttttctaatgctctattatttgttttatcgtccaggggatagagttgtcaaatccacaggcccacggcaacctgcttggaagtggaactcagagcacctatttttcagagaccgggacgttctcgaagatcaaaaggacctgagctgataagcaaaagtttcttcttcccatcagcccacagacccgtcataatcctcaggatgcaccgatgaatccattttgtaatgtactccaccttatacccgaattcagcagactttcgtggtgctgtttgcaatctctagaagttcgctaacttccatacggttcaagttaattcgacatgctgcgtttgatctgatgccgtctttgcgttcaacacaatttactgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaacgtaagtactttatggaaaagcaagtgctaaatggattttgatacatcaggaatttatggtactcacagcaggatcagtgaacactattagctgcttatcagcagtagacagtagaagatttgtgttctctttgtttagagcgattgctgtgacgtcctggcctttccccagctccattgtatgaaatacctgccagtaaaatatttctggtaaggttaccacaaatgaaaaataagccccccccttttttttttgcttgtgacactaaccttaagtttatgcagatcaacaaagcatacagaaggcacatgaacagattgcctagtttcagcttgtttagatatgccatccttgccatttggttcattaggttcatgatccccagtctcagtactgtcctcacacttataattgcttgaagaacatgttcccattaaggcgaaatggccatcagtagaaatctcaatgcaactaacccgtccacaaaaaggtgatagaactgtggtagcaatagggagtccattgacagtgaatgtagatagtcttttctttgattcattccaaaccagaatgaccccttgagaagataagcatacagcatgtgcctccgctacattaagcttccttatcagacgaccagtcctcaaagaatgtagaagaacacctgacatgtttgatgaggatacaacaagtcccaagtcaggactgactgaacagctagtcacttcctcaagatgtcctctcaatacatgcataggaccttcaattcgacgcctcctgatttctgtaaggttgctcacactaggactgcgtggtgttgtcggagttgttggtggaggctcaggggcatttttcttatgtaaggagcctgcctgatgaatcctccagagtataactgtggtatctcgagaccctgttacaaggtagttgctatcatgagaaagtgcaaggcaggtaacaggagcaagatgtccagtagcagtttcaatagtcttcgctccatctggggagatcaacttcacagaaccatcagcatgcccacctattattgagtaaaatggtattagaaagcagacgaaacttcataaaaaaaatcattaaataatggaagctgcctaccataacacttcattaaaatccagaagtttctatttgagaaaaaaaatccagaagtttttattcgagaaaaaaatccagaagtttcagatcaagctgtttgcttgactttatctagcgcaacaggtgttcagtattttaatttaaatccaatatatgcaagatataaagggcaaatttgcatctttggattcgaagtgttgtcacaactcacaaggcaatcttaaactacattgcttacatgcgcgtgactttttacattacaatatgaatccacaactccatgctgtgttccatttaatgcctttcttgtacgttagtgaatgtctagcacatatgaacttcattggctcatgataacgaatctgtctggtaagaaaatgattatgaatctataaactccccccaaatctagcaggtaggatgtctcatcctccactagtaagcagagaattccccagaaaatggaaagaaaatgatggatgaagaggaaagatcatctaaatgaacaaaaaaaatacatatagaagctaaagcataaacagtcaaaagaaacaattaccagtgataatctctttgtcacatgtgacagcaacaactgctgaactacggatgccagaagcagcaaatgctatagctcttgggaagtcataatcttctccagaactagcagatcctttaaaaatgcgcatcagtgcaccaccggttgaatttgcagcatttctaccatgatgaaatagaaagggtgtcccttggccatctggagtatttggttgccaatggtgaagtgccacatgagcagcaggcacatttacatctacaactacaatagagtcattggatacaaacatggtactggccggaacattgcagcgatctggatttggaagtaaatatgatttaagttcacttggattccggaatatagtctgcacagcaaataaaagggtcagtccatgtaaaaaacagtgaggcaggccgcaagtaatgtctactcttgaacatggaataccagctccaccatgtgaaaactagttagctacacaacccaaacttaattaaattgccagctaatgcttttgggttcaatttgaactactttccagtgttccacaccaggtaacttgaatctgtttacttgacttctatttgacaatactcctcatccaaggtggaataatttggttctgttcaaagaaatgctttgaatcgtttgctttgggggttgttctcaatagccagggtttaatatagattacctgtagatgtaaaacttctgccaatggctttctcctcatgtggggaatagttagcaattgagatggtgtttgtccaaagtaagcaatttgatcttgcatggcttgccgttgcaccttcagcattttcagttttaaaaaaatatgagcagatagatgacaacacgggaaaccaagcactagcttgagcgcatactagtacttactggatctgtgattttgtcaatgtccacagttccttcatatgtaatgtagaagaacacattgttggccattactgcttctttacccctctgtttaaatctgcaaaagaaatattcctaggtaaatggtgatatgcgaggagaaaaaaaatagaattggcttcttaaaaatactaaacagaagtcctatatcaccctacatcattcataaatgctaaatttcaataattcattgatatgatgatccaacaggaccattctacctaaaatacaagcagagaaacatttacaaactcaagaatcttttctgttcatgtggggcctaacttattgaactttgtcattgttgaaagtcttgcttcgtcttcctacaaaacacatctttctattcagatgcagaacttgtaacaggatgctccatcagatggctacagttctttagaaggatctaccattatacctagaggagcacactttcggaatgataacttgcagtaatggcttataatataagtacctattacaagtatcttgaatagcaagtgattataagaaagggcaaagggaaggtgaattacaaacttatttatacctacaccaaattatagagtgattgcataatataagcattcaaattaaaaaaaaaaaaggaaagtgagggtacccaaatattaaatcaatccactcatgcaaatgagcagaaacatgctcactctcaagagccttccggtgtttatggacaaaatcaacagggtcctcagcccaaggaggcaaatttacagaatctgcatttatgttcggggttacataactctgcttttacgaattgtactgtaaattttacacaagctgaaatacaagtacctagctttcctccaagctgagttgtcccgaagtcgatagaatttatattggtaaatacttcagggaggtaaaacatctcagggacctgataaatatcatcagatagttatattgcagcaaaagatcttgactggatttcggcgctgcctactcaggaaaacaaattgctggtaagacttactagctcttttacatcactcatgtcttcaagaacactgtcccatgtaccagatagatcagaaaacatacgatcagcatgatcaaatttgccgccttgcagctgtattgagagcgtagtataaggttccaccctgaaaaggtaatacaagacctgcaacggatatgtattgttatcaaccaagatatacattgaataaaaaaaatcaaacaacatattgaagttgttatattttaggatggagggagtaataaataaacatttgattcagctttaagatgtaccgtgccagcactggagtaatgtgaaccataatggaactttgggatgattggatcctcaaacgtagagtagcgctcttggaatttttctagtcgctcagggtttagtgcaccaatcggctgcatcaaataatactcacaacggttagcatcctagataggcaaaaatatagaaacaactgtcagaccaacctttgaaagatcccgatatgtacatgggtcatccagattaagaatttcggatcggtaatcagcaattatccaaggaaaaacaggatactgcacatgcatgtaaattgttagaatgataagttaccttgttttagagaagaaatacaagtgcagtaaactgacctgagttatgtcattgtaacttcgtccagccagtgtgttcagttccatcaagtactcaaaattgctaatctgaagaaattgaatatactgagattcaaagctaccaacaacagcatagaaaaattatatgttgtgttcatgtacctcccagttagcccagcgctccgtcaactgagttcttttgagaatttgctcagctctctgaatcaagtataatatattactgacaaacgtcattgcagattgatcatactagagattaggaaaaatgggtttcacacgaacctgggtagctagaaaaatgtcattcaaattgggaggcttgctgtgaacaattgcccgataagcatttttgcgtgcttccatatcctagatcaagtgcaagacacaagtataataaaattatccggttgcatcatctgtatctcagactacagagagtagagtttcataaagagtgtaccccaaaatcaaaaaagaaatttgacctatctaccataaacaattccaaagcacttcgccgcaacaaatatctgcaagaagtcattgaaaataaccaagtaagtgaatagaaataaaaattatgtggttaatgtcattgatgctgcatgcatttgcttcacaagtattgaatgcctatttttaatctcagcagacaagaatatccgcattgcgacttgataagagtacatcagaaaacaaattctaaacatggcatctgatcagaaaataatctttaccgtctgctatatatctgatgcagagaggagatcaaccaactcctatctttatcctgttgatcacattggccgctagtggacgcatgatcatccatgttactctcgcttgcactctcatcaattataaagttaatcctcttagatgttacctacaaaaaaaaaaaaacagggcgaaatgatatcaattaacagctaaagtgggagttgaagaagcagaataggatcatgagtagcaactaaatctttgtaattccaactgtgtagctttatatagcagaaaaatatagtaaagtgcatatagaattgaaataatacagattttgaacagatccaggactataacataatataaacacgatagaaggatagatgattctttaaagaaaatatattggatcaaagaaataggatgcatagtcattactaactaaattaggtaacacggtttttttagtattatccatctcaaacaaggtgtcaatggtttagccacaaggaaaaataactgtctatgtatttgcagcaaattggacgccctatgttttacttaggggtttagccagaaaacaaattatagtgctaatcttagcatcccctagaatttgatgaacataaggtacttcattgcaatagtttagatcaaacctttcagtatataagcaaataaaatacaatgctgcagtacagatagcatattatgacaaaaaaaaaactaacactgcatatatccgagtacgtacttgacttattttgcattttcagctaaaagaaatgtttttagttaatttggaaccatcagaacattctgttcgatctactgcagcaccccattaataataattaacatgtgcacactgaaatataacgcaagttgtagtggctaaaatccaattccaccatagtaactgagaagtgttataactaatacaccacacatcggtccacaattgcaacttgcccttgacattctttaatacgatccctaaaatatgtatgtttgtaaaaggaaaagtataagcttgaacaattgcatcttagcctcttggcattatttatttgtagcaagttgccttacaatgttatgttggagcattgcaacgcttactggtaacaaagacaatgttattcgatacacagtagctgaattatgtgatgagtaatcttaagacaattgacaacctaaaattgacattctggagtctatcagaacacatcagtatgacagatcgtggatgagccaagttgtaataaaattaaagttcactttctgattatttttttttaagaactggtcatggcaccatcaaaatttagtaaatatcaattacttacttggaatgttcctcgtacaactttcaatggtcgcaccatcgacgatggaagctcaacaataattctctcatcagcatcactaggcacatatccaggtgcaataaccgtcgaccgaaccaaattgcgatcagcagaaatgccagaacctcgtgaatctattgatcctttcacagactgttgatctgcttgttggagtcgatcgtcaacactgctttgagttgtgtctgattctaactgctcattgtcctcatttctgtcatccactgacatggcctcagccgttattataggtgcagttgatggaagtgtgtctgttactaaaggttctgtaccctctgggttgcattcatttgattgtgcaacattacttagctttcgctcttcataatcagcagctgcacccaaatgatcagaccccttgtggttccttttcataaatcttctcatccttgaagaactttcagtaaaatctaatttccagaaaatctgaaatacaggaaagaaaagaaacatcaaaagatgtcctgcaggttgtcttttccttctatttttgtttcttttgtaagggtgctagtataccagaatgcgctggtctggaaacaaaatttgctggggaacagggcagaaaaacacacacacacacacatatgcaaaaaaaaaagaagaaagattagaaaaagttgtacatacacgatcaggagcacacaagggttcaccgaaaggtccatatagtctgtccatctctgttaggcaatgaagaagatggcgccatgctcgaactccagttgacacccgatgtcgattcagcacatcagcttgtgtttgcctctccatctgcatgttccagagttcatatgatttatggtaaatttatatatcagaaatggacatattccaagtggattcacctcaactcgctgtaagttccgcgccaacgcaaaaccagagacaagaatagcgacatatttgtatgaaagggctgaaaaatcccttcctgaaactgacttggaatcaactgattgcaggcactccatccaagcagcactcatagcttcagatgtgttccacctctttgcacgctcaatatcacctgcactcctcctttgtcctgatgttgccattgctacagcactaagaccccttcctgaaccaatcttagcagtccgctcaaggtcccgagtagcagctaatgctgctgctttgacagctgctttatcctttggtgtggatccatgcttgttgggtgctgtttcaataggcttctggaaacttgtaaaagactgtagttttggtgctgctttacgctcaggcactgacgtgtcacgcctgttcaaggtccttggaggtgctattgcttctgttccagaggcaccagcagccatcatggctaatgccaatgcaacaggtggtgaggcaaaagcagcagcccaaccaggtgatatcattgaaagagcagcctgagttcaaaaaagtaggaaaaaccccttgaatatatttttttctttgagaaaacatctggcgataaaactttaagacagacaactagacaagtacaattttctaatctatgctaaatgtaaccacaactagactagacatatgatctcaggatggatatcaaaatgtttaccttatcattaatatgctaatatagttacataagcgggaaaaaaaacaacccatggttgctgagatactagttaccccctccctcccaaaacataacagcttctagtatttaaaattgtcacaaaatataacaacttcttcacctacattctcttctcaaccaatcacaaccttccaccttctaatttctacacctacttcctcttctcaaacaatcacaaccttcccccatttaatttcacctactttctcaatacccatgtccaacccaaaaacttcttatattttgggacagaggtagtacttttcaggtttcagcttctaggtttctcaaatatcaagtgcactcaatagtaccagattaggttaaggttgccacttgccagcttatgttaagttcatgatcattgaaagcaaccccaacttcttttcttccgcagtattagtaaactagagaggaatttttgtggactgcgtttttcccagcttaaggataaaatatgtaaaacaaacacaactgaaatcactagttggaaatttcatagatatcatagtggtatctatatgtcactgtctcactgatgtataatttagcattaataccacataacttaagctatagttggattttacaaagaaccagtccatacctcaatgggtaatgcatctgctgccaaagcgcgatcatcagcaatcagtggattttgcccatctgaagaagttagctcatgaataccagccaatagtggacgccaccttctcaagatggctataaatggtggtaaaatcagctcaatgtactgtttccttagggggctcctgtccctaccaatagcatgccatacctacagaatgaataatatcgcataagctttatgacaaacgaggaataacttctttgttatcccctacaaaataaacattgcaggaatatagtgcctaaacattataagcataaaagattaacatgcaacatctgtacatctacaaatttacctttgattatagtgtttggatgagcaaaggcaggttactgttcaaaaatcagaatcacaggcaaaaggtataacatggaattcgaaacaactacaaaatttggtactcaagagtaaataccgaacacactttatctaacaggtatcaaacataattgcaaacactgagagtaaaacaaatcaaacagctaaataggagaaaacgaaggaatgtggaagtatcaacaattcaacatgtacacaactgcagatgggcatcactatttcttctcttttttaaaagtaaattattagaaaagaaaagagaaaattaacagaaaaagaaaaagaaaatagatttaagatgtgagcatacatctagtcacttaaaaatttgcagagaaagaaatctactttcaggtgatataatctgtagaactttcttgaagataaacgatagaaaaaaaactaaaatattgcactattttttattagatgttccactccgtagcatgggtccacaatcacttagacaaactatatgcttaggttaagaatattaaaactaacctctgaatagagaatagaggaagcaaccaacaccctttgtctcttagattcattaattggcatattgagaatgggaccaagcacactgaaaaatcacaagagtaccaacaaaataagaattgataaaaccagagtaaacgccatagtcacctagatatattatcatgtatataggaagccaactgtgtttccatcaaagttgcggctaccaactgattgtgacatatcatgccttagagcagttatatttttcaagaaataaccaatgccagatattatatcaaagcatatagtatacaaatcaagaaatgttaggaccctgccagagattgttagcacttcaccagtcaccagtgcttttcttagcttggtggattttgctagtgtttcccctctcaacattacccaacattgaataaataattttcagcttccattttttctcctgcagttaaacacataccactaactttgattttaactgttgatacttgatggtgcatagtgcatacctccacagaagtgcagatcggggtttccttgtagatgagcgattgttgctgtcaagtggcatcatgcttccagcttgatggcccaacccttccgatatgacatcttttatgctgatgttgcctgtgaaggcatcaccttcaccattgtcatcctccctcattgaaacaagagtcattctgagcatgcaaaggaatggctggtcgctatccagcaactgataaagtgcagtcataactcccataccagggccggagccccctccaatacctagaccaccaccaagtccagaatcatctaacagcaatgcctgcagcactgcaactgatttcttcacaagtggaaggtcaacccaagtcccatttgagtccttctccagaacagatttccaaaattcccaaccacttccaccgccaccaaatgtatcagatttggatgggattccaacgccataccacaagcggctcctgtacttccaactttcagcaagatctgcaatgcagctcccataagaaacaaatgcatgtttgacagattcataaggttcagctgctgctgctgatgtaagacgctccatcacagcagcagagatttgtccgtttgaatcagccattgaagtaagcacctgcttgatcacacagtaaacaagaatgaaactacattcatatgaaggaacagtggactctatatatagtcaatacgtgaccagaaatctattaaaactaatgatatttctttcaatagcacttgtctgttttacatgcattatcatgctgtcaacttcccataattgtgcattctacagactgaaaggcatatgaattttcctacgtatcacatatttagaactttctttcagaattcctatccagtaaagtggtatgcatctttctgtatgaaccattagacatatacctccgtccattcagtattattgtctatgtagatttttttttaaaaaaaagaagagcagtattcaccatggcaataatattctcctgtaacatgtggttaaaaaccaatgcaggacagggtagcctaagtgactggcataaagagcctcaaagatataggtaactatgacgaaaaaccagcagtagtaagccagaatatagattaaaaaaattctaaaaacttaggtgactaattgtgacacatagtgccaccttttgcaactatgcaccatcttgaagaaaatagtaaatggaatctcagaacaaacatgttgacgaaacatgctagtgcatatagacctaaaaatacaagtattccagttttgagtcctgttagaaataaatatcatttgatcaaaatgatgctaatagctgaagtaacataaaatatatatagccatgcgttacatacatctaatggaaggccaccagcatcagtggacaaagatgatcgtcttgaggtcccagcatccataggctcattaccacttctacacaatgaatttgatcgactggcagcagacgaaaccattgaggcagaagggacagcactatcaagtgatctggatgtgcaaaaatgttgaccttgtgacctcagatgatcttctacaagcatcagaataactattgcattttccgctagtgctactgaaagatgagcagcattttccgcttgggtttttgcttcttcaggagataaaccctcagctgcaacaccagctgcagctgcagcaattacttcagtctgttgtatgacaagcaaaacaaagacattatagatttgactaacataagatgaaacagtatccatgaaaatgatagaattatcaaacttcacgaaattgtatcaaaacataacaaagacagctatcttcaaattaacataaacaatacaatgcaaatggtaaagtacacccagtaacattgataacagaaaccaatgccactgacatggtattgtctaggtgtcaacccttttcttttgtgcagagtaagcagtgatgtagtcaaagctaccagttttagtgttccaccattttgaccattacagtaccaaaatttgtaagttcatgctgaacttttctggattattaccaccatttaaactaggccaggaccaaactatacagcacaaggcaaaggtaaaaaaaactagtgcagaaagtagaaagagcaaaaaaatacaaaaaaaaaaaaggctcacacatatacacaaaacatctctgcacagaaagtaaactgtaacttttagaggaaagtccaaccacctggacttgaagttctctggcagaaaaatcaagcagaccgcctagcaatctcctttttaaaattggcaatgattcttcccgtctaaaagaacataagtgccatattgttataaaaggagcaagataataatgccacaagtaaaaaggccagaaaaattgtagagaaaatgactctttctctatctaagccaattgccaatttcaggtcaaaactcctcacgcattccctctgctagcctgcacacagaagggagcacgagagagagagagagagagagagagagagagagagagagagcacctgattctttggtctcctgtgctagatcctccaaccattgaaagccactctgcacaatgaattgttgcttccacatcctaaattgtcacagcaacaacaaaattatgaggaaataggccaaaatcagcaatgatacaagcatcacaaacacaaataagagaggaaggttgggatggcaacagcggaaaagattttctgcataggatgctctacaaaagaaaaatagcttgccttccacccatctttttgccgcattgaatgctccaacatgataatcaggaaattgtgtatgaggtcttcaatatcaccaatgcttatgccatcagcatatttcttagcacccatctataattagaaatttgtgaattagatcaatgggtagtggacagcacaaaatgtagcatgattcttcttgcaatatattctgacataaaaaaaaggcctacgatacttacctcatgattataaatcaaaacctccaaaatccattctggccattctgaaattgaggtcatcgtggttctattctctggatgactgcaagccaaaaacagaagatcctgaaataatatagagggaaattttgacaccataagaaatttaaacaggtaaggtcgcaaacaaggtttcaggaaaaaacaaagaatagataacagcaaacagtactgatgagcaaaaataataaaaaaaaaacaccaaacagtactaacatagaggttatatgtgggcatataatgcaatggaagtgaatatgattgtgcagccatgcaggtgtttggttaaaagcataagaatatagttaaacacggcatggaatattcccactaaatatgtgtcagttgcatagttcaagcatacattctttttcttttcttgagtttccaaaagaaaagaaatgtgcttgaacagtgcaaagtgacacatatttccttaattctcttagttcttggctgacttctactgagaacatggcagctggttgtcccatgtaaatgtattaaaccacagctgcatgtgatttcaatgagaataattagaataaagcaaaaagaaactgactaataccataaagcctaagttcaaaacagctcaaaatcctaagagcatgtttggatcacttgtcaatctctccatggcctatgtgcaaaacaaattgtgcccaatatttatggatggaatactagatcatttgtcaatctctcattggtctatgtgcaaaacaaaatgtgcccaatatttatggatgaagtactagtacttaacaaataacaaatcactttataaggatttttcactgaaaataaatgcatgccatattcataccctattgaccaaaagaaatattgtgtggatttatcttcaattcttcataatcttcacaaaaccacaaaacaacaaggcaaagattggtgttttttctgtaacaaatactactccacaattatcacaaggtaaaaaaagccaaaccacgcatagcatataccataagaaactaccatcgacatgacagcacaaatcctggaaagtttatggcaagaagatgaaaaccaacctgtatagcacgagattggaatgaccttgatgcatatggaagcgaacggagcaagactagcaacagttgaatatgttcaaaacggtggccacaatcatataggtttagattttcatcaactgaagaaacattgatctgcattcaagatcataacaacatcaaaagtagaaacttcgaattgtaaacagttgggtaataattaaatggaagaaacactaatctgcattcaagataatattagagtctagagcctataatactaatcaaacttgaaacactgtggtgcttatgccattccaaatggaatggacaaaaaaaaactaagtaaaggatataactgcaaagtccgccaaaactgacatggactcggacactcgactgggcagagaaaatctagcgttcatgcttatttttacttgaaataccataaagcacaatccaagagattttgttgatagaaacttagatatcagtttttcatgtggcctgagttgagaaaaaggtcaggtgataaggtaaccaacaggcaactaagtaatttactcttaagttaattaatcataggaaatcgatttcgtggaagtcaaaaacatatacaattatctagacagcacataaacaacataccgcagcagaaattaaagccatatagacatttacagtcataagcctccttggggctgcttgaaatgctttctgcagagcaaacagtaacagtgacactctatcttctgacatggtatttccttcttcatgaactgtcgtcagaaggccaccaggtaaatttggatttgcagcccttgaggcaaactttaggtgacctgatgcaactagagcacccaaaatgtgaatgattccaacaacaatgccatcacctttgtcaacattgtaaacattattccggacattgtcagcagtaattgagaagttgatgccacccaaattctttagcagctgattttcagaactggacaacttccttcctatacttgatcccaaaatctcacaaggcacatcatttgtgcttgtagatcccagctcagtatgttcttcatgaaggatggattcgtgctgttcaagttcaactgattgaatttgatcatcctggctctttgcttcaccactagcagcttttgtgtctgaatcatcattccttaaaaaatcattttcacttaaaagtgcatcagaattgtccaaaatactgttgttaccagctttagcttccctctgtaaaagaacgagaagtgcatccacaccaccacaagatatgaatgactgagcaaacatgttggctctagaaatgttaggctgcacaatcaacctatagatgaggtgcaacacccttgcaacctgttaacaaggacattgttaagatcacaagaaacagcttagactatattgtcagatgagctatatagataagatggccctagactgctacacatttgtattgtctttcaaatgatcaaggcaagtataaatatatcccaacagaaaaatagcacgtactccctccagttccataattcttgtcgttttggacaacaacatgatctccaaaatctttggctatgattttctattataatatatacaaaaaataagtaaatatttagcttttaaaaaatatttttaaactaatatatgcatcatgttctagtgtcttcaaattaaatattttaaaagttagtgatagtcaaggttctaattgtttgacctcaacctcatccaaaacgtcaagaattatggaactggaaggagtaaccacagacaagctttaagagcaaagagctgatgcaccatcaaatttgttgtgactcacggttaaaataatacccacttatccttatgatatgatgtatggaaataaatacatcaaattgtaactttacagttttcagtgtatatgctcactagatattaggtagtagtagtaccattatgatctttagttcaagaacatctgcgtataaaatatgtagaaggttgggtatttccattcaaacaatggctcaggaggaaacagtagaggcatcagcatgagtttgtctagcaatcaatggccaaattacctgattaggctgtgggcaatcaacaacaaatccaatcaagcagcgaacatcatcagaagctgctgtggaagatgctgatcctaacagaagttcaacaacaaccaagagttcatcaatcagagcattaatttcacccaaggatctctttgttccagtaagggcaaagttatcgatcgaatttggttcccggattgcccagtagcaccttctgcagctatcaagaagcatttgcaatgcatttgcatccctcatgcaagcagcctctgtaaatatcatgtctgcaagcgaggacagaagcttcttctgtaaaccataagtacatgaactccacatcttcaggtccaacagcaaagtactgaaaagctgcactttaagctcatggttgtttctttgagattggcacaaggatacaattgcatcaactagctcctcatcagtcactgcctccccctctccaccttccatctttggaaatgcttgtaattggtaatgtaaaacacgtgacaaaatctccggtgaacatgtccgacataattcttcattatttccaggatgctgaatagccagggaaataatcctgaaaattggggcagaaagagaagcagtggcaatcgacaattcaccaagcataggttcaagactatccatctgcacattgcttatagtcaacggaagtaaagccattggacccccataggctaaggcccataaagactccgcaggccgcacacgagatgaaacatgaaccaacccaagaacttctgcaggccttcggtgagtgcctacagttcaaaagaagatactatcaataaaatcatgtacatgaccgaacgtgtcaaagtgccactatgaggaagcttgggaattttttgacattcggttagcccagtacatatcaaaaatcaataatctgacatcatttcagcaacaaggaacatgatatatcaattactttgcacactgaaaagggtatagatgactcaagagagtgtcatcacaaagatttatcaacaattgacagaaactactggcattgaagatatgattcacctgtgagtaaatacaatttcttggtagaaactacagttagcagcttgctctcaagagctcccacctcatttttgagaactcttatgttttgctatgggaaaagccctattttggtcattcgactttaggatacagtttgtgttcagactgaattttttttcaaggatgctattatggaaacaaattgagaaaattgctggacaaccaaaactttttaaagatactatttacagaccattaaatgaaagtttctgaaccaaagcgggccattgaaaagttaaaggtcctaagagaaatcagagccctttttttattggtcaaaggcacattagttatatgactttgagcataacaatttgttttgtccagagcaagaatttaaataatgtgttcaggagtttgagtaacataacatttctgtatctatacctatttcactaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcggagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtggaggcggttcaccccggccgccgccgcggccccgcctccgaccatgatcgcgtcgtcgaccgcccgcacaacctcctgcggggcgtccggcggcacgcccagcggccgaggccttctcctcctcggcggcggcggcgacggctccgaccgcgccggcgtgaccgccaccgacgtgcccgcgctcgtatccggatccagctcgctcccctctgcacgcacctcgtcggcgagcgggaccgccgagaactgctcgtcggagtcctgccccgggggcggcggctccggcgaggaatccaacgactcgcggggttcctccgccattgctagggctttacgacatcaacaccaaacaccgaacaaggtctcgggaataaaaatgcgggcggaatcggtcaacgacagtgaaaaccgcgagcgattcgagagagagagcgggggtggagtggaagggggcaggtgagcagcgcgcaatgcggaggcgcgcagatctggtggcgttcgggggtgggattggccttgcggcgcagcggcggagaggttggggatcagcggcggtgcatggcgagatccgcgaggcggagaggatgggtggggatatcagatggacgaactggacgagaagaagagcaggaagggggagaggtagtagacgacgtggcgcggccggcgggttcacggtcacgggtcgcggccgctttccagtgtcgcagcctcgcacccagtcgcaggcgtttggactttggtgccgcggtttgggccttcgcggcgcattgcgcccgttaaggaagctgactaacaagttgggcctggtggcccatgtgacagagacagacaacgaacaccaattcaacgagcaggaatatacacttgttgtacgtgatgaaatttttttatgaatctggcaaatacagttttggagttttgatctaagcacaacccctagatggaagttgaatccaacatgatttcatttcaagagaagttcaactcattcaagatcaacagcacatgcagggccaggcatgatggaggagctgctgagctgcatcgatgcaggaccaacaataaaaaggagcaacgtactactcctattgcttcaatgcttgcagacaaaggaaaggtatggcacaaccgatggtcgttcacacgattgcgatttgcaaactgaatgttacggagtacttacgatcgaagtaggatgcggcctactcccatggacgtaaacacgtttaagacagtatacatgcatgaactgaatagcagaaaggggcattttctcgtccatgtactattactgctagttattccaatctcgcaatgctcgattagtgacctatatgtgcaagtgattacaatttaattacaaagaactttgacgagtaccacatggactgattaaaaaatctcagttaattctctccgcgaactactgtgacgttcaaaaagtgattagtaggtgagctcgcctgacagtctgacacgactcagaaagattgattagtccagatcttcgcgaggtcatgtgcaaagttgaaagcagcagtgcagcattatactcgttgagtcggtgcaactttgaagacacgctacacagccaagcatctagttagtgttttagactttcagtcacgcagtgctgcagaagccggacgcgatgaacttgtatcccttctggcttgaggcaatgccatacacagctaaatgcttgcctgaattgtgcaggctgacttttgcaatcttgctggaactgtggttattgtcttttcttattctggattttgaatttccatttgcatgctttccaagctctccgtgcatttcgtgcaaagaaaacaaatattatacaaaattcctgaaacatttttaaagaaactttccaacttcatattagtttaactcattcatttatatcctcagacaactacataaaaaccagattatgcataatttaatcaatttcaattatcttaaacgggatgtgtgtgttagttttgcagggtgtaggagcactgctatgcatacaactcatgcatatgactagcgtgcgactcaccttatgagactaatcagtttgctcggattcttttcatgctcaagtctttcacagcttagtcatagtcgtacatgggtcgtatgcaaagtgattcggagggcgtagtacgagtacaagtacaagtaccccaagggaaatctttttcggatttccgtagactacctaaatcgctaccatgacttatgaccaaaatgtactgagggagttcacagtggacttgtgtagcgttcagcatcgtcctcccatgtctgcaaaggagaaagtcacatgccacgttttcttccagacccaccaaaataaagttcttgtgtccaaagtttaccaccgggttcttggagagaaactactcgtttgggtggataaaagctaagagtactagtactcatttggatgggaagaaaaaggagagagatgaaaagtaaaaagtttgtcactggtgggaccccctactagtacttgcactgtggagtatgaagcttataaggttcttcgtctacgtggcatacgaggaacagcaaaaatcggcgatgcactgtgaacgccctgaagatgcctcacttcaggcggagcctctccgcttggatgatagaccgattatttgagcctctccacttggatgatagaccgactatttaagcttggaaggagttgctttcctcctttctctccgttaatttgtaatctgtaatttgaacaatttgctatgtatctctttcctctaattagctctccccctgttgatatttcaaaaaacaacactcgctggaatagtggaagcagctagcaccccaaagatcattcaaatcacagatggacaatagacataggtaacggcgcttaattgattactctgtgcattagcatttgtttacctcagcttcccccaacccaagggccaaggccccaatcccaagcgtcgaccgacaacaaacggccccattgtcctgtagcatttccagtaaaaaaaaacaaccctattgcttcacttattcgagaaataagtgaaacgatgtaaatcctattgcttcacttattcgagaaataagtgaaatgaagtatttacagataaaaagtaatttataaataattttttttatgtacgtgttcttaacaatttaaaatcaaaggtcaaaaataaacttagatgaaaaaaaacataaaatcaactctaaaaattgaaaattcaaattttagctgataagtataagcataagcgaaaagatgaggctgaaagctagcagagccgcagaggaaccttgaaactgatcgaaacccaccaggtttcagccacccgtttgctcgaaatgaaccagaatgaagcgctcaggcagagccgcagaggcgaacatcacatccttgccgtattttcctcttcgattcaaataccatgcggcacgcacggcctgttggcctgattctggattccagtcgctcacatacacagccacgcaggaattcatatggcacatcaatacatatatgtacctcagcaataacaggaaaaatcgatattggaataacgggtctagaatgggccagatcggagaagataaaagatcatctagtttacaggagtactaattaatgaattgacagtactctgatcgacaggtaggatcaaacactgaaagcctgcatatatgcaggaacccgatgcaaaaacaagcattgttctgttcctgctggagcatgagagcatgcatgcatatatatatgcctgatcgcttgatcagctagcacgcgcgaacgattgattaagggaggcttgggaacatcttggttaattcagagggctctcgctttgacgatgtccatgctcatctcgctgggatcggtcgcctgcagctccacctggatcccgtccagctccctcttgaaccggtccttggagctcgcgtacagcatcttgctcctcaccttcgacgtgtccggcgacctggaaaccaagtgatcacaccgcagattcagagatccaagattagtcgaggcatgcaattcaatgtgaaggcaaaaattaattaaaaggcgctggttaaattcatatattttaccaggagatgaagaagatcttgctcttctggcagttctcgtcggtgacgaagtcgaagtcgaagacggcgtagcggcactcgctggcgggcatggaggcggtgaagtcgtcgtaggtgtcgcccggctggcccagcctgtccacgaccacctgctgcgtccgctcgtcgatcttgaacgtgatgaagcggaagctcctcttcgacttgagctcctggaacttgagcttgcactcgtcgcccacggccatccccgacgctgagttcgcctgcatgcccagatcaagcagcaacagcaacagcagcagttagacgtcgatcgtattggcatatgtaattggtcgatcgtatactcaccatggttgataggtttcgatctctgcacggcggtgacgaggagagacggatcggcgtggaggaggaggtggtgggcaatggcgatggcgaatggcaaagagatcgatctccaaggcctgaaagaggggggaagcaggcaaaatatagataagcagctttgcatggcgccatgccgccacgttaggaggaggagccgggccgcgcgtttgaccaacgatcccccttcagggccttcactactatacgtgcgcgagacccagaccaacatgcgctccaccacccatccacccatcgccgtgattgcgagacaacggacaggcatggcacggcgagtcacaaactcatcttcttgtctgcagcggctgaatgcttcagaagttcagagaatgcgcaattgcttcagaagttcatctttggggcagcaaatactgctccagaaatctataacgcggtttatttgagtcgtcaagcgcactagattcttcaactggtatttaaacgaattattgatgactatgatggtaacaaaacaactagagactggcagagaagaggcgttaacagactggcagagctccttgaatcaacacaaacgcaatgttgacacccaagaacatcacttctcaaaacattgaacagtagatcatattaaattcccgttgtacgttacaaaaccgtgatcccccaatagacaaaattgttcggaaggatcttcttctgtatcattactggtaagctacaaaggttacatagtttaaccaaagaattttacaactttcggagcttgttttacttttgccttagtgttggtattcttgtcaccatcgcctgtctctgtggtagattttgaactagattgtttagccttctttgccttggtgtgtcttgtttcttcttcttcaataaaatcgtcatcaaggtcatctccaccccggagaacagcattgtcttccaggtgatgctcctccgtattgaaagctagaaataagcagaagaccaaataaatgagcggctactaataactgtacggaaaaaagttaccagatgtttgatagcaccatcggacaaaattatagaccatctcaaacatataagaaatcataacttatctcacacattagcatgatggcatctgcttggcgccttagccagactgctactactaaaggcgtattcacccaattacccatcggcacagattctatgttacagtatagcatcatgttatgtttctttaacaaaacaaaagaggcacgcctggcaggctagtcattttctcctcataaggttagccaaatgcttacatctaagtattaatccttaattctcacatggatagaaaaggtaaacataatctgttcttctttctccaatgtattgtcaaaacaagcgtatggtctatacatccatgaaaacacttcaatggttatttactaaatgtaaacagtattaataacaagtggatacaaagatcagctacaagaagttagtgaaagttccaaattttttaaaatgaatcagcaaaagtacaatacacatgataccgtggaggaatgttaagacagttcccacaaaatgttacagttgaggtttgtgtttaccatcatccccagaagatatcaagtcttgcctccctctgtttggacaatgcttggccaggtgtgtaacttcaccacatatcttacagcaacctccctaacaaatgtatagagttagaatccacacgtaatggagacatgcaactaaataaaggaaagataatgcaagcagaacatccttcaaagtggacattttgagcccctaaatgcagaatgttatctcagtccaagatcttgtggtgataagggacaacagagtatctgataatacctttggataaatgccgtgtttgttttcaggacaattcttgctcaaatgtccctgctgtttgcagacaaaacagcttgcgaactttgtaccccctgtatgcaaaaatcatgctaaatgtgcgaggaaatcatatggctgagggtaactatttgcaggtatcgagtatggaaactggcaactgtatgagatgaaaggatgtattatttaccattttcaatgggtttggggcacttggaaagtgagtgcccagattcaccacaattataacagaatttcttcaaattttcatcatttttgtcagggcaattcttcaggctatgacctcgttgcctgcagagcaagcaaatctgaaagaagaaaatataaatattaaattttagcttgaaaaccacaaatgaactggtcagactttgaggcaactaagtactgaaaaaaaaaatactactgactgaaaatatataactgtgacagccagaatccactgattaaaggttggaatggaagcagtaaaacacttatcaggatggcctccagaagtcaccgttttgccattcacctagagatagatacaacgtgtgataaaacaaaaaaatacagaacaaccaatacacgcactgcccagtgcccactgctaggtattgcataacgtaaataacaccccgcaacattaaacagaacaaggcataaacagaacaataaacagaaaacccatactgatttcgttggttttaacccccaataataacagaaagtcagaaagtacaaatgctgatctaaacctaaggtcaccttaattgacgttcttaggtccatggcttctatagcaaaagacattgggccgagcaaaaattatccccaagagcttgcaaaaggcagggattttgagacgaatggtggtaggcagataccttgttcttctcccagagggacttctcggggcagaccttggcgacgtggtccgcggccttgcagatgaagcaccgctccccgggccgcatcccggggacccggagcgggtgcttcgacctccccgcgcctcccccacccgccttactcgtcttcttgaacatgctcttcttgttgttcttcttcttcttggtgccgtcggcgggaggggtcgggttggcggggaagaggcccgggttcgcctcgcggaagcgcttccgcgcttcccgctgccgcttgttcgccatcgccttgggctacggacgctctctcgccgtcgcgcgtggtgctgtcctcgagcttggtatctcactctctctctctctctctctgggcggcggcgcgcggcggcgggggacgggagtcgggaggggagcaagggaacagccgagcaaggagggcttcgttttgggaggcgctgacgctttgagattcgggctcacgccttgatccaccgtccacgcatctagaagcagtgggagccactccgcgaaataacggctaaacgaggggtatttctgaaaaaggcaaatcagggatctttttgtaaaattcgcgtcaagcgatctttttagataattcaaaaaaaaaaaaaaaaatggattacatcgattctgccataagacatacttcctccgtttcacaatgtaaatcattctagcatttcccacattcgtatcgatgctaatgaatccaagacatatatatgtcttagattcattacacaatgtaaatcattctagcattccccacattcatattgatgctaatgaatctaagacatatatacatttttcacattcatattgatgctaatgaatctaagacatgcatcaatatgaatgtgggaaatgctaaaatgacttatattgtgaaacagaggaagtacaaccataagtttaataagaaaaaggtaaagataaaaaatgtaaggggagaaatctaacgcaaaaatggtccagatgtccagcagttcagcaatcagcactctagactgaagtattgaagtcaatggcaatgcaatttcctgcatcgagtaattcagcagccaaggcaatttcctgtaaggaaccaatggatttacaggttttacagctactagccccgtctattcaaattcaggtacagatttcatcagtggtacaaactggactgtccaatcaacgtttatagagagactcccagaggacaccgaggtcaacattgcctccagaaacaatgatccctatcttactgctctcatgccaagcagagctttgcttaaactcgtcagagagggcggctgcgaggcctattgctccactcggctcaacagccaccttcagcatctcgtagcacattttcatggcgtccacaatggcattgtcatccacaacaatgatatcatccaccaagtcgcgcaccaccggcctaaaatgcagagatcaaatctaagaagttttcttgaagcatgactgcctgctgggtcaatagatatttcaaataaaaccgcataaatatttgcaaatgcatttggaaaagattgatgctgacaacaggttaacattttactatggttgtaattagtgtggggaatgcatttggagaagattgatgctgagaatcggttcaatgtataatgctttaccatgtcaggtcaccaagaaaagctcgaagtccatcagcaatggtgttggttgaaggcaatgttatgatctttccagcagccttggactgggcagaatcatcagcaccctttggttctgctgccagaatacgtattgaagggtttatggccttggcagccagtgccacaccagaaattaaaccaccacctgtagtgtagccaaaagtatatgcatgcgtcaaaatagaaaagaaagacttgtgttacagaagaagttaatacagtagagtacagaccactgattggaacaattattgtgtcaatttcagggacttcctccaaaagttcgagagacactgtaccttgaccactgaaagaaaacatcatatcagaatttgcatgattcactgaaaagttcatgtttgctattcaataagctaagagtacacattttaaagtggcaagacatggaaagaaactaaggttgttaaacacaagctgtatgaaatatgtcaagtagatattgccctttttagtctaggctggtatataaaaaaaatcatgaaacctggatgaaatatgatttaagagtaatgatatcatatacagtttgaattaagtgctgatttcatgaattgatagtgaaccaaggctactatcaagtaatttcatatactcgtaagaagaagagcctatcaaagttcaccccgctctgtccatttcaaatcccaaatggacttcttttgcatcaaagtagtaagctcaggaattgggactaccagataaacaatagagtactagtgacatgttcaatccacttagactttagcagcaccagtatctaggggtatgatatgttaaagcaaacagcttttagtctctgtacaatgtgttcatgatttgagatatgaacaaactttccgcatagcaacagagcaactcaataaaaaagaacttagaacagagaaatcatacctgatagtgtttttattattgaatgggtgaacaagaatagcaccagtttcctcctgaactcttttagcaacagattctcttgattcaatggagacatcactccagataatatggccaccgtaccgcttaacattgtcaaccttacatgccggtgcatttcttggaatgacaatgtaagcaggtattccgcgtagctttgcagcaagagccactgcagcagcatggttcccactgagaagaaaccatttcaatcagttcagttcactgtgatgcttcttaggattaggatgccaggtaacattgcaataactatgaagctagcactaacctgctatgcgtcacaacgcccttggatgcctcatcatcatcaagcgcaaatatcgaattggaagcgcctcggatcttgaacgcccctctacatcatatattcatatccccacacaagcaattagcagcaggtagaaattagcatggcagatatgccaaacaacacgcgggggggggggggggggcagtgactctcacgccttctggaagcactcgcacttgaagaacagctgcttccccactatggcatcgatcgatgttgatgacagaacgggcgtcttgtgcacgtatggtgcgatgcgagcctgcgcctccctgatggagtggatgtccgcggcatagccatggctttctgcgccatcgccgccacttccacctctgctccccatcaggccctagtaagtactcgtgttagctagcaccacatcaattctcaatattgtccttagctcagtgatatgggcttcaaattcagtgactgaaatactgcgcgcaagatagtaactagtattccatcaaaagaactgcacaaaaaataaaatctatcccattacattgaggggagggcaaacgcaaatggggactacatcagtggagtagtaactgcatcaccaggaaggcaatcaacagagaaaaatatcaagaactatatgattcgagcaggcaaggtgactcaagaaactaaccgaggatttggaggagcaggtgcagaaatcttgcgcggagaggaatccgaagcaaggagaaatcgcctaaccttgagtgacagtccgggcggagatttggaagttttttttttttcctatttgagcgatgaaatccaagaacctaacgagaagaagatggcgttgtggtgattgacgacttgaggggcagccgtgcagcctgcaggccactgtcttgtttgggctaaacttatctaatgggcctccattgttgatatctacgagatcgtgtttccgagcccatttaaagcaatttgcatctgctcagcccatatcgggtattaaccctaccgattctgagcaagaaagtcttcacctgaatctttcgcatttctgcttttacgtttgctccctggaatactagattcccagagcatcgagctgcgacaagtaatagctattaagccgataataattatactcgtcaagcatttcttgatcaatctgtgatcacgtaatggcggtagatacagaaagtattctagttttgcctttagggagtaatcgatcactgagtgtgagtcattcgcagatcaccatacgtaaggaaaggatcacagggaaacgctcatcactgtcagtgttccccagggaggtcatgaaatctgctcaatggggcacggcatagtgtattgcctctattttttacaagcatttgtcgcgcttgactaaaaaatgcacacattaaggaaatcactgtcatattaattttgacaaaaatgtcatctgctaatgctgttgcatgaaaaaatttgacagttatcatctgctaaaagagaataagagaccatattgatgattggctcctgctaagggtggagatcgctctatgcgggctgattccagagttgacattcacattttgcctgggcactaaattaactacggatagatacagcttagctggacgatgacttgccacttggaatgtcggatactgcttggcttttcttcagtgattccgtaggctactgctacaatcgatgtcagtagtgacacctgcctctacctgcagttcttcaggattcatgtactaagaacccactcaggaacaaccttcccctaaacgagctgaacagctagtcttaaacaaaccagttgtttaactagaaattaagcagccagctcaactgattgactgtcaggttaagctatcgcctatcggatgacgccacgatgcagtaaaacaaaaaacagcgccttgattaactatcacgcaactcgatcggattagctcccatgtgtttgacttttggatgccaactttgcgttaaatcgtccgagtttgaatttttcgcgcgattttaaacgaagatgccagatggctcttctctaaacaacgcttaaagataccatcagagcaagaaatctctgcgtggttcgagagattagctgttatccagggagaaccgtcacctgtttttgttactactccagttaaaaataacccaaacctgatttgacttcgattgtttttgaaacgccggccggttcgcttacacgtctgtgcttgaaaacaaattaatctgagttgaatttgattcgttgtttcaagaggatttcctggcagcatgcccaaccttgttcggctgttcccacatattctataattcaaaatttgatgcgaacgattgcagacgcaagtatgctggcaccacaagcgaacgaagcaaatccaggtcaaatttgaatttaaaactttttctatccaaagcgctccggtcatccaggcgtttaaatatttattcggggagtacttgacgtgtggaacgtttaaacgggaggcgtgatttcaaattgtaaacggcatctttgtcttttgtgtatgaatgtcttagcccgaaagacgtggacagatgcattttcaaaatgacctataccctccgtttatgaatctggacatacctaaatgtccagattcgttatgtcaaaattcgttgtattatactaggttaatctatttttgaaacgaatagagttattaaaaggctgcatgttaccgtcttccagagccttccagcccgctcaaaacaaaaagaaaggccctgaaaatgtcagcaaacggtagtgatccagcccacgtattcttgaggcccaagcccaagtttgattgtggaaaagaatctactatacgcacacacgtccataacaccggaacgcgcatcagcgcatcactgctagtgtttaatcagtgaaaaatgcctaggatgcataaaatttaataggcgttcatattccagctatatgaaaaataataacgctaaagtgtcaaacaagatttggtattactcgaagcacctcattttatctgtatgttaaaggcttattcacttctcctttgaaatggacactacattatcatttattttaaaagattgcaccaaagaaaaattcctatgcctccacttcaatcctttggatcgtttgctacacaaccataagaaattttcctatgtttttcaattcttaaaagtttgcacaagtattcccatactatttctacatttttttctattattacattttgaatatcctagaaacttaacaagccctaaacttataccattcacgttttgaatattaagtaaccatcgagttgtattttttgtgggggttgggggggtgtgataaatcttctcacactttggtttgtgtttaaagcttgaaaacctcctctcccattgacccatttatttgttgaaaccacgttttcgtatgggaactagaattgattacctgatgacaatgtaaccacatcacatctatttgtaacataccatacctgttaaataacttcccattataaagatcttaaataggagtacagtctaaataataatgcattgcaatctgaaaaaaaaaaacaccagtttcaagtggtgcacttaaccatgtcacaagcatatgctcgaaatgcaatggcgcctgacgtgtaccccaaccaggctgagagagcggtcatcggtcgacgtcccaactttcttttcacctcacgctacatgttgcagcgtttgcgccgttgcgctagcatttatgaggtgcacccataatttttcctactccaatgctgcgttcgcgagcactttcgtgttgcggttttccaatacgtaaccatgcgctagagcggtcgcgctctcttttttctttcttttttcattttttaccctctttttagtttttgagcgagcacgacgatccaccccaccaccccggcgcccctcacgccgccctccccgaccctataaattcggccatgtttaaaccatttcaccacaaaccagcagcaaatcaaacgatcaaattgtaagaaaggaaaataaaaacagaagccctcttccccaaactcgagggggtcacgcgaacacgctgccaatggcggcgagcactcgagccctcttcctctcctgcttccacggaagcggcggcggcggcggcacttccgaggtgagccgccgcctcgtgctgcggccgcggtacccgtccatgccgcggcgaccgaggtcggccgcggtcgccggagagggaggggaaggaggaggaggaggaggcgacggcgatctggaggcggcggccgtgggggcggaggaggaggagaaggtggcggtgttcgaggtgtccgggatgacgtgcgccgcgtgcgcgggctcggtggagaaggccgtcaagcggctccagggcatccacgacgccgccgtcgacgtcctcgggggccgcgcgcaggtcgtcttctacccggcgttcgtctcggtgagtatcgaaggctccgtcgctccgatttttccatatattttttttaaagcatgccgcgtttcttacgggctgcttgcttcccgcacgaccagattgatcagcctgtggatagctaggtaaatttaataaggggaaaaaaatgaatgatgctttgtgtgcgacatttttcggttcatactccataccgttagttgcgggtgcttatacgcaaagtggtttgatcttggaagtaggtacacgggaactttattaaattccaggctcccaggctccgggctcccagctatttagcgcgtagagacaaatacatagctgtgtaacattagcagtagatagacaggtagcatatcagacacactgattaaagcatgtttttatgaacatgttattagaaatgtccatacgcatagtatcacgaaaaaggatttgagtgagctttaattgatgctccacaagttcagaaatacttgaaatgtgaggtgggttcgtgaaaagttctctttgcggtttagaaggttacaagtagacatctttgcttgtgacgttgaactgctagctgcttttggggatcccttgaaacatggattggcctgttggatcccaccaactccttcagctgcaagtattaagatttgcacagacctgtagtttcaatatgaagacgtatttgataaaaaaatggacgtcctgcttattgtttgtagcagacaacctctgcttctggacagaaagtagaaaggaagaacaatctaatgtgcatgtgccatgtaattctaatttacctgatattcccaaaacgactgtttcaagttctttttactgaaatcagaatttcagatttaactaactaattttctgtaccacgtaaactttgtacttacctgttttgcttggcgacttttacactgttgcactcttcattctgttgcaaagttccaaattgttcatttggtgttccttccactagatgcaggcatatgcctgattagttactactaatactacaagttggaatatattttcttattcaggaacaatttgttactcacgtttatcatctcataattacgctctctgatcagtggcgcatttggggatgcaaaattgtaatcttattccccatcattattatcctgaatatattttcggaaaaactaatattttatttgatcaagatgtgtcgcttttaatcagtatcttgaaatttattagaacgaaagggggtgccttttctattattggatgtcattttcccactgtgcaaggctgtaagttcactgttaaagataatttcatttgatccccattgtaggacatgaaacaaaccaaagatatttcaacatagtggttgcttggtcatgcatttccttatttgtgtcaactctctctgcatctagtaacttttggtcagtaatagttagaagatgctggcacacttatggataaagtacattgcaaaggactgatattacaattcgagaaataatctttgatgtaaggattgaagttttgtttacaatcttttgagttgggtggcctgtataacacaaacagtatttcagttatctctgtcaggatcccactatgagctgaagcctgtctttgtcaccgtcccattggatagtgcctctttcttcgtagcgctttatattgattgggaattaaaaagaaagactatttgtgttttggatctgttgaatttctagaaaacatatattagttccattgcattttggataactttgttgttttctgtatttgatcaacatctaacagaacattttcatagtggtaccctttttccattttttcaatagttttacttcatgtttttacattacacatgtccacatgtttcaatccaatttttcttcctttcttatatgtttggaaattgtgctcatcaatgccatttgacaggaggaaaaaattagggaaaccatccaggatgtgggctttgaagctaagctgattgatgaggaagtcaaggaaaaaaacattctagtatgcaggctgcacataaaaggaatgacctgcacatcttgtgcgagcacagtggaatccatcttgcaagttgttcctggtgttcagagagcttctgtcgcattggctactgaagaggcagaaatccgttatgaccgtagaatcgttactgccagtcaactaacccatgcagttgaagagacgggttttgaagcaatactgatcaccactggagatgatcagagcaggatagacctcaaagtggatggcacactcaacgagagatcaatcatgatagtgaaaagctctgtccaagctcttcctggtgtggaagacataaaagttgatcctgagctccacaagatcaccatctcatacaaacctgaccagacaggtcctcgagacctcattgaagtcattgagtcagctgcctctggtgatcttactgtatcgatatacccagaagcagatggaaggcagcagcatagacatggggagatcaagcgatacaggcagtctttcttgtggagtttagtattcaccatcccggtattcctcacctccatggtgttcatgtacatcccagggctgaaggatgggctcgaaaagaaggttattaacatgatgagcattggtgagctcttgcggtggattttgtcaacgccagttcaatttgtaattggccgcagattttatactggtgcttataaagcgttatcccacggctcatcaaacatggatgtactcattgctcttgggaccaacacagcttacttctactcagtttactccatcctccgagctgcctcctcacataattacatggcaactgatttttttgaaactagttcaatgctcatatcgtttatccttcttggaaagtaccttgagatcttggcaaaagggaagacctctgaggctattgccaagcttatggatcttgcaccagaaactgcaactatgttgatatatgatcatgaagggaatgttgtgggcgagaaggaaattgacagtaggttgattcagaaaaatgatgtgatcaaagtagtcccaggtgggaaagttgcttctgatggctttgttatatggggacagagccatgtgaatgaaagcatgatcaccggagaatcacgacctgtggcaaagaggaagggtgacactgtcataggagggacggtgaatgagaatggtgtgcttcatgtccgtgcaacatttgttggatcagagagtgcccttgcacagattgtacggctagtagagtcagcgcaaatggcaaaagctcctgtacaaaagtttgctgatcagatatctagagtctttgttcccctggtaagttcagtttcatcgtggtaattcaacggatatcatttcttatcaattctaaatagtcttcttcatcctttcaggtcatcattctttctttgcttacttggcttgcttggttcttagctgggaggcttcatggttaccctaactcatggataccatcttccatggatagctttcaactagctctccaattcgggatatcagttatggttattgcatgcccttgcgccttagggcttgcaactccaacagctgtgatggttgctactggagttggtgcctcacaaggagttcttatcaagggtgggcaagctctggagagtgcacagaaggtccataaaaaaacattgtacttttagatgcacatgtttgcaaacatcaaattattgacaaattttttatggcatttataggtcgactgcatcgttttcgacaagacagggacactaaccattgggaagcctgttgtggtcaacacaagactgttaaaaaacatggtcttgcgtgaattctatgcttacgttgcagcagcagaggtatgctttcaagcttgctagatctttttgattcaatgcctttattacttgtagcaaaatatcattcctttgtgatatatgaaaaggttggttgagggcatagatgtatgcctagacccacccaagttcaagtcctcatcgaggcgaattcggatgcctatttcttcttaattaattaaaaatgtcacctagttcctcctaggttggttaaggttcttttgttgtgatttgtaaaaagaaacattgctcaaattttatcggttctggtcttcaggtcaacagtgagcacccactgggtaaggcagtcgtggagcatgccaagaagttccattcggaagagagccatgtctggactgaagcaagggatttcatttcagtgacagggcacggtgtcaaggcaaaaataagtggcagggctgttatggtgggaaacaagagctttatgttgacttcaggcattgatatcccggtggaagctttggaaatcctaacggaagaagaggagaaggcccaaacagcgatcattgtggctatggatcaagaagtcgtgggcattatctctgtatctgatccaataaaaccaaatgcccgcgaagtgatttcgtatctcaaatctatgaaggtggagagtataatggtgactggggacaactgggggactgccaatgccattagcaaagaggttggcattgagaacacagttgcagaagcgaaaccagagcagaaagctgagaaggtgaaagaacttcaggtgagctatcataaaatcttttgcatgtctcctggttttttttgccgtaccgttatttggttattcacaccctccgatttttttttactcttgcagtcggccggaaggaccgtggcaatggttggtgatggaatcaacgattctccagcgcttgtatcagccgacgttggcctggcgattggcgcaggcactgacgtcgccattgaagcggccgacatcgtcctcatgaagagcaacctggaagacgtgatcaccgccatcgatctgtccagaaaaaccttcttccgcatacggatgaactacgtctgggcgctcggctacaacatcatcggcataccgatcgctgccggggtgctcttcccgtcgacccggttccgcttgccgccatgggtcgccggcgctgcgatggctgcttcctccgttagcgtcgtctgctggtccctgctgttgaggtactacaagagcccaaaactgggccgttgatcatgcagtacacacgcatagcatttgcttagaataagaggtgtagatatctgttgacaatgtgctaatgtggttctaaaagaaatgtgctagtgtgtgttgtgtggcacctgaaatgtgtacattacctacgtatatatgcaccgtgtgtttacaagtgttaaatatggagcactttgccaacactagcaggtgatacgttgtagtgcaatccatctaatcttggcacttcctaacaatggaggggacaggtcgtcaatctcaaaagcagaaatgctaatgcttcgtgatgatgcccgggtttcccgtgcaacttggctaatcgacgttggtagttacctaactctttttctgggtggcatcatagtaacctaactaagcagtttagcacgcaacgcgcaattgagcacacttcgaaccaaaagatgccctgaactttactactactacctacgtggctcgcagtgggaacatttggtatctgagctgaaactttgcatgggaatttgggataatttggccacttgcattctgagctgaaagatagtgctccgactagggcagtggagctatcttgccgagagcaggcaaacacaactggttcagtcttcagcttagctacctatacaccttcgctcttgtggccgatcattgtcaagggccataacccagccaccgaattaaggcttctacctgatccactgacctcattgcacttgatgatagtatacgatcatacgactctggaaaacatgctcgatggctatcggttgcattattgaatttgttgcttgatccgccccatgaacaacagtaacccatcataaacattgggacctgtagtgagtttttatgggctccatagcctgttaaagcaaaaggttactttagatccttaaataaaggtctctcaaccacaaatctagatataaaataaccctaactattaaagccaatacaaatttaatccctcagtgagagatcgagcaggaattcctaacggcggtgacaccgagctaggatatcccctctcttcaaagtcgctgcagctcagggtaggtgtgctatacgctgttgggaagagagagggcgagggagtttaggctttttttttataatgtgaatgacatgtggatcttatatttttaaaagttttaatgtaccattattactaacatataggtcccattatatatttatttttattatttttttcagatggtgtcacacataaactccacgtcaaacaaagactaagtcaacgtgttatgtaggacaaaacaaccatctaaaaagatcaagagacttgatttgtataggttttgctagttgggctacgcattatagctggttttacaattgagggatacgattcaaaactcgactcctagacaaaggacctacaattggacgttatcccctgttaaaaggcacacggctagaccagaccagaccacctacgttgatcgttcatcgtgtccgaagcctaataaagcccaaacaaaggattttcggcccagcacagcctagctccacataggagaaagtacacccaaggtccctcaacttgtcatctaattacaaaatcgtcccccaaccgcaaaaccgcacacaaggcatccatcaacttacaaaaccattgtagactagatcactcggcggttttaaccctggttttgtccgaagtggtggctgagtcagcgtgagacccatgtgggacccacatgtcattgaaacattagtctattttcccacacttctttctatcccctcccttccaagcagatcggcaacggcgtggggagcggccgtccggccggcggagcgggcaggcgacggcgcggggagcggccgggcggcgggtgctcgtcctcctggtcatcgaggccagtggccggcatgctggtcggcaacgggcgcaagcaccaggctctgacgacgaggttctccaagacgggcgcttgtccccccggtctgcggcgaaacggcattcggcatggcggacgaaggcggcgcaacatccgggtgggggagaagcgagcggaggagggtggcggcgatgaagcggtggagggcggcggcgtccctccccctggtggcgatggagacccagcggcccttccacaggcggcgcaatgcacggtcatcggcaccaccatatgccggccgttcttgtgctgccgccaccgccaagccgacaccgacgccggcggcgagcgcggggaggcgttgaccgagctggaggaggacgacaagatggcgcgcggcgctggaggactcctcatgcgccgtttgccgcttcctccactccgccgccctgctcctcgtcgccgtccgctccatccctaaggagctctcccctcgcctcctctggacccccgccttcgagttcatcgccaacgaccgtggccaccccacctcctccattccacgcggtggagctcgccgacgactgatttggacttgggaggagctcgccggcctccccgcgcctcctctgggccctcgccttcgaactcatcgccgacgaccgcggccaccccgcctcctctctttccacgcggtggagctcgccggcgatgaacgatttggacttgggaggagctcaccggcctctccgcgcctccgccgtgcctccactctcgctcgttcgctggcctccgccgtgcctctgccgatgctcaaggggagaaatgggagagagagagagagaggagtaacggaggggagggagaagagaaagggtgttgacgtggcatcctgacatgtggggtccacatgggtcccacattgactcagccaccacatcggacaaaaccgtggtcaaaaccaccgagggattttgcaatggttttgtaagttggggatgcgttgtatccagttttgcagttgggggacgattttgtaattcgataacaagttgagggaccttgggtgtactttttccctccacatacgatattcgtgttgcggcccatgaggccatagaccatcagttaccccagcccgacccatcgtgctgcaagcctttgcaaccatcgacagttgagcaggccccccaaacgcgatgggcgtgggccgcgtggcgataatgtgtgcgccccgctcccctcatatccgtgtccgtgcacgagtgaacaacccaacccaaccgatgcgcgacgcagtgacgcaggcacagcgagttgaccggccgcgccacgtacggttggttcctcctcccaacacgcggcgggacccgtctccacgagccgccgttccctagaacgcggcggcaacgagcatcctcctccgcgtgggccacacgctgcgtttacaagcgttcacaccttcggcctggccttttttatactcccccccttccccaaggtgatcacgtctcgtctctgtctctcggcccaccgcttccatcgttcgtcctcgtctccacgctaccgtttcgcaaccacccgcttcctcctccggagaccgctcggccgccgctcgctccagcatggccgccgcgccgtccgccacctccgtccacgacttcaccgtcaaggtcagttcctcctctcggtcggcggcgctcccttctcgaagggatctgtcctgcagtgattgggatgggctttccaaaacccgaacccgctcgagcagtcgagccgtgcgtactttggggggtgggtgggggggggggtgcctgtaatccggggtggtgcttgacgtgaatttgttgagcagtagtaattgggtgtttcaccgaatttcttagcttgttttgcttggtgcgagggcgtgcaggatgcaagcggaaaagacgtgaacctgagcacctacaaggggaaggttctcctcatcgttaacgtcgcatcccaatggtacttaattcacttcattacgccccccattttatgatggaattttactactacaccgtctacacatcaacaggttgatgtaggattgttttagcggaatggctagctagaaaacttccgcaagtttttttttcccccaaaactttcagatttgttgtcttttgccaaagagaataataaactgctgcaaaacagaatatcactagcagattcagagcatccccagccctgttgagcagttgaactgaaccggtcccatatgaatcatgcaaatatcatgatacaagcacagctcattaactcattaactcgtattgtgaactgcgatactgtctttgtttggtctactgcaaagatggtccaaatcaataggtccactgctgcttattttatggaaccgttttctgcataattgtccttatctgacgtaggcagctctatatatatttttttatctatatggaaccatttcaccttacaccgctaagcattttcttcgaccaattatttcagtggcttaactaactccaactacactgagctgagccagctgtatgagaagtacaaggtccaaggtgtgtctttgacccgttgcctttgtatatctttgtatattgtaattgcctttgcatattgtactccttcaccatggaagttggaataattatctagttcatggtcacatggatcattaagctttagttattatatgtgctagtagttcttcactttaaacaattccggttgttgtggttcaaaccgctaaggaatattaccaatgtgtgatttgtaggctttgagatattggctttcccgtgcaatcagtttggagggcaggaacccggctccaatgaggagattgtccagtttgcttgcactcgcttcaaggctgagtatcccatttttgacaaggtaagttaacgcaatacttttaactcaatcagagtaattatcagtgtgaagcaaaatgatataagtcacatgttttatctatcgaagaggtgtttctgtggagtagcattgagtctcttttttttttatctgtcaggttgatgtcaacggtaacaatgctgcacccctgtacaagtatctgaagtctaacaaaggtgggcttttcggtgatagcatcaagtggaacttctccaaattcttggttgacaaggagggtcgcgtggtggatcgctatgcgcccaccacctcccctcttagtattgaggtaatgtcctgcactaccacttgcaatctctttctacaggctgaattgttaggctctcattataacatttccatactatctctgcagaaggatatcaagaagctgcttgggagctcttaaacctaaaggtcgggatctgtagagcaacctgcacttatgcactgtattcagcactgagagttgtattaataaattggtgacatgtacttcacaggttgcatttgcactatactccttgcatcctgaatctttattgtactctgtacctgtatagttttcatgtcaataaatttccttgctgtatctgtgtgtatgcatctcattggatcctttgtcggcgtgcactgtattgttcgtttattaagatagattcggccaaataaacatgcaagtatgcatttgagctgtcccaaccatggcaagcacaagaagttgcatggggggatgccttggtcatgcgttccaacagtttaagatgaatcagagcatactaatggcattgatgaacacaatctttccctaactttttcctcctgtcaaatggtattaccttgatcaatgtcatcaatgccacaaggatgctcagaaaaaatttgatttgttagatgcatttcataatcctgtgtttgtcttaaatatgactccatacaaatttcctggacatgcttctgaataagcttactatgtgtaagtgatccatttttttctgacattattagtttagtactcccttcgttttt

SEQ ID NO: 74905 - DNA, 519 bp, Oryza sativa
tgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagt

SEQ ID NO: 74906 - DNA, 819 bp, Oryza sativa
  unsure (1)..(819): unsure at all n locations
cctcatttctgcctctgtaatccgcatcaccctgtggaaaatgctctgcatgcctgttcagttcatcgatgttcagtaggtcgtcgatgcgagcgacaatgttggacgccagactctccagcacccttgaataactctccagtattgatttacccacatcctagaaatggttcaagacataataatgacaggtgcatcagtaactagcatggcaatgtggataaaacaaacataggaagattcagagagatactgcacaaaccctgttatactgaattttgctcatgtccaagcttgtctgcgtcagtccaggaaacctttgcttcaaacatatcagtaggccctctgctcgttcggcaagcagctccctcttctccgtgtctattatcatgtctttcaccatgccccaggatgatctgccactggtggcacggcctaagacacttgctggttttgcagcaatccttcggcgccacacatacactgatgcctcgacacggttggcgatttccagtgcttggtactccgttgacaggtccaggcagtcgagaaggcactcaggagagaaatgatcagacgttatgtaaaggtattatgtacttaactaactgatttagtagtaatgataaatgaagcaatagtaggcttcagtaataccaacatgctgtcttttattatgtcattactggtgcaatttcagattgttgtggtaaaaaactcatctgcctagtgaaaaacaagatgaaantgtgatttgctaaggngagtatgtaaangattctttggtgataaattagaattaatctataccagagtctt

SEQ ID NO: 74907 - DNA, 999 bp, Oryza sativa
  unsure (1)..(999): unsure at all n locations
gaaatatgttccttatgaggaaaataatctttactggttttattatggttaaaaacagtcttcatagggtttttaatttcggatttttaaagtttagagcgcatattgtccttaataatcattaccagaacatgtaacaaaatatgttcttttcctagttagaccggccggcacctgttaccctcncctttatattagttattttttggcggaaactagataccttctggacagcagcgtactccatcctgcaatcctgctgttacgccttgccatgcataatcaatgaaatgtgaagcaactcctgttcggatagcgcccctcctgttattagcggctttaagtatcccggtcctaaatacgggccggatcagtcactagatctttgcaccaaacactagccatctcgtccaaagatccttagcatttggtggtacgtgtatcatgaaatgtccagtatacatcaataccatcatcgccgaaccctacccgtacgtagtgtacgtagtagtagtacgcatcgtcccaatccaaccataataggctcacgcgcgcacggcccgatccatccgatcagcggaccatcacacgattataattcccgagaaaagccatgcatgcatgtacgccccatgccggccggcggcctaacccggtgggccactcccgaccggtggttatccagacatgtcatgctagtgtgctaccgctgctacatgcacgaacagtgctgatatgagcccttaagctaaaatatgaaatgcagatgtctcccaatctatatccattgataataataacagcagatgcttagcagattcaaaatcaaacaacatttatgtgttggaaggaatgcgacatgcgaaataggggttaatgtcacatttgcaggttaaaggaagaacagcttgtaaagtgcaaaatatctttcttcccaagagcactaacggtgccttcaatatccatcacacaacggccgtcgaaanaaaaagggctctc

SEQ ID NO: 74908 - DNA, 13567 bp, Oryza sativa
ccggtcgtcgtcgtcgtccgcccgcgcgtgctggctctgcagcccccgccgcagtagtgggaccgcgcgtgctgggtcggggaagcccgcgcaggcctgtcacgccgccacgatcccacgagccacccacaacgtaacacgagccgatcgagtcccgcgttttcactcggcctacatgggctgacgctgcggcctgcttcggctttgggcatcccgcggcccatcttctgcgagccccccgggaacgtgcggcccgcgtgataatcccgtggatatgggtccacgggttttcctctcctcttcccatcgcatccgcatctcggcatctcgcgtcgcgacccgcgacccgcggcggcgcgtcccgaatggcggccgatcgcccgctcgcgagggttgatgagatagcaaggcgccatttccaaatatttcgatccgcagcgtaatctctctcgcgtgcgccggtgcgcgatcccctccctccctcctcctcaatcccccagatcgcgtgcgccgcgggctctccccgcgttgactctccagcatctagatccgcgcctgcgctcccgacgaggtcggccggtctacggtcaccctcgtggtttccattgacttgtttttctcttctttttctttttttcccctcttctccccaacctcgcaacaaaatcggcggctatcctcgtgtttcttcttcgctccgtggccgcagaatccccccaccgctgttcttgcggcgccggtgttcgtttgaaaggtgaggactcgatctgcttgccgtttctccttctgggcaggggcaggtaggcatggaatgcgatcttgggtggtccatggagggattgatggattgatagttacatggagtttattggtgtacttagattggtgggggatcaattatttcttgagttctggttgtgcacgaaacctctatttaaatcgaagttttcctattcatggtgatggggttgctcctacctaacaaatcgatactccttgctctgcttattctcgctttttatttaatgggcagcatgtatttcatgacgcatccgtcggcggcgacgaactaattttcagttctttatgttattcagcagttggctgcgctgtcctgggaggcctcagcagcagcagcagcgagctttgctcttgtgagcgcttcgtgtgcttgcagctgcgttttattattgcgtcttggagctgtcacgacgtggttgttgagaggaatctatcatcccttcacagttgcgaggaaagcttcctgtggtatgtgttgtgctttgttttcttgtgggcaactggcagattgcaatggcattattaggaccttgtccaccttgacttagacaaactgcgaattaggtggtgtgacatgtgttgatattttcttttccaatcctctgatgcttacaacccggttgtgcttgtgacgtgcccctacctttgtttgacttcaatgtgtagtataacatggttgtcctgggcaagctcattacgtattccccatgagctatttagttgattgggcgatgtggtagttgcatactagtcgtcctttcttcccttgtcacctttggcggcctcggcttgcttaaaaggatacatatgcttttgtaactagaacatttgttgttgaatttggattatttgatcccatggcgaattctcgggctagccgtttcaaggtatttctttatcttgccttggattcctcagttgtgatctttctttggttgtcatcagtttgatgtgttcttactcctttcttgaagtatttctgttcttgctgttcagttctgtgattttgtctgaaaactttatctttgtgcttatcatctgcctgctgtttaatttaatccttgaccttcttgagtcctttcaatgcttgtactgagttttttgttaatataccgtagaaaaacatatggaagcttagagatcaatgttgagcgagttatttttatgaatcatgcttttcttgtgtgtctgtaaagttgaaacagggacatcttttttgctaaatatagcttaaagagggatggtatgacatgtgactagagttccatgatttctttttctgtatcttctcagtgttgtaaactcatattagaatgaacatcatttgacgagcacactttgttctgtgtggtaaattagcatcttacatctcacatattgtggatcaggccatataacttatttattttttgcaatatgtatgaattgaaagtgcttttttttttcttcttgcatacttgattctagctaatctagagagtttgatcactcagtattggatatgtctacagctatatttagctggtgttcagagcactattatgttgatgtacattttagctttctgctaacaatttttgtactatttctagtccaaagtagagatctttttaataagccaagtctatataactgtgtgagtggagctaaaatgatgagtatggtgtagtatgaagctttgattgggatgtgaaaatccatgggtggaatcaggtgcatggggtctatcaagaaattagataattattgttagtaaacattttttaagtgttcctctgctttgtccagtaccatggtatattgtcacattgctattaactctaagagcaagataagggctaaagatcaaataggttccagcaatgccaaatatttcaccatgttacaaacaccaagatcgattaaagtttctaagtattttggtttgttccatttgttttttggcagcttcagtatggtttttgtgaggtaactttttattgaatttttttctttacattgccagatgtctaatctatcagagccctcaaaagaagctgcatcagctgatgattcaagtgctgtccagaaaactggagcatggagtaacacgttgaacattcttctgcaacaagcttcagtctatggtgtggctgctggttattgcctgtcagcatccctgctctccattatcaacaaatgggcagtcatgaaatttccataccctggagcattgacagctttacagtacttcactagtgttgttggagttctcttatgtggacaactaaagcttattgagcatgatggccttaatttgaggaccatgtggaagttcttgcctgctgcggtgatgttctacatctccatcttcacaaacagtgaacttctactccatgccaatgtggacactttcatcgtgtttcgctcagctgtgccaatttttgtggccattggagagaccctttatcttcaccaaccatggccatcactcaagacatggctttcactttcaactatacttggtggaagtgtgatctatgttttcacagacaaccagttcactgtgactgcttacacctgggcagtggcatatcttgcaagcatgtccattgactttgtctacatcaagcacgttgtcatgaccattggcctgaacacatggggccttgtgctttacaacaatctggaggctttgatgctcttccctcttgagatgcttctaatgggggagcttaatcagatgaagggcgacagcgctaaagtgacaaactggctttcatctgatgtcattcttcctgttgctctgtcttgcttgttcgggctatctatatccttcttcgggttctcctgcagacgggctatctcggcaactggatttaccgtgctcggtatagtgaacaagctcctgactgttgtgattaatctccttatctgggacaagcatgcctcctttgtgggaacaattgggctcttgatctgcatgtccggtggtgttctctaccagcaatccaccacaaaaccaaaggcccccaaggctgagccaaaagaggagaatgatgaggagcagcagaaattgctggagatgcagcaagggctcgaaagtagctcaactcagaagcaagcgtcatcttaagcctggtaggaaatttggcgtcgatatcttactctcaacctcaagacggcttccctgtatcatattatgggatgctaaagaagaatcatttggccaaaggatgtttgttcgtcatgctagaatcctgtaatgctgttggcatgaaaaatctcagagaaaacttaatgtcactttaaaattctttgtttagtggtataccgtaattcatttgttagacctgtggtagggtatcaattatcaaagaatcctgaaacatactcgaacagaatactccgtatacaatatgctgtttcattgataatacagggtggttacccttttccatgcagtatatttgtttttgcttttcgttttgtgatgaaggaaaattatcttttgtactcaaattgcctgtatattatgtattctgtattgtgttgaaggcttgaagcaggttttgtcctgagttactccttatctgtgcacttccaggtcctggctggcgatctaattttagcccttcgacactgaaaatgatctcctgtttattttttttggattcagggattcagattcaagtgaactcggacttagcgtcgcgttcactgcctttgatgggccgtaatacgcatcgcgtaggacgggcctattcattgggcctgcaacttgctctgttgtcacttcgccacggtgttcttctccacatcatcctctataaaatccacgtcgattatggatttgcagtagggatgaaaacggctagagaaaaatgattatgaacattgttcggagcggataattctcagataatccagatacaaatacgatatacggtgaaacataccttatttctctttaattctagactttcaacctacctctttatattttctgttttaatagtagcccatctcatgacactatcctgcaccaataatattatttaaactttcaaatgtttttataaattatactatagtttatatattataatattagttagacatgtgtttataccaacgctgttgtacatgttaaacttaattagcattgtttagtttatgatcagacttaggcgggagttcccaattccctaccctcgttttccgcacgcacgcttttcaaactactaaacggtgcgtcttttgtaaaagtttctatacgaaagttacttaaaaaaatcatattaatccatttttgaaaaaaaacagttaatacttaattaatcacgcgttaatgcgaacatcattttgtgtgctgggaaggaggaacccatcctcccaaatacagccttaatataaaacaagctaattatatgtgatgatacttatttctattaaaagttaagacggttttcgtgctctgaaaaatatttgtttatgtatttgtgccttagcatattcggttcttatttgtatttgaggtaattaatatttattttttgtattcgagctattcaaatttatttttttgtccgaccaaaaaaaacgaaaacaaatacattaggagtatcatctgtttgtatcagctttgttttcatcctagtatgttgtatgctgtttttttttcgatggtgagaacgatatgtgaatgtgattaccatcgattcataaattaatcgaggtagagaagaacacattttctcgcaactaaggataagactatcatatttttctcctgaaagaaaatattatctttttgaacttcgaaagaaaaaaaaaacgcagtacagtaccagtagtactgtatttttatctctctacctttattcctcccttcgtactttcgtagccagccagagaaaaatctggaccgtgcattcccttctccaacggcccagatctctcctcccacgcagattccacctccccgtttgttcgctccagtgcttcgcacaagcaagcgcacgcacgcacgcgcggctttctctctcctccccctctctctccccttcacctccgcacccaacaatggcgcagccagagaaggtctcgtaatccaaagcggcccgcctcgaatcccctcgcgcagccgccgccgccgctcgatccccgcggcgtcgcgcggggtcaccggaggagagccgcctaacaagcccctcgcgagccccctgggggtattctgctccagccggaaggaatccgcggtggaaggccgccttcgaactcgcggagaggtatatctatatctcggagcctcgatcctcctgttgagtggtggctcccatttatgtagcgcggtttctacgggtgtttcgatccttgttcgatttgatctagggttttggttaggggggtggggggtattggttggttaatcgcgttgttggtggtgtgagtttttattcatatattattcggttagtgtgatttttgtgcagcatatagtagcggactagcgggtgcttatgattggcagcgattttgcaggagattttacccgagggtttcgattccgagcttgggatgtacggtcagggagggaacttcaatccgcagtatcggcatgctgcgccaccgccgccgccgcagcaagctggggtaacgggtggcttccctcagcaaccactaccaccgccgccgccgcgaatggcacagtatccgcagccgccagcaatggcggcgccgccgcctggaccgtaccagcacaggatgccactggttcagaaccaggcctacccttttgcccagatgcatcagatgccaatgctacctcagcagaggggttacgcccagatgccaatgccagggccgccatcgcagccgccgcctccacaagctatgtatcaggcccatcctcagtatcccatgccagggtctctccctccaccgccgccacggccaccaagctttgctccagagaatgcgctgccaccatctagccccccgcctccatctcccccaccaccaccaccgtcttctccacctcctgtgcccccttcaccaaccgctgcccccacaactgggcagtcatggaattcagagccagaaagaaaagaaggtgccactgccacagatgttggtcatgatgtcaaaactgagaaggtgactaatcagctaattgtctctgatgactcggatatggatatggatggtaagcgaacctacccgtcttctgcctctcaactgtacactgttaatttgtcacaattctaaaaattagtcctgcatgctgctccactctgtatttgtagtcaaactttgtcttactttgtgcatttattggacatgcttcccatcttattcctacctgatataatgatcaccactgtttcttgcaaaaagactggtataatcctcctgtcatcagaaatattgttgaatctccatctgcaggacagtttatatgatgataaactattaatatttattttcccttttgtagctaaagcaccaaacactttacttctcaattgatatgataccttaactcctgtgttaatccactgctagatatttactttatcaagttaaatttcagctgacgaggactctccatcaagggaacatgtcagtccaatcaattcttcacttgcaactgctgaatgtactggaaatgttaacacgcgaaagcctgcgtgtgatgtttctaaccttgtcaaggacagtggtggtaaggctaaaactacaaatgtaactgatgaaggtaggagcacattccaactaattcaaggctatgcctcagatgacagtgaagatgaggatggtgcttgtgctgtcagcaaccttgtgccattgactgaaaataatgagcctgttcattcaattggtacaaatcctgatattggccatcaactccttactgaagctgctccttgcactgagagaagtttggaggatcgagagcatcaactcatgagtaagagcaatccagtgaaacatgattcagatgaacttggacatccagtcaaagaagatttaagtggcaatgattctgatagagggcaacagactagaagacatggcaggagccagtggaaacgaagccgtggccagtcacctcagggcaggaggagctgtagccctctgtcccaaaggtaccaaaccttgtaccttgccttcaacttaaattggtgcatcaatttatctccacaaattggaactctatttgttttagatttttatatgtcatccagtttgcacaagtgaccccctatgggagtctaagaatcttaaatttctttcagtttatcatctggaaggcaaagcaattctccacttgctaagcgggctaatctactcgagagcaaatcaccagatggagtgggtcagactttcagggcacaacctggcgtcaagcttggtataagcaaggatggattctacaacgacaaacatgattcccctgtaaaagttgccactccttttgatattcatcctgctggagggcacatttcaggagatagaatatctgagcaagatggcctgatgggaacaaagaagtttaatggttctccagatgatatagattgtaacgagaaaacgaatgatgcatctgttggttcctttggaccacatggtcatggtgcagttttaacttgtggaccttctcaatcagttgcttcttctgcaaatggttctgatcctcataagatgcaaaggtcaggccgtgcatcaatacctcaatcagacatggataaatcatctctgggtgctcatcaaagtctttcgagtcaacctccaggaatctcatttgcaacagtacatgctactgagaagaatatgatgtgtgatgtgctccaacctcattctcagaatttatgtcctcctggacagatgccatctggtttgagaccagctcatataccatcctcaaatataaccccactcccagggcaacagttactttcgactccagaatttcctcagatgcacttccagcctaatgttatggcaccagctaatgagtttctgcagagtcagatgcaaacctatcctgcaccagatctgcctcatcctaggccattggatttccatcctcatactctccagccagttgtccctcctcatcagcagcctgctgccatggttcactcctctttccaaagattcacaccaaatctaccaggaagtactgaatttggtgctatatctgatactgatctgcctaaatcatctatcaagccccactacaacccttttgcgtctacctttgaacaaacagatccgactctaaatattggctgtgatgttatcccaaatccagttgagtctgcttcaacaaaagcagcagaacacgcgaatgcactgtcaccttttggtctgtcggttcctggatctggaactcatgtgcgtgagaattctgcggaagttgtttccagtcggcaaaagcagcctcatcgtgaattcacttctagtgctccctatgatccactgctcgacagtattgaaccctcaagcagttcaatcaacaaaatggatcttggtcgagaggcaaatctgagtgctagcaatcataatgcatctaaaattgtgaacatagaagtggagagtaaaaatatgcatggcctggggcttgttgctgaatcggaagttgaagaatttggagaggtggcagcagatactgaagcaggtgttgtggataatttaagtcctgagcccttgggtgcaaaagactggagctcagatatgcccggtgatattgacaatgatgaatcggtggataaaaataagaggactaaggattccagatcaatgaagctatttaaggttgctattgcagattttgttaaagaagttcttaagccatcatggaggcagggaaacataagtagagaggctttcaaaaccattgtcaagaaaacagttgataaggtttctagttctgtccctaacaatcatattccaaaaacgccagccaagatcaagcagtatgtccagtcctctcaaaagaaagtgaccaaacttgtaatggtatgtccacgattcttctgtagcaatattgattacttagtttgatattctgcaaatactcttctgaccatatgttgtagttctctataatggattgtgtttagtaactgatttttttatgcgtgatatgttaagtatctaaacagtaaacacaaattttggagaaaaaacaattgcgtgatagtagggaacaaaagttgtgtgttctagtcaactttgtgctattcagttctttgatgttgtgttttgattggagatgtcctggtatctttgtgcaaggagtcttccagccacttggtaattggtttgtgagtttcagtgtcatgttgtaatatacactattaattgaataaaccaggtttatttagctattgaataaatttgaaagcacaagtactttcaagattgaaacattctgattctggtgtatgattttttttagtatatgcatataactctacagttgaaggatcccctgagccaatcctctgagccaatctgtttcttttattcagggctatgttgacaaatatgtgaagctatagttggatcagtaaatgggactatgaactggagcaatcaggacagtgtccttttcctgttgcagaaatcgtgatgggactatggactatgaacagctcacacgaatctgagctatgctatggtattttggatcatcaatttgcagtctttcagcagtaagggattccgggtaatagttctgcagaaatggatgtatttatcagaaaatcacgagtttacattggaacaattgctgcctagtcttcatagccttgtaagatgtatctttgctccactgtttctttttttcttttcttttgagtagtttgctctactatttcaccatcattaggcaagtgatagtagaacgttctttaatactgactgcatgaacgcattgctgaaaagaattatatttcttcaaggtaaatgtaaatgatttaatcttattgctacttcaatagttcaatgaacgtgttcatgtctgatttagccaaagatctccctaagaccctaccgcctttgctggatgctagtttgaccatttgaacaatataaagcgacttaaactgcagttggctcaatctttctaatgtattgttatatttacatgttacaagtaatgaacacacaccaatttgacaaatatttctcatgttgagctacgtatgttaccatcgtgaaggggatcgcattgcaagattctagagcgtggtgttgggcagaggcagagaggaggaataagttcacttaacgactgagtttagatcacgtactaaaccgcaatataagggcagtagcaatcatggtttcccaaaccgccgggttaccgtgcctcggtggtaagcacggtaaccgttgcaaaccgtacgaaaccgtgtaaaatttatcaaaattattttttaaaaaaaatatttatggaggttaccgcggttgtctttttaccgtacccccgcggtaagcgcggttaccacggttaccggcggttctgcaaaccctggtagtacccatttgaggaacctaaaaatgccataggttctgcaaaccctggtagtacccatttgaggaacctaaaaatgccatataggctataggtaccgtgtccaaattttggttccccacagtgcaaatggtctcatgggtgacttcaattttttgtttcagcccctactacttttgatttcaaccctcatgtttttttctcaatttacaaagaagtaaaaattttacagtgaacatcttacagtggagaaaataatacaaatcacaaccccacccaggtacccaccaccactaggtccacaaccctctccactttccctacccactcggcgagttcaccggcgacaccgccgcctcccgcctcttcccacctcggcgacgaactctgctgctgccagcctttccccactccccataccttggcaacgaactccgccatcggcggcctcttccactggagcagcgtgggagctcggcctccaccggagctcgagcggatcccacctggagctcgatggtgctacccgaatctcgcccggcgcggggtggcgttgccggacatggagctcggcctccaccagagctcgagcatatccgacctagagctcgacggcgccgcctagatctagcccggtgcggggtggcaccgccggacatgaagctcggtggcggatcgggcgacggattggtctctcttatcctctgttgccggctcctgtcctcctcaacgtcacaccaccatcctctcccctctcacctctccgggcgccggatgctcaagctcactgcccctccccaactctgcagatcggggggtgtggagctgtggaggggctcaacggtgataactgcggggtggggaacatggagcgttgatccagtctactatctctccccctctcctacgcgttctctgacgaggccgagtgttcttcagtaggacgcaatgggtgagctagagaaacggggccccaccatctctttcctccaagtaagctattcaccgacgtggcgcgatgaggtaactcgccacgtccctgcactgtgaagggcctaagatgtttaacttgcaaaatcggagtgcacgaggtcttcagatagtattgaggtcggttttagatgatatggcacttacattcaggaaaaaggaataaaatacgatggtggaacttacatgtcagacaaaaaaaaaactacccttctcttccccctctcccactaacacgtcctgacagtgtgctcctgtccctctatctccttccgctgccccaccacttagccacctgtggcgacaaacagagagagctcgcgcatgcaaggaagtatcatcgtcttcgcccatcatgttggtatccgcaacattcgttggagcaggggggaccagcctcgttccttgtcatgctcgctgtcgtgttggctgtagtgtgtgtgtgggcggcgtcggggataggcaggaggacgacaggcagtgcttcgtcacaatcaacacgctcaccatggccatcgtgttgtacctcctcgttggcgacctcatcggtgtcggcgttgtcaataatggcagggttgtctcgaacaccttcgtgggcatgctcctagtactagtgctctctctctctctctctctctctctctctctctctctctcttcgtcgatgttgtaggaggctcaccgaggggcaggacaagctgtcctccccggcgtccctccccctccctgcgctcaaagcctccgttgaaatccaccgccgccgcagaaccccttttaccccaaactggtcatgtggcggctgccgcgtgtttggacgaaggtgccatccacatcattgtggtggaaacaaaggaaaattcgatccaagaggttggggagtgggggggtggggagagagagagagagagagcatgggtttggggatggaattttcgagcttagctctcctcccgtcaatcgctgtccttctccctgctagccaccatcctaccttggagtccatagaaatgggaatagaggggaggaagtgagagataagggcccctaacatgtagggcccatgctgattcagcgttgttgatttcgatcaattagccacgtcggacaaaaccagccgctatattatcatgggacctcctttacattggttggttttgtaagttaaggaagatgttatatctggtattgcagtttaagaacaaaatttgaactaggtgtcaagataaggacctaaagtgaactaagggg

SEQ ID NO: 74909 - DNA, 9256 bp, Oryza sativa
attccgcttgctcaaatgccagcccaatttaaattctaaatgtggctcccaagaatggtggattatgcgattttccaccgaacatgcctaaagcacaatgaattgctcacggtttgcttgtgttcaggggaacataaccttttcaacataacgaaaatcagtaagattttcctccatccatgtccagcatatatgaggaaaagaatatgaaaatacccgctgagtaacaatctaaatcacactgggaaaagaactacaatgacaccctactggtatgaaacttttgatccgcttgtgctttttccgtgatcaatgcatcaagctccaggcctcaacgtccagaggatttaaagagaaatgaaattacaggtcctgatcaatagggtgccagggaaacgttcaaggcaacatgttttcatcacccagaaaactacagccaccacagccagatcatctctcttttcgcaccgcacccttggtgaccaaggccatatagcaaaaggaaggttggataagttatgcagctacaagatcaggcgtctctgcctcaacggacaacagggtggtatgcacttttccaacccaggcgtccaaccgctcgcgcaacgccttcacctgtggaattccaagtactctaggctggacccatgacacgtgaactgtgctgtccacctcatcaattatcccctctataagatgaacctgcaaaatgggggaatcattaataattctctcatattccaatttacttttaaattgtatggcaattgatggcctcatggaaatacagcacccaggctccattagcaactaaatagaaaacatcagcatggagcttttgtaagaagctgatagcagtggcattctatcttggctacctatatattctgcctttcaggggcagcattattatatactataatgtactaactgatgtagaaaagaactgtaatggaagaaaaagatgagaacatcaactaggaatactagttgatacattgtgcaaacactgaagccgtataaggtaaaagcaatagtagcatgtaacaaggagagacacaggtttgctgtgatcaacaaacacaaatatatgaatcacatgtctagtttaactgacaacgcacacccataactcacaactaaagattcacaaaacaaaccatcagcaattaaaaaaaaagacaagttcacaaaggggaggaattgaaggcagtaattatcaaataatcactatccatatacagctgccacattaaaatgacagaagcattagaagcattctaatgtctaatcttaaaaaacaatttatgcacaacaaaactagatgtttatgaatggcattcatgcattgtctatcccaacaatgaattaacatgatattggcatattgcaaataatatcttatgaaagatcgaatgtaagaaatgcaattaccgagaggctcttcataagaagatattccacatcactgatagaaagcttagtgcgctcggctataacacttaatgggatagttctgtcttctgacgcccggctacaacatgaaaaagaacacagggcttagaaggaataaaggaaaaggggcaagacatttgtggtggcatagaaaagcaagtagcaaagttgtacctaaagattatctccatcagacatagaatgttgatcttctctagcagtttccgttcattctgcaccaaagctggctgagcactgagagcagcattgtggaccctacatagttcttggtagagagctaggttgccggtgttgaatgcttgtaacatatgatagacccactccaccttggttccaataagactgttgatctaaggatataaaaatataaacaacttcagacagagatgtaccaaatgacaaccatatatgccgatatatagatttaggggccattcaatatttcaatcccataaaggctaccttgtgtctggaatttttttgtttggtatccacaagtcaatattgatttttccatgcacaaaaaagatggtttgccattaattcatgcaaacttaagtttatgctatttcaattcaagaaaatacgaagtttacataattataatatagtggttcacaattacatcattcaacattcagcaaaaaaggatcaggcataggatatttcatcattttgatatgctttacacaatcggtagcattttattgtgtcaatgttaactgcatacattcaactcatgaaatttctgctaccgatttggcaatagatgtaagttactgtgtacaaaactccgaaacttaactaccataacatacacaggtaccttggacgccttgcagttctagcaagcatcagataaaaacaactaataaataattatcagaactggcagttgtgagtaccaagaaaagccacatgtaatgtttatataggcaagcagagttaattttaatcaagcaatcaagaaacacaaaaaagtatggataaaacaaaggtggtactactaactagtggcaacaaaagaaatcatgcgtaagcaaagtccaacttacaatcgggtgagctaacaattccccaaagttgtagatgttatcaccaagcaaggctgcaagggagagatcaaatgccaaatcctgacacaagacagcatcaaagggtaaacatagatgcaagatacattattaaaataatgcgaggaggaaatgattttttgtcatgtaattgcattgttaacaatagaacataccagtttgaaagactcagagagtgactctacagtagtgtaagccagatacagaagggcattcttgtagaactcagcaaattcttggcgagccttatggtactgagatgatatccagtagaggctagcatgaactgtgggatcaacatcagtcatgctatctagagtagattttccttcgtccaaaagtttcttgcactccttctgatttcccttctccaggttaatcgcagcgatttgcatcttgacgtagagaatgggttcattgatgcgcaggtcctttgtctcgcgcaattttgtgattaccccctcgaggaaacttatagcagcatccttgtcggggtactggcgcgaagcgatgaccgcgaaatgcgcaagtttgagaagattgatcttcgtctcgaaatcagtgatgaaattgttgtagagctgtatgagggtgtcacccgtctgtaggagaatggatgccgctgttagaattgcaaaaacgcagaaggcacaacacagcagttacaaacctaagcaaggttcaaacaacaagagtaaatttcactttgggcatctttatcaaccaatatttcacaacagagtaatggactagggttaaggcttatcctttcacataacatcacatataattaaaatcttttgcgctttggaccacagcttattccctggtacctcaatttccaggtagtgaaatctgatctttaaatatttcatatgcaagtaatgaaacccaaatatttatcttcgaatgttcatatgtacttttcaaggttgaaacatgaggtttaaatctccacaaagtggcggcctgtttgcggccggatcggtatcgaatttagggcccatccagtccaactagggttcaaatcgaactaggcacggtgggtagggtttgcggcgagatccgtacgggggggacagcagctaacctaaccaagaacaagaaggcgcttgcaagagagggtgaggggaggaggtggtgggaaacctgcgcggcagggagctggaggaagtggtcgagcttgagggtgagctggtgccagagcttccgctggtagaggtcggcgaggtcggcgtacgggtcggcgagctccggccgcgcctcgcgctgcgactcgacgaactgcagcgccatggagaaaaatccccccacccaggagttggtcgctcgctagggtttggggaggagaggagaggaggcgagagggggatctgcaggcgcggcgagcggaggcgaacaacaaagagcaatctcttctctttccttctttcttgtaagaggaggaaagagtaggagacggagacggagacggagagagagagatactttgcgtgggctgggctgattggtgctgctgctgccggcccgcacgaggtcgggcctagtgggcctagtgggccttataggccgaatagtttgttaagtctgtttttattgagtgatcttttttaagatcatgtttattaggttcgcaacttgtatttaaaggttgttttgggaatttctacttggtaatttcaacttatatttgaaaattttcaattcaaattttttaaaaaaaatcaaatccacccaaaatttgaaaacttcgtatattaccatcgtgacaaagtgaatctcaatgctccctgccatgttgtttgaagtgatcttacgctgaatttctttttcattttcccaacctatctcacttgtttttcacgccaagtttttcaaactactaaacaatatgtttttttaaaaaaaatctatacgaaagttactttaaaaatcatattaatttatttttcaagttttttagattaatacttaattaatcatgcactaatgtgtaatatcgtttttcatgtagagaggcaggggcggagctagaacgaaatggaggagggttcctcttgcttaatttactctaatttagatcaagttttaagctgatatgtgtatgcctaagtttgtattaaggagggtgcacacatggtgaaaatcggtgagttataactaaaaatttttttttgaccggattcttgggcaccccttccatactctacctccgccccatcagggaggtggagttaacacagtcttaaggtggagcccaagtggcgtgcagaagtttctctagatttgcaagtgtttgggaaatgcacatatgtgggctctacattttcctaaaagtaaagaaaaatagaattccaaaacaacctgtgagtgctgctcacatagggtgtaggagaaacgagaaagggatcgtattcttttaaatggagtattgcttgaagcttggcataaaactcgagtttggcttaaagctaaggccaatctaatggggtcagggttgcagttgtggttacgtacctcgctatgggtttttgactttatgccattctcccggatacgtattctcaaataccatcattataatatacttaaattatttgtcatctgtactcactagattctttctattttgtcacttttaactaccaactcagcaacttgagatgagaatgactttattgcaccatctcttccttctttcgttcatctctactttgtgtatgaacttgtcttctctctccattcgtccctctccagcatgccgaagagtctatcaacattagcgttggcgccatccatgacacctcgatgaggaagttaagtaggccccaggtggcagagctacttgagagcatagtattcatcgtctagattgacatgctggcggaagttgttgcggcgacagtcccttttccttggcatcgtcggcagtcgatgaagaaggggaaggggtagagctgcgacgaggtccttgtcaaccctgcagtcaccatccccaacaaggtgtggctcaggttgattccttgatcgacgatcactgctcggggatccaacctagatctaagcgaccgtccctcacaactccacatagggaaaaagtgacgacgtcgatagcgcaggggaagagcagagagaaagggacaactggtgcttgtaggcggaaagcttgtccgcgtgcatgaccttgtcgaagctggagcaactcgttgaccaaagggagtggagtttgaaagggtgggagagagcagataagggataattagatcttttgttacacggttggctgagctagcaagaaaaatggcaaaatagcaacaatctagtgggtccgatggcaaataaataaagttgtttggtaagatggtattggagaatatgtcgctgagaaatatggcaaatagtccaagatccccctagctacttccttctccttcgtgcgtgttttagcgtgtaactgcttcgtgctggctttttctttctataaacgtttgatgaattctgaaacagctggaagagcaagtttgctggcaaggtagtatagggatattccacccgggctagagcatcgcattcgcatatatcggcgctagacgccttcaccatcgtagcgtgacaccagcaaattccgcagccagcagccagcagccagcagatccgcagaagtccccaatccgtccaagctccaacaacgctggggagtgtggccccgcctggcccccaccagctccaccaaccgaggcacacgctgcggctgcgcgagcagggcccaggtgacggccgcccgcacgcacacgacacgacaccaacgacgcgacgcttcccctttccccccctcatccgccgtttgcctccaccccccacccactccaccgtccccgctctccccccattgccgccgccgcctgcgacggccgcgagctcatcccgagacgacgtctctagctagcatcgagcgttctttctctcctcgggctctcgttggtaagccctcgattccggtttcctcctgcttctcctccaacctgcccctcggattagtcgccagtttgttcctcgttagttcttgcagtaattatagtgctaagctccggttgtccgtcggcaatacgccggtagtccatgcaccagtctcgttttcatgggttttgttgtttgcagcaggcatacccctgtttcgctagctcaatcaatcatttcattgctactattttttttgttttactttgtatttaacgagtacttgcatctatgaaacaaacttcacacaaatttgatgctcatcaggttcttagttccaccttcttttgtgttttttttgttcagttgagataaggcaaatcaagagagcaaaattttggtggtacatgtggtgattctatgtcgacaaggcgtcatcttgcagtatttaccactgcaagcctcccatggatgacaggaacggccatcaacccgttgttccgggcggcctatcttgcaaaggatggggatagggaggtcaccttggtaatcccctggctttctctgagggaccaagaattggtttacccgaataagattgtgttcggttcgcctttggagcatgaggcctatgttcgtcgctggattgaggagaggatcagtttcagaccttccttcagcatcaaattctaccctgcgaaggtacattgatatattaacgcaaagagttcattaaccatttaaccctggaattctctattctttgtgagattttcttttaggtggttctgtacttgatatatcaagttctctatactttgtgggattttcttttaggtacattgatttatcaagttctctacaatactattgtcttctattttacttggaaaataaaatcgagtcaaattggttaaatatttaccgttgattgaacctgattaccttaccatggagttatggttaacctgggtcagttttgtcagaaactcaaccccctttcaggtttcagctaactttaaaaaaatgcagctcaatacagatgatgtggtgcatataccatttttatttgcactgttagcttccatctagtaatactcatatttatatcttttttttgctttagggattttcaagacaattaatacccttttttctttatgatgcagttctctaaagaactgagaagtattctacctgttggagatatcacagaatgtattccagatgaagtggctgatgttgctgttctggaagaacctgaacatctcaattggtaccaccatgggcgcaaatggaaaaataagttcaggcgagtgataggtgtggttcacacaaattatatagcatatgtgaaaagagaaaagaatggacaagcgattgcctgtttcatgaagtacatgaacacctgggttacccggatttattgccacaaggtaacatcaacgccatatataacaacagtgaagatcccaagaattatggtgattaatctgaggatgcattttgcccatttaatttatgttccaattttacatggcgtcttgatggaaatgaaaaatacaagagacatgtcttttcagatttttctgtctgaatgcatctggttgttttggcttatgctctattacatatttattgaatttgaagaaccccaaactcccataatcatcatgtccttattaaagcatgcaatactgacttttgttgattttagaacagattatcagattgtcaggtgccacccaagatcttcccagatctgttgtgtgcaatgtccatggcgtgaatccaaaatttcttgaggtaggtaaactaaagttgaagcagctgcggaatggggaaatagccttcacaaaaggggcatactatattgggaagatggtgtggagtaaaggatacagggaacttcttgacctgctgtccaaatatcagagcaagttggtgggtttggaagtagatttatatggtagcggagaagattccgacgaagttcgaaaatctgcagaacttctgagtttggccgtgaaggttcacccaggacgtgatcatgcagatcccctgttccatgagtgagttctcttattgttcaaaaacttccttccgtcttcttaattatttgaatgaacatgagcgtacaactagacaagtttaaccagctacttttttcattgttgttcaaaaatgagtttgagggttacatatcattataattcattgcaacaatgcaaggttactgaactaaacaaaacgttgaacacaggctacataatgaggtaagacaagaaactgagagtgctaaatcacctaggaatgcaatataactcataatatattttgtcatctatattacattcagcatatggcaatggtttgtgtggatactgaaacacttcaatttcccaacagctataaagtattcatcaaccctagcacaacagatgtggtctgtacaacaactgccgaggcccttgcaatgggaaagattgtcatatgtgccaatcacccttcaaacgagttcttcaagcagttccctaattgccgcacctatgacagtggcgaggaatttgtacaactaacgctggatgctctagcagagcagcctgctccactgactgacatgcagagtcatgacctatcttgggaggccgcgaccgagagattcatggaagccgcggagctgaaccttcctatctcagcagagccaagaatccatcaaacatccaagg

SEQ ID NO: 74910 - DNA, 3302 bp, Oryza sativa
attctgcccatcagtgtcttcttaatgtaacagtacttctgtacttatcatcctacattgtgcgctggcaaatgcttctgaagttgaatttccacggaacagtattataaactagtgctagatctttcaccaatctttattaattttctactacaaggttgcaatttgcttaagaatagtaacgtgcaagttagtagtactccatactatagtatgcaatcattaattgccttgcaagttgcagcatggttcccacacactcgtttgcacttgcagaaaagtttgcaagttgactcagccagcacaaacttgttagctgctgcttaaggctttctctggattgaaggaattttacagaaattttgatcaattcatgtaaaatttctgcgtgtggtacaaaggagtagggaaagatgcaaccgtcgcatggtacgaagcagctgctaacaaggcaactgcaccgcagatcgtacagcggtcagttagcctttattagcacctactccatcagtccaaaaaagacaaatcataagtttccgtatctaacgtttgactgtccgtcttatatgaaattttttataattagtatttttattgttgttagatgataaaacattattaatattttatacgtgacttgtctttttatttttttttatattttttttaaataagatggacggtcaaacgttggatacagaaatccaaggcttgtcttttttttaacggagtgtgtagctattgatttcgtccaaaacaacatcattagctggtgctagtgtggagattatggcgagctgtcaccaccagaatgactctgtagcgaaacaggatgcatgccatgccagggcaagttctgcatggtgcacaactatgcatgtacgtgcacggcactatcagtggatcgactagtaaatgatagtactatgcccgtaatataagcaaagtttatatatacgcagaagaatgctattggaacaagacaacacagcacattcaacttgagaacaatataggtgatgtttgaaaagcagggactaaactcacaaaaacataaattcctatgagagggactaatccctccttcccaaacaccaccgtaacatcattatttgcttgtactatgctactgattagtttggctctgatttgaacctgatgtttgtcgatttaaatgtgtggacgtgtcaatctaaattttcgaactctcaatttatcttaggtgtcatgcagatccaaatagactccaatctactcgtgctaatattcatatcacgataacacctatgtatcaatgggactcatatgttagtcacatagaagaaaataaagatatctcatctctctatcgctaatctattgtaggcgtctctctagcgaaaatatgtttttaattttattttttatatgactaacatatgggtctcactgacacgtatacgtcaccatggcatgtcacgtcagcctacgaagcgggttggtgcctgtttagacttatatgacacccatcacaagtttaaggacttgaaaatgcattttgatagtttggggatgaggatgaccgtacctgcacaaatttagaaaccacccgtacactgcgctctttggattttaagttgtttggatttcccttctaaacacataattgttgtatggattcccatgcattagagttagtatctcacaactgattattttatgtacaaaaattgaatatgactataattatatccaacaaggctaattcgcgaacgcattatgaccacattatgacaagcagctggattagggtttggggttaggtagagggggaagcagggatattccctaagcttagaggagtggccggggaggcggtgtgtggtaggcaaggatgggcatcaaggcggtgggggcaaagcaaacatgagtgaggggaagggggaaggagagcgggaggcagacaggcagtcatccaagtgtgcctcgccgacatgttgacgcgcctttcaacggtggcaaggccgagtggcgccaacggaaggtggtggaggtagggcactgcattgcgagtaggtcgagcttgatggcatcgttgggagatcgtcaaagtaaagtagtagcagcactacgttatcaaagaggtcgttgtctactccttccctctcaccgtctcttcgtacagatgtattagatgaggatgagaggatgaggtggagggaaagataggccttgagctgacatcacacgatgatggctgcacgtggacctcgtcgtcgtttttcattcacgtattgctagacactcgaacgtgtgcgcattagacccatccaattatatttgcaactggaaaagcacatttgagtactagaataaatggttttgggccttcttttaaacacaataactttatggtattttcatgcatcagaatatcaataaaattcctcggttaaaaagtctcgcttaacacaccccaaaattcaacaattaaggctatgttttttttatgtaagttgagaactacacatgtaaaacagagtagcggataaacgcatgattcattaagcattaaaaacttaaaatatattaatataaatttgtagagcaactttcttataatatttttttaaaaaaacacatcgtctcatagtttggggagtgtgagaagtgatacaaattggaaaaggagagaaaataacaccgagtaccagtaggctgtagtggtttattttttaaaataacgagtagtcgagtatcaatactacttcctccgtcctattataagtgcagccataattttccgtgcgtaattttaaccgtccgttttatttaaaaaaatttgaaaaaaaaatgagaacataagtcacgtataaaatattattcatgttttaacatcttataacaataaaaatactcattataaaaaataaataaaacagacgatcaaaattagacacggggaaattatagttgcatctataatgagatggagggagtggttcacttccttttcacggagcaatgagatcacctgatcggccttagccagtgtcgcgatcagaccgacgtggagacggcgaccgcggcgcccagtaaaaccgtttccggccgcccatttcttctccccccacgatcctgaccgtcggtccaatcacgccggagcccgcgcgggcagagagagcagagccaccgctttttttcccgcgccgagacagcgacgcgtcggccccgccgtatccgcctctcccgatcctcctgtccccctacccccaggtaggccccaccccgatttttcacattttggtctttttgaaaaactt

SEQ ID NO: 74911 - DNA, 1080 bp, Oryza sativa
cgccagagtggctggcgccgtcgttcaacaggacggcgccaacctctttggcgccgtccccctgccgacgtggcggggcgatgctgagatggttagggggagtgcgccagagtggctggcgccctccccccgaaattttttatttttgttttatttgtttgatattttttttcacgctttgggacacacaagaaccaaccatagaaaaattgaactcaaatggacgtaatatgtgacatgtagaatttttcctctcctctcctctctctccgaactagtgcagaggagagatgtgcaacttttttatttttattttatttttttgatatttttttcacacttaggaacccacaggaacaaaccatgtaaaaaataaactcaaacggacgaaatatgtggcatgtggaattttccaaagctctaccgaaaaacttctctcctcgaaaacacaatcttgcaagcggaatttggaggttttaatatcgccgaacccggcaaagctgaggagaattggatgtaactttttctgtagatgtccgtgcatatattatttgcctgattccgagtccgtatgagaaagttacgcctattttaatagatgacatattttgtccgtttgggtagagatttggaaaattctacgagtcacatattttgtccatttgagtttattttttatatggttggttactatattcttctaagtgtgaaaaaaatatcaaaaaaaatgaaataaaaataaaaaaattgcatctctatgtactgtttaacttatatatgttatttcatgtggttatattttgaattagattaagtaatttcatatagtggtagagtgcattatgtttaacatgctgatcaaagggttttactaaaggaattatggtctaattttagtgaaggtgcaaagtagactaaatggtatgctatctattttttcagacttagctaagtggttgttcgagtttaaattttttctgtggttggttgtatcgtgatcctgagtgtgaaaaaacattcgagaaaataaaataaaaatgacaccgttgcaactccatacagagaaacaggaatggaggc

SEQ ID NO: 74912 - DNA, 16328 bp, Oryza sativa
  unsure (1)..(16328): unsure at all n locations
cgccctccgccttgtacggtacggcccggcccgtggggcccacctcgtcgcagcggccggtgcgcggcggccctgtggcgagtcgacacgcggcggcgaggctccgcccctcctccatgtgggcaagttgggccgaccggccacttgccggtggggtgtgggcccccacgcgtgcgtggcgcgaacgtgtcgcggtcggcgcgccggcgcacacgtggcgggcgggagggggtagacggtgtacggtgtaccctcgggggaggcgcggagtggggcccacgtgtcggtgtggaggggtgggtgtggatcgggtgagaagaggtggaggggtagtacgtactacctgaaaaagggtgggggccactgtgcaagttgggtgacgcggggtgcacctgacgacgtagtagtagcaaggactgcaggaggtgggaggtggtggtcttttttctgatctcggctcggctcggctcccctctatttcaattttcaaggcacgtgtcggctacggcgatggtcggcttgagccgtgagcccgagctgcggtgtttgtcccgccgcggcctggtcggcttcggctctcggctcctcgcgaggtggcgcgcgagccgcgccacgcgtcgtcgatgggtcgacacgtgtcgcgcgccgcgtccgggggtgtttgccgttccgacgaaaccccacgccccaaaagcgaaagcgagccgaccccgaaaaggaggattttttttttccttcctctctctcttctcctcctcctcccttcccatctccgccgcggagaggcgcaggcgagggcgcgcgttccccgcaatggcggccacctagtccctcaaggaatcctcgtaagtcgcatcttcctctctctctctctctctctctctctctctctctctctctctctcgccgcggcgggcggcagcaatggcggattactcgctcggtcagttcttggctcaccaccgttggtgttcccctgtttcttggttcacgccaggcgcttcttcttcttcttctcggatgcgagagcttgctgtgattgctggctagctagcttgccggaatggagggcttctcgagggacttgctgtgcggcatcggcaagggaggagacgggccccgcggcgaggtgaggccgcgcgtggacatggaggctgaggaggtggagctcaacctcgggctgtcgctcggcggccggttcgggctggacaggagaggggagaagctcgccaggtcgtcgtcggtcgcggccatcttggcggcgccgacggagccgtcggcgccgccgtccgggctcttcaggacgagctcgctgccgaccgtggccgccgcggaggcggcgaaaaagcagggtgtggatgaattgaactgtcgccgcccgagcggcggcgcggaggcggagcccgcggcggcgaggctgccggcgagcgggagcccgtcatcgggctcgtcggacggcgaagggcgcaggcttgaaggtgcgtcatcgcttctctccatgggggcgtgtgctatctatctatctttagcttttatgatttcatacctaaccgatgttaattgcgattctttggtaatatatgctgctaattatgcaaattagacacgaattgtttgggtgaattcaaggtgaaatgcacattgggaaatgtgaaattgccctgccatatgtcatttacctgacgtcctggtggtaaataaagtttggattaagatgcttgggcgttggtctttggcaaagctaatgagatcttccatcactggtgcttcctcgttaacaccgaggactgtaatttcgatttacagcttaaattatccaacagtgaaattcgtctgttttacccctcttgaaaaaaaaaatttctgtttacaactgttgcttccatcatctaaaaatgtggttgctatcagtatatagtttttaggatcgtgctgctggcttggcaagtcagtttcaggatatctgttcttgtcaagtagccctttaagtcacatgacacgcgcaaaaagaatcttaatgggtattcttccttgttctgtaactttctaatttcacctgcagtagactttcttcagtactccttttataggaacgcctacaatctttttaacccaaagggtgaggatgggaattaagtaaatatggataactgctagaatggataactttgtagtgaactgaattcatagatcttattcaactaagcaatcagattcagcaagctttttttttttatccgtgaagattattaccacagttcagtgactagtggcaggacacgtggacgtggtgcagtgtttacagtgatgaacaaatgacgataagcactcgagattaaggaaaaatcatcttttatgtttctagattaaggaagactaattatgctttgcctttgctcaattcatagatactcttcctcacatgaaagaaacttannnnnnnnnnnnnnnnnnnnagcagaattagtttgagcctgggtagcatgcatggtagaaattgaagaagtctttcatacaactaagatctgaaatagtaattagatacagagtggttactggttaccaagtttcttctaatacatagtttctcttattacttaataatcgcactacttcaacagcagaaagaaacgtgtcctatgtgtggattcaagtgttaattggttgcatagcattttatttccaagggaggtgtgaacaccattttgttaacgtcaagaacatatttttgataatttgaaaattttaaaaatggtagttaaagtaaaatatatgaatttcaactctcaaatagaaactagctttttgggggaggcataatttttttatggtgaactaatcacacctcacttcttagtcaataatgattttgatccttgtaatgcaatctatgtatgtattcctctcattaatgacagcaagcaagagctttacatagacattgagttacgtctttggatggatgttggtaccctttgttagtggtagcctaacctaatgcggtgtttattttgaagcttccagaaataatacaagatgttctattagcatattagcaacaaaggacatcagcagatttgtttttgtgttactccgaataacaggtagcaaattcatggtggaaatgtacatggagctcgcaaacattggctaattatggagcaattcaagttgggttcagcgacggttgatgttaattacattttgtttcattatctaatatttaacaacaataatagcaggtgcaacagcacaatgtacatatgtaggtgttgaatcaaggttgatgctacctgggtagctaactaggctttagacgccaagcctcacaggcagctaatagcccgttagttgtgttgtatttttcaaattaccatataggtgtgatgatgtaagaatggagctttactcgcacattgtgcacactacattttaatgctgccatatatgatgagatgaaacaaaaataacattagaagacattcctaaattttccaattctagtgcgatttggtactagagtttgcatgttgcatgccctccccttccaacttgtcgctaacttctggttctgacattgcattagggctgtggacagtaagtaatctgaacctgcccagcatgagctcctagatgcatgtgaaattggtgagctgcaggataggcaactatctcctgcggtctgggaggattcagatattactttactactggtctggtttaagggaaaacataccatttttcctaagaaaagtgaattaggaaggattggtcgacaatagtaaagtccatagttggcgtcaatggatgtaatttcattgtcgcgcaaaagatgaagaccccttgactgtaacaacctagtggacttgcgttcaaaacagacgagttcgaaaggtcggtagagacagctcctatcaacggacaactgtgaaaaacaaaagatggtggaatgcagctattcatggaattggaccttactcttgcttatacaccaagtgaagtagtgctaggaatgtttctagaatctagaatcgtattagtaaagccttatgctcacattgcttttgaagtgtcttgttcttcccgttctaacctatcgtttagccagacatgccgatatattgttctgggcctattttgtcattgatgttgggccaattgtggtccgaactccaaacgccaaataaatttgatcggagggagtacattgcgtagctacgatattacatatttccaaaagaaaacaaaacatgcaaagggagtacgataagaatgttaccgaacaaatttagtttaacccatttctttcgggcagtttatctcatattctgaaacttacagttttctgtttaatttagaatatggcagattccggaacagtttaactaaccatgttttctctttcgtagtgaatatgacagacactctcatgagaacaagttcactccctgccggcatcgaggatgaatggaggaagcgaaaggaggctcagagtctgaagcgactcgaagtgaagaggaagagaattgagaggaggaactctctcacttccaacatttccaaagaggctgttgggcagatattagaggagatgaatgcaggagctgagaaagtagaaagttgcgatgatgttgctacaggcaataagaagacgggaggaaatgtgaaccatagcagtgatagaaaccgctgcactggacttcctccagtccaccgtgccacgtatactcaacaacgtggcagtctgtccggaataccaacaaagcatattccagctatgaaaggtaaaccgcttacgttttgtcgttttgcatttgttttgtcgttttgcattatagatacgtgaaaatattttcttgtcaatctagcttcaagcatgattgtttgatatgatattgcactattttgtagtttcatgttttgttctttatgcttgtcacaacttttgcccctccattatgttcatgtagatctctcatgtctgagggcttttagatgctcaatttatttatattgctctcatttgtgcgagtttcaagtcaaatgtcttgaatgtgaactgggcatggatggttggtgccagatactgttatgttgttagccgctgtgcgcaatgttttttttcctaaatggcagatcgactaaaataaattatgttgtaacaaatgcctaatttagtggcctggattgcatggccctgcctccggtcaaaggatggaaactacttccagacttgaaagtatggagggtccacacaaaacatgtatgacaaggatcaataggttatgttattagatgaaaatatcagcaattggtcatccttccttacttccttacttcctttcatgaggtttgcttatgtttctcattaaggcctgtttgtctgtccttccaggatctgctgatgccgaagagcacaacgttccatcggccgctactgagcaccgaaatggagcagccatagcaacaccgccattttcggcactggcggtgagggcagtagctcttgcttccaggggagagcagctgcgtgctacaggaagagttgcggcaagagccaagagcatgggagatgtggagaggatcatgatgcaggagatgccatgcgtgtgcaccaaggggctccccaatggcaagagggttgaaggcttcctgtacaagtacaggaaaggcgaggaggtgaggattgtctgtgtttgccatggcagcttcctgacccctgctgagtttgtgaagcacgccggaggtggagatgtcgcgaacccgcttcggcatatcgtcgtcaaccctatcccgccatccttatactgaacctctctgtcagctcactgctgctcttgcaagtgttactatagcttcagtcagcccttcaccttagcttcagaattcagttcagagtagaatctgattgtgagacttgtcttaatgttacaagtgtttattatgctaaggagacagcgggagatttgctcctgctgacataaaaagtggttaacatggctccattgatcattgttaaatggttcctgcagctgcttttgttcatgcaggttgtgacaaattcatcctagtgcaagttactctggcaacaaagatctcctggactcgtagtatgttcaagctactacttgcaaatttcccagccagtcagcagcatgacccatggagatgtcaaaatcctgataccgaataaccacggaaaccaccgacaaaaaccaatgaatttcagacagatctttaaaaaaaattgaaagtatgatcaacccaaatgctacaaagaatgattgtaaaacactagatacggctagtgcagacaaatgctacaaagtatgatcaacccaaaggagtgcacaacagagactaatctgtaagtgcaactgtgcaagcatctgtggaagtctggcatacatgggaacaatgtatataggaaattaacatcaaccagttactgattccaattatcaatttcacaatctgtccaggcaaccatcacatttgaagataaaacggctgtataacagcatcacattctggttgcctcaaaaacaagttaagcatgcatctacctataatacaaaaggctaatactagctagcacctaattgcagtggagaaaccataatttataaagctattacacctcaaaagctttcatggacaggcacttcaaaagcttcaccgaaacactgcatctaagctttcatggactcttcaagcttcaccgataattttgcatctagcaacctgtcagcttggctatctcctcgagcatgtacttggcttcagctgcgtggtctaccggagcttcactcctcacagtgatcctctgcctcttctcattcatgtactcattctgagttacgctgacgcggaacaggtgaggaacccaagtagcttccttcagcttgagaaggtaactgtcatcaccctcctgaaacaattgagaccaacaatcttaggcacagcttaaatagcaatcttaggcatgtagaaaactaaagcctagaatctgcacaaagttgaactgaagcctagaattcgcacaagcttgaactacagcctggaattcgcacaaagttaaactaaagcctagaatttacacgaaggtgaatcaaagttactgtgggattggcaaaattacctccttcctaatccgatcaagctcatctgcactgcagccaacaatcctctctgcctgatcattgaacagagaaagccaggcctcaccagtagggtcggagaccttgatgaccatgatgtacctgaagaaaggaaccagtgtagcattagctttggctttgtatcatctcaaattcaagcatgcacggtgtaattcagcccaaagttttacctcagtgagcactcagcatcattcttctggcacccttcacaccagtatcctgatccaattgcctcagtcaccttcttgttgcaggtcttgcaagctcggtaccacatggtttggtcaggcttgataaggctaatataggcattcagactgaagaacacaggctgcaaaacataacaagtaaatttaggacaatcacaactagaaagtgctaataaactaaacatcaagaacaattccattttctttcaaagattccaagattttaccttatcctgacccaagttggggtcacttgtgatgtgagacagaaaaactctatcactgtacatggatctcgcgccaccaacccttgatgcgcccatatctgaaccaattgatgccattgaagtacccttgccttcagagtcatacctgtttgccaaaataacgtcaaggaccaaagtagatagtttgaaagataataaaaggagtgtttgagattaggacaataccaagctctgagctgttctgcctcaggcaagtcaggattcactacaattgtacttctccccacagttgacagagacaaacctgtcgacattatagtagtaatgctgttagcacataatcgccaattcagatcctaccacatgcaggaaggtaacacaaacataccttggaagtcagatacttttaggctctttatcgcaatgataggcgcagagtctaccatgtccaagagctcctgaccagtagttgtggcaagatcattccaaagagatatggttacagttttgctcctgccatcagattaaatgtaagttatcagcacataaaacataaagagcattcacatcatcaaaagaaaggagttaacaagccaaatgatgcttacgagtcatccgctacaacgatgtcacgctttggaatcgtctcgttgtcaatcttcctcctaacactaagagtaggagatacgctctgaacaaccccaataacatctgcaagtagggtaaaactagtcagaacactacattcacaaagtaggaacaagaacacatcactgaactgaaagcactattgccttacctactagctccctgccaccaacatatggccctagctgatcaatcttgacaaagttgtactgaatctgtgggataaaagtttcgccctcagcttcctcaacaacagcattctcattcagggtcatctcgtagtcattatggacagtcttgaactgcttgttggcgactctgagagatcctttggagatgtagtacaccttccccagctcaaacatcggatagaacttcttggcagcctcgttgaacatggttgcctggatctgggtgccctgtacacagatccaacaaaattaactcatcaatcaacatacaagaattcagaattgctcatgaactgcaattacatcctacggaataaacatttcacggtaggttgcacttacatccacatcagtgagctccacattgaagacgcagccttcaccacgagcattcttgtacgtcctcaggttgcccttgcttgtgacacgcaccttgatgatccagttgccctggtaggggttcagggagatcaaaggatgaactcttctcgtcatggccaaccgcgccgcaggagcagcactgcaaacaggaaggcatcaagaatcggcaggttagtctcaccaacaattctgcatcagaaacaactgaacaagagagatggggatctcgcaagaatcgcttacttgccgcgctgctcgttcacgatctgggacgcggacttcacctcctgcttgggcttcagcacaaccggaggaagtggcggcgcgttcgtgggcttggagagaaccacggattcctccttgggactcaacagaatcgccggcttctcctcttgcttttcggcctcgcacttgatctcggaatccagcgccttgaacacgacctcgagcttcgtgataatcaagaccctgtgacgcatatgaacaaaaccagagattcagatttcagaagacaaagaaacgcgagtggtctgaagaatcagacaggtggagcgcgcggatctgtacttttcctgcttttcgccgatggtgttgcaggtgtagtcgaggacgcggatgacgccgagattctggatgttgccggagcgcacctccggagcgagctgggtgagaagcatcgtctttatcttgtccttgccatcgctcgccaagaaactgcaacgcaacagagagatcgtgaggaactcgtcgctgaggaagaacaagaacccacccagatctgggcgagtttttccgtggcgcggaatcgcaagaacgctcatcaaagaggaatcgcacacaagaaacactcacgtgaagcgggtgccgatgggcttgaggtcgacgacctggaggacgatctccggcaccggcacgccggtggccgcgtccggcgacgcgttctccaggacgaacgccaccgcccccggcgtcactgacggtgccgcgtcggaatccatccccgagccgagttgaaggcttcacgcgggaagattcagctgcggcggcggcggcgatggggaggaaatggtttggagttgaggagaatgggagtgggagaggattggatccgcgcgcctttataacgccgtggtttggcgaggcgaggcgagcgcgcgggcgggaagggggaggagatggcgtttcggtgggatttttgccgcggggtttcgcgttctcctcttcttccccgcgcgcgaacggccgcgtctggtttttctttttttggctcggtttttgagctgtggcgggagaaattttggagggttttcgcgccggtggcggaggcggagtgcgagccagagagatgggccgggccgctttatcatcacgttcgcctgaacgaggtagtgggccgagactaatacggcccaattagtgagatgggggagctgcctcctcggccaggttgggttttgaggcccataagcgtgctttccatgggggcccactattcagcgtgaaggaacgacactacggcggaatcccccctaccgccggtccgccgccgctcgccgtagcctgcctccggccggcgtcgtagttgcgtttcacggccgttatttcagtctcagatcaaattggattgataagccaagcatcccaaattctcaatgtcacaatgtacaaattggcttacggcacagcagcagtaagcaacctgagcttcggcgagatcctcacgaggccagggtggtggtggggcagttgtcgacgccgcaggcgaggatgtcgcggtagtcgcgggagacggtgaagctgtcgtgcacgctgccgtcgcggctccggacgtactcgaacagcagcgccgtgtggttgaaggccgtcagcttggcgaacccgtagtcccggtcctggacgtggctccaccgcgcccgtacgccggcgtagtccgccaggctcgccccgccgccgcccaccaccacgtgcgtcgtcgccgtgaacgcgccgctgtagtggctcgccgccttcgccacgcacacattctgaatgcacacatttcacacacagtaaaacacaagcagaaaatgagagccacagccataaattcacaagaaatacacatactttacactttagctgttctcacgttctatacttctaaaatagttgtccctgtgtgattcaaattttatctcaaaatagtaggattcaattttatttcaaaatagttatcacttcatattactccctccgtcccaaatataacaacttttagcactcagaatttgctccaaaatataataatttcttaactataattctcttcctaaccaatcacaactatccactatctacttttcccacctacctctttctgaaccaatcacaatatctttctatttaattttacctactttcttatattctgggacggagggagtaccctatcaattaccttccattcaaatatctcgttattataccctcaacaagggcggatccaggaacaaaaaaaattagggggggctcaattatgcagtttctttaacctctagccatttaaggacctttagtttatcatttatggtgaaaaaatcgaaggagtgctccgggaggtatccatgggtatagagttccccctgcacccacgttggatccgcccctccctcaactacctaaccatacaccattcaattcaaatttctctttattctatctccaatctccaactactctctcacacctaaacatacaccattcaatgacgggcactataatcttctctttaaatcataatctacactaaacaacctagaatagtaactgtatgggaacggaagagtaacagtgctcatatacctcgtagactgggcaggttctctcgtagccatggacatggccgtacatggcgatgtcgaccttgtacttctgccagagcggctggaggctctccctgcccatgggctcctcggttgtgccctcctcgacgtagaagctagctgatgagtagccgagaacacggtgggcgaggaagatgagccacggctgtttctgccggtcgacggaggagaagcagtgctcgatgaacttgtactgctcggtgcctggcctccagtcgagctcggtgttggctatgcagaaacggaacatgccgtagtctatcgagtacctgcaaggatgatctcagggtttaacaggtgcaggactgcaggttattggggccataatcttttgtagtagctttttgttcagaattttgatggaccgtactaagaaagatgagattatgcagagttggttgtgttcagtaagagagatcaatgaattttagctattagtacagcctaaaaaaacatgatagcttgttatttgttaatgttgatctgtgtatataagaaaagcatgtttacgcatgatcgtctagtgaaccagaatgtctcgataagtggtcacatgtatgagtggtacgccttaaaatatccaggtttcgtatagtatttcacaaaattcaggggaaaaaatgtcctaccagaattgctcacggttctctgctggcacgtagaacatattctgagctggtacaccgcattcaccacctgaatccaaattcccatagaaggaacctgatccaggccaatctctttcatggttgccgctgcaagcacaaaacaatatcatcagaaacattgtttgaaatttccaccttgtctttggtttgtttctgtcgtcaagtcggagtaccttccaaccatgtaaggcacactggatgcaatgggttcaacttgtgcggtaaattgatcccattgtgacagataaccattggcatagcagatgtccccaatatgtattaccatatcaatattcttcaaatctttaattagctggtaggtcgtgttcagtgaaccaggctcgaagtcattgaactcatttgaaccatcggcctcagcctgtgcaaggagttcaaatgccaattaaggccagaggagaaaagcgaatttgtagcaaataatctctcttgttttagcatgagtagcaggtacttaagtatcttattctttgttagtttgactcgagatgatagaactcataaagagtacaaccttttctaacttgcataattgtcattaccaatttactactactaactaaagataaagacacactttggtggccttctgctaattgttccctatctaatcttttttatataattgagagattttatttaaagcacaagttgtactacatctcccatattaactttgaatagctatggagttccatatcgattcagtgatcagttacctaataatttattgcacttttgggagataaacgtggaaaaacaggcacattgtaagtggtatcatattcacaccttccccatatctccaaaaatgactacacgctgcaaagagtcttcccctggataaggaggtgcttggaagctatactcatgtccccaaataatagagccatctgatagccgatgcccaattctgtatgtatacctgaaatacaaactcacttgtaagacttgttggcacttgcatttgtacaaatgaatagttacaggaccacagagggcacagatgcagacaaagcaaggttgtgtaacactcatttacttgaaattaggccacagatccttgaggaaacttgtatgtatgaaaccaggatcgcgccatccaactgtcctagcaggaggacctgtggtaaaatcatcataaagcatgacaatgttatcatcttattaggttcgtcaaaagttacatgtcaatggttatttgatctacaactgctctgccattataccattattctaagatgtgtttcttttttagttgtcacttgtcagcactaatgggggattattactctgagcaagtaaaaacataatgaaaatttactcaccgcacatagtgctgcgactgaacgtaagggtgcctgcaggagaaaggctttggatttgcccttgtaggccccatttgacaaatggtgtagcctcattggtgccatatccacttgtccaagtcactgtcatctagaatcacttaacatcagtcattattctgtaaacatggtatgatctgatttgcagaagcactttggtgcccatttgtttcataagcaacgcagacaagcaaacactatttcggaagaaaaaaatatcacttaaatggaacaatctgagatgtcttacattcctgtttttgttgctttgacattcgagctcataaacatattccattaaaaaaataggttacttgcattgaaaagtgctaaaggaccataaacgaaattttatttctgtccgcaatgatattttcctttgcagatcacaggctaggatgctcaattgagactcacttcattacttatggaatacttaacaagatgatacttacttcattccaggattttccttgcgctaggcgtgggtacacaggggcctttgggttcgtgaaggttactctctttgagtgtgcaatgagctttggctgtgaggttatataagacatggcataggcaagttagaccatataatagttcagtcacattgtattttaactagaaaagacaaaatattcaagaaataccaccatggtaactgaatcgttcaacaataagttttcacactaaataaatgaggagaattttggcacatacatttgagaggcctccagaaaacaatgcaaatgaaaaatcctccctctgattgattagctgaagcttcatggatccctttcctgtcttctcatagtcaagattcttgtagtttgcaaatataaactgccaaaaaattgtgcctccttcagcatatgttattggcaagttttctgaagtctcatctacagttcacatggaataaggctaactggatgtaacactaacctttatgggagctgtacatagaagtggtggttcaacccattggctctctgatggacaagtagaatcactggtaaattgccaaaaaggcaaaatataaataagatctcaacttctttcttgctgtcttaattaagcattcaattcaggcatccagcatcaggatgattggattgcaagtacctgaaattagcaggagagaacaccccaatccaatcatccttcgatggcttggggttgttataggtaagagtcacccattctctgtcctgtccctgcaacagataaggtagccaataatttgaatacagtgggtctatggaagttcaaaaaaaaaatcatgattgattctcctataaatcctaatgctgcaaaatgcaaatatatgcctcgaccgactaaattaaggcactattaactgggatcagaactctcgagctctggtaagtggtaatggctgactacatcgaactatataggtccgtacaagagcaaaaaacagcagcgagtgctgaattgacgagctagtagatacagtaggttgctgagaaagctgtagtacctcgaggccgaggaggagcggcgaggcgtcgacggaggcacccggctggatcgcgaaggtggtccggtggatgccgatcctcgacagcggctgctccccgcctcttcctgccgccgcgaccgcgccggcgaggctgagcgccaccagcgcgtgcagcaccgccgccgccgccgccgccatcacggcctctcgctcgctttgctccccccaaacgcagcaagagattggtacagcgaggaggaagatgattaacgcagagctggcacggaggaaagagtggcgtctaagccaaaacacaagtggctcgaagaaagaaagagaacgcaggagaaaatggcgttaatctctgcaagatttatcagattagtgatgggacgtgttgggcatgtgtaatctaatcgactaatcgttgtgttcggagctggatccgcagatgctttggtttaaccgtggaatatccttgtggcaattctggtggttatgactagggacttcagatgcaacacttgcaggctgcaagagattaattaatgcacataattgcgaagtcaaaatgggatcttatttatgtatcaacacatggttttgttgcattgatcttacaagtcaaggtcaccaaactaacaaaaccagcaacatacagcatccaagagaagctagcaaaaattggcttaagcatcatcagcactctgaatgtcgtgcagacaagtgcccttgccctgcctgatcacactagcttctacaggattatatgtcaaaagaaaaatgaccatcacgtcgacatttgaaccaccccaaaagaaaaggaactggatattgtacatagctcacactgagaacattgagcgatgaactgttagcgtaatggcattgagctgatgcatcaggtcaggcaacattctctacctgcactcaacttgcattggagtacagaacaaactaatttttcacacagcccaaaacggtttctgcccagaaatggaagttgggttccctccaagcacgctattcgtctcatcgatgttgtcctcttcatcgtcatctccataatccat

SEQ ID NO: 74913 - DNA, 27185 bp, Oryza sativa
agaagttgtttaaaacaaattaaataaatctattttttcaggtttataataattaatatttaataaatcgtatgctaatgaactttcttgtttcacgtgcgtaaaaattttccctctaatatgagacgagcgcagccttagttctatttaattatctaatataacgtgttctcatccataccttctttcaacaatgggaaccacgtcatccccttttcctaaatcttaagagccattttgaatagtagaaatagaaaaaacattgaattcatatacgattgtaaaatatggagaaaatatagaaataaccgtttgattggaccgtatgaaaaacgtagaaataagatgaagaggtagactcaaagaaaatttttcaagaggttataactcttgctaagttttctctatctctattggatcttcattccatagaaatttcaaatgatacgataagatttaattctttataatctttattataaagatattcatagaaaattattttaataggattgaaatcctccgaactttctattgttttctataaactagttggatggcctgcgcaattgcgcggctagcactcatacaaaatcatttattttctaatatgattttacttaaaatttatcaaatagctatctcgttgtcttaaggctttgaaaagccaaaccttattatccccatgtttctacttttatagtttttaaaagtcacaccagttgctaccccttacttctatcacaccccttcttcatttgcttgcttgatctaccgttgtttcgattcattctccttggacctttaaaaattataccttatagtttttagagattaatctctcgttgggttttgtttttataatttttagaagtcccatcaaacattgtcactatactcatccacaacccgtccattgccttctctctttattgccattgggatttcaaaaattgaatataattatcatttgggttcattttttactttttagaagtcccgccaaaccattaacggcttttcactgtatttctctatggctcacccattgcctcccctgtttattgtcattgagattttaaaatcgagcaagattatcaattttttttttactttttagaagtctcgagcctttaaaaattggaccttgtagtttttatagtttgttgtatcgttgggtttcattagtagaaactttaggagtcccgtcaaacgctgcactatactcctctatgattcatccactctctcctctctttattgttattgggtttattttttactttctagaagtctcgccaaataatcagcggctttatcaccgtactccactatggctcgtccgttgtctcctctctttaatatcattgagattttaaaatcaaatttgattatcattatggtttatttaattaatctcatgttgtaccctatctggactattcttttaatataattcattttttaatcggaattttaattatttataaattctattcctattagaactcttcattattattattaggattttaaaaatcgaacctaatcattctttggttttctatttttatagtatgtagaagtttcgctagtgcccatctcttaataatacaatacaattcattttatcttttattctacttagtagttttctctaaatattttttgtttctgattttagttatttttaacatatgcccaccataaattggtgcatatttttttctttttctttacttattaatttggtaatttctagatctccttgtataatatttggatatattattaattgtatgagccattgctgctgtagcgggcagactaccgagcaagaggatagattttcttttttactgagcttctttgataaaaagaaaggaacgtgcagcattgcccggttggggcttgagagtccgaatataacttggacttttattttttgctgcacggttttcttttttacaaagtttgagtaggactcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctattggtgttttattaacagttttttatatgtcgtatcaaccgccaccactctactcctttataggcatgttacttaatttatctcgtcatgtgttttagatggtattttctttcaatagtttttatttttatcacaaattttagttatttataaattatattcctaattgaaatcttatttttctttctctaatttcagaatttatttttttcaaattttaattaatatcgtattgtgttctttttttttcaatttcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggctagggcttaataggattaatagaatactcatatcaacaagttgcaacttcttttccggaagccaatctccaaagaactccagctccagggttaagcgtgcttggcgtggagcaatttgggatgggtgaccgacccggaaattcttcccgggtgcacacgagtgaggacaaagtgtgcagaaaagacatgtgttggtctgtgagggtagtctatgacctatgaaagccaattcatagcatagccgatcaggtagatctagcatgtatcggcaatactccgatactactctatactaagattttaaagcaagtaaataaaagtagttaatcagataagatcggctgaaactccgatactaccctaatcagcaaccagaaagcaggctagagattgcaattctaagcacgactactctatactaagattttaaagcaagtaaaatatactaaacataagcttaatatacttatatgcgacaagatcttaacataaagggcagatttaacatgtcaatcaagcatatagaataaaagtagttaaatcagataagatcggctgaaactccgatactaccctaatcagcaaccagatttaacatgtcaatcaagcatatagaataaaagtagttaaatcagataagatcggctgaaactccgatactaccctaatcagcaaccagaaagcaggctagagattgcaattctaagcacgacttaatatatcaaacttaactgatgcagcattaagtatgaaaagaaaaacaatatctagacaatcaagccgctggaagtttcatagagtggtagatatatcacatagtctaagttaacatcattatctaacctaatcgactaccttccattaacagatgttagccgattataggttagatgaagatattatcaaagattatgtgagatatatgataactcgacgaattatatagacaagattagagtgtcataaagatggaagcactaatcttgagaacataagtctcatgacaagttttacctcttgttgaagatcgaaaccgatgcagctcaacccgagagcacgaactcatcgaaataaaagtaaagcataaagggtggcgatgcgccgagattgtattggatgtctcctttttacatagggctcgggtctattatacccgagaaaagatacgtccataacagacatgactattatctctaacaaactctaagataccataagtctttacggcagacttttgcccaaacatatctctaaggaaattacatagaatatcctaattaatagatataattgccttcccatgactctatccatgcatggcaatcatcttgaagcacatcaacttgaacccgatgacgtacaccgagtcaaattatcggaatcggctgtatcggctaaccccgtccgactcgaactctgccaacctgaccttagccgatttggactgcagtcgattcttactctgtttccgcaacgatcttcatcttggattccactttgatctgatcttcacctccgatgccaatagtgatagaatttaccaaatttggttgttaacaggttcttgtatggattcttctttcaatattgcttatttttaattccgaatttcagctaattttaaattttattcctacttgaactcttcttttattttcttttgctaatttcgggttttatttttatttttatttttaattttaattaatctcgtattgggtttttatatggactcttcttttaatatttcttatttttaattctgaatttcagctattttaaaattgtattaactatccttttcttttctaattttggattttattttatttttattttgaattttaattaatctcgtattgggttctcatatggaaacttctattgcttggactcttctttttttttctaattttagattttatttattttaattcgaattttgattaatctcgtattgggttcttatatggaaacttctttcaatattgcttgttttaatttcgaattttagctatttttagattgtatttctacttggactcttctattcttttcttttctttttcttctattaatgtgggaatttctagtccccacagcgaatatggtgtctcttttcaaagctgttttaataatataatagatagatagataacctccgggccaattcaagcgagattgatgggggcagccgccgatcctgtgcggtgtgaagagtgaacgagctctaatggccaatggacgagcttagcgcggtggagtgcgaaggcgcgagagctcgtgcggcggccggcgggagggtagtattgctggcaacgcaaactcgagccacgttgggcacttgggcgtttgctagctgctaccgctagtgtagccggcgaccacagagagagcgtgcgaaagataatcgattgcggaagccccaccccctctgttctccttggcctataaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaactcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctggtccttcgtttttttctatacaatttaaaggggcccttaatttttagcaacaccatgtggtcctcaaactcatcagcagcagacaacaactaaagagccgtgtaatatatcagacaatgcaattagtagggagaggcgcccataacacacagaagagaacaaggatcagagacgaaaagggttagccttttaacgctgtgatctactcgccgctacaaagagaatggacggattgatccaaagtgcctcgactttactacttgcggcggggtacaccgtgccgcccggcgtgccgcgcgctcccaacgcgagagggggtttcgacctacctgcacggcacgcacgcacatatgctctgcatgtgctgtgcaacgcatgggcgcagccgcgagagcaagcgcggcatgatgcgcctgtacgctaattcttggatcattcctccctgcgttagtttaacttaatcctaccggtacactgcagacacccagctaatcaattaggcttcttgcattagtatatatagtgatatatactatatactccgtaccttgtatatgtcgttggagtatcatgcatgctgtgactgtaaaagcctgcagctaaccgataggaaggtagcagagggatcgtactgttctatctcgtgcgtagtggtggcatctctcggtgtccccagtttgtaatctagccaagtttcacggcatattaatttgcagcgaagggagacttatggttggccatgcatgctctgatcacagttacgctcctatccatgtacacgccgtgtctctatccggtgttggcccacggtatatcaggaccatcgctctctcgcgtctagggattcggaaaagctggtgtatatgtccaacacatattttgatgcaatgttgatacgcgatgtgactcgggttttggtacgcagatatactcagatgctacggactgaaaattgtacttggggtatacacaaaagctagctgggcgacgacattttggagagatcggtaagtctattgtgtgtttagagctccgtcgatgacgttgcaattgttctatgacaagaaaaatgttaaaatatcagctaagtgcaggaactcaacctggtatctcagtgaataaacatatggacgaggtatccgtacattgtatgattttgatatatcagtcatcactcatcagtgtccgtaaatatctctctttttctgaaacattaacgcagaattattatacgttagctacggtagctaaactaccaggtgaaagctagcgatcgaaagcatgctagctagctgcatgcatgaccgttggcgtccgaccaaagcagaaattccaaaccggggccgcagcgccagcagctagcttaacttttggagtggtcccgtcgggcggtatagcttaactcttctcctccattatttgcatgggcggtttcttccccctcacaggcctataaattccgaccccctgcctcacagtctcggtctctctcaccacatattccgcgtgcatgtgaagagagagatatagagaggagagctagcgaaagtttgagtgacaaagacgcacgtacgcgcgaaaacgttgtcacgcttttgagtgatcgatacacgggggggatacacacgcaaaccgatcgatatggttcgtgagcgggtggtggtggtgatggcgttcgcggtggcgacgctcgcgacgagcctcctgccgccgctggcgtgccaggcggcgccggcgccgtgcgagcgcccgacgcgcgggcaccaccagtacaggcagccggtgggcgtgcggcggatcgtggtggacgcgagcggcggcggcgacttcctctccatccagcaggccgtcaactccgtgccggagaacaacaccgtgcgcgtcatcatgcagatcaacgcagggtcctacatgtaagctatacccagttagctcatgctcatgctcatgcatgcgtgtgcagagtttgcgtttctgacgtgatatatgtgtgcgtgcagagagaaggtggtggtgccggcgacgaagccgtacatcacgttccagggagcagggcgcgacgtgacggtggtggagtggcacgacagggcgagcgaccgcggccccgacgggcagcagctccgaacctacaacaccgcctccgtaaccgttctctctaactatttcactgctaagaacatcagcttcaaggtgagctagcaaacaccgttcgcgcgccatgccatgcattagccagtggtccgtctccatggacccggccgccaacgtacgcgactcacaagacgcacagggagatgcggtgcagtacagtgccgactgccgaggcagagaggcagacaaagtgacaaaacccttcagtgtcacgagccacatcttgcaaatttgcaaatgctgcatgccgggcgtctcttcttctctgtgtatcccttgttcttttgatattttgaatccgtttgtacagggatgtattttcgggttcttggagcagccaaagcagatggcttcttccggctacggcggagagaggctacagcctgatcgacgcggccggccaactttttttttccagtgaattgcatgcatgtaagtagcaaacaacagctgacgctgggttcctgaatcctatggcttggcagaacacggctccggcaccaatgcccggcatgcaagggtggcaggcggtggcgttccgcatctccggcgacaaggccttcttcttcggctgcgggttctacggcgcccaggacacgctctgcgacgacgccggccggcactacttccgcgactgctacatcgagggctccatcgacttcgtcttcggcaacggccgctccctctacaaggactgcgagctgcactcgacggcgcagcggttcggctcggtggcggcgcaggggcggcacgacccgtgcgagcgcaccggcttcgccttcgtcaactgccgggtcaccggcactggccgcctctacgtcggccgtgccatgggccagtactcgcggatcgtctacgcctacacctacttcgacagcgtcatcgcccccggcggctgggacgactgggaccacgccagcaacaagagcatgtacgtactgcttcagctagctagctagcctgatcaacttgataaaaaaatgaaactatattattcaattcccagccagctaacgcctgtgcaaatgttgtcgacggcgtgcatgcgtgcaggacggcgttcttcgggatgtacaggaactgggggcccggcgccgacgcggtgcacggcgtgccgtgggcgcgggagctcgactacttcgccgcgcgccccttcctcggcaagagcttcgtcaacggattccactggcttacacctgacgtctgaaagccgtttttcggcaccacaattaatttactggagacaagaacgtacatttgttagtacagcaaaagcgaagaatagaacattacgataaatataaagtattgaagtgactagtgcagtatatagcggtagattcattcgttcattcgttttgtctgatccggcttataatgatagctgctatagaattcaagcacagctctttacaagatctatagtagctatgtagtactgttttaaaagctttgtcatgtagacatgtacccatgcatgtgaggtgaatagtgaatatataattgattttgttgttactttaaggaaaaatccaaatttgatcccttaactatgaccttagtagattttgatccctcgactataagatcggtctccattatcaacttttgaaattgaccatatttcatctatgggcgccaatcacttctaagagttccgatttggatcagggatgaaatatagacagttataagagttgggggatgaatagtgaacattttaatgttcttctaattgaaggacaaagtcaaaccaaggccagataaaatacagacttttctctcttcataaagataaagattttatcttattttccgttagcacgcttttcaaattacaaaacggcgcgttttgtgcgaaaactttctatataaaagttgttttaaaataacaaatatatctatttttcaagtgttataaaacttgttagattttgtatatctcatatttatttattttttttacatattttccgctatctctctcaatactgttgctataaatcggttgtggagataacggaacgtacgagcctatatgtacaccgctctattggtattacaatcgattgcgctgagtcctatcacactcttatgatatcatattaggtttcttattttcgcatctcaaaccctaacctggcaggccgacatctctcgccgccctggtctcctcctcccaactccctatagactctgtcctcgacgacacaatcaagatcatcgccaacgcagtccgctcctccttatgactatgatataaaacgcattccgctcctccttccagacggccctaggtttgcaggttgatgacaccgtcattgctaccatcatcggcgatactgttgattgtgtcacaacaccggtaccctcttcactactcacagctccaccgacaataccccctctcatattattgttggcagtggctgtcttctccctattacttccgttggacgtgcttacttacactatcctacactactatagatccgggcttcagtgacgggtcatctgtgacgggccaacgcaactcgtcaaagataagtaatctctgacgggccaaaaaaatatcctcttcaatatatggctaccagggaggacccgtcacagatgtgaagtcatctgtgacggcttgcacttgtaacccgtcacagatcgtctgtgacgggtcacaaccatggctcgtcatagatgacatgtcatctgtgacgggtgtagtattatgaaccatcacaaaagagaccactcatctctgacgggtctttaactaacacacgtcacagataatgttatctctgacgggtggtagttatgacccgtcagtgatgagtgaaaattcaaatttttaaattttgcaaaaaacctcgaattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaacatcggatgaagatattttctatgtaaaagttataaaacacgataagatctataactacttagttgataatattttcatttgaagtcatttagggtgttaaatatatgttaaatgattcagacaagcatagacaaaataataacattggatgagtaatcaatatgtgttgagtaggtgagttggtaagggagctctatatggaggttgaggtcttgagttcgaatctcacgtgtagcatacaagttatattgcgtgaaaaattgtgaatttgtaggtagtgatgtgtaaccatgtataggatggctagtaaaattcaaaatattttttttaggttttttgatacgtttaaaattcaaaaattgtatttcttgctttgtcatcagtgacgggtcgtaagttacaacccgtcagagatgagtcatcagtgacggttaggtagttacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgttagagatgacctggtccggcgtagtgctaattgctgctttgttcttaacaatgttctaatctctcttgacattattaagagctttatttctgcacaccatttttcttatgataattggtgttccattgaacttgacccgtttggcctctttgtgaagttctcaaaattatatatatatatatatatatatatatatatatatatatatatatatatatatatatatatatatatatatataagcaatacacgtcctatggaattaaaacttttctatagaaaataattaaaatgcccttagcttagaagcgagacgtcaagaacaattatagttcaaaaatatctaatcactacagatatcttaatatcaagctaacactacagaaaattctcacccatcatgccatcatgggaaacaccttagttttgaaaaagaaaacaaaaacctatggttggaccttcaagggggtaaaatggaaaaacaatctattattgatagtgtggcgccaatattttctacaaaaaatatattccctattgtcaagtatagaaaattaatcctatcccttatgagattatttttttatcccccttccttatagttatgtctttgagaataagataaaacccatatgaaaagaaaaattgtattcaccctagatgttcaaaatatactattgttatacaatggcttagagaccaatgatgcatagtagcactcagcactatgtacctcagtacatggcaaatactacctctgtccctaaagccctaaattacacacgctgtgttcgttagtgtagtttgaaaactaataggttgtttggtttggtgccacacattaaaatagagtaatggattagcacataagtataaatttattagtttaaaatttttaaaaataaattaatatatttttaaagcaacttttctatagatattttaaaaaatatattatttagcagtttaaaagcatgtgtgaaaaaggagaaaatagttgagaaggagcaaaaaggccacaccagagagtactctcgttatatatttactcccttcgtcccataaaaaccgaatctaaaaccggatatgatatatcttagtagtatgaatctgaatatatatatatattcagatatttagattcatatgtattatattcggttttagattcgttttttataggatggagggagtacactagtactactactacatccacgagttccccaatgccaaaaatactgcagaaattggatttcaccttagtgaattatcaccgtattgattctcctcatctttgctccaaagagaaaccgcggggctgcagaggatgcaacagctaggatcatgcggcgaagcagagcgcagagcggagggtagagtgcgtcattgcgaacctttggggattaacctcgccgacgatgaagccttcgaccgtgctgcccgagaccgagagcatatgccctcacggccgcctgaggtagagacgaggccatggaaggcggccggcggccgctgcgtcggacgcgttgaggggctcggggatttggaaatttgcgtttggttttcgcggcggagagccggagataacacagagaaactaaccaatagtgttgccaaatcggcatcaatgcggatctgagtggtggtggtggtggactggtggttgcccccacccccaaccgcgtagaccacgttggcacgcggccgccgcaccagtccccccctccgccgcagcgcaatgcaccaccagatttggcgcctcctccccagcgccctctcgccgatccacgccggagctccccggccgagccgcccgccggcgcggctaggccgcccttcaccgcaacgacggcgggcgctcgcgctcacgcacctcgccacccggcgcacatgtcgcctcctcgctgtctccgcccagtccgccagcccccacgccggcttgaggtccgcacttactcgtcgaatttccttcatcgctattcatggaatctgaggaagagttggaattgtggtttgtggtggaatgtaatacctggtacccttactggatgggaggaacaatgccgcacagctaaactggtgttaatttgggggaagtgccaattttatgccttctagtgctaaagcttgtgaattcagtttttggattatgtgatgtgcattgtaatgccgaattatgtgttagtctttggctaaaacttttgtctatgatcccctgagtagtccggatatctttagatattggatggtatcatgatcaatatacctcgcttgttcaacttttctatgatcctggatgatgccctggatatgaaattgttgttagtccttgtaattttcaggttggatcagtttttcgaggtggagatgaaggtacgagattatgaactcgaccaatatggggttgtcaacaatgccatctatgctagttactgccaacatggtgagttctgttctaccaatgaaacaaactaaaagaacatctcatgtatattaattaggtcagttaatatgattcctatagcatgtttagaatttaattaaaataatatgattaccatggttggttctgacaaaattaaggattcatttattttttaaaaaaattgagcaggtcgtcatgagctacttgaaagtgtaggcataagtgcagatgcagtagcacgcagcggtgagtcgctggccctctctgaactgcacctcaagtactacgcgcctttgagagtaacatccttgtttcccaagttgtgaaaaaaccagaactgaaaaatgttgatgtgatactatgaaactaataacagatcaaactctaaatattgataataggttcatttgggtctaacttctccctttgtttctttgacttgtcagagtggtgacaagttcgtcgttaaggtcaggcttgcgagcacaaaaggtataaggatgatattcgagcacttcattgaaaagctgcctaatcgtgaggtatgcagcacaaataattgcagattttagaataggaaaaggaattaaaagcacagtacgtttcaaattctcaatcatgttggtaacaaatcttggcagcaatggcacaatgccatcagtagcaacgtactagcatttttcgcaacatagtaccaacttatgaaatctatatgttatttcagtcacaaattggtcgtaggatttcctttgcaactgctctttgcatagatcacacttttccatattcttctcctagcagctcattttggaagcgaaggcaacagcggtttgtttgaacaaagactaccgccccacccgtatatctccagagttcctgtccaagctgcagttcttcacttctgaaggcagtagcagttaagtcactgtactcatcgtcataacctgcgataaatcactgtatcccattttccatcgtattgtctttgttcaaatgaaccaattgattgaagcatttgacttcagtgacatttctaatctgtgataaatctaactgcattctttatttgattttcttggagtgagcacgcgttccaacgtttgaatacatcgtccaaattcagcaaaaactttgaatggctatgttgagctcatggatatgatgtgagaaactttttttttttttttgggggggggggggggggttgagcactggttctttctgtgctaggttacatatctatgagacccggctttagtcaggcaagggctcaagttctattcataggagatctgaggtttctgaaccctttccacacaatggatgaacctttcagtcccaggcatccaattactagttgtgatagagtgaatgttcaccaattgactagtataagtagtgaacatctcccaatggaaaaaagctatcgaaattttaactttatgcaaaattttcagttttgagttaaaaatttgcacattcttagttcaaaacatctactaacattgaacatagtagttcagatttttttttatttcactggttagctcacaatggctgctgtgtttgacatgcgaggaaaagagaagatcgaggatacgcaaaacaagataagccattagcattagcgtatggttaattaattattaattattttaaatttgaaaatgagttattaatatataatttttaaagtaacttttctatatttttttctaaaagaatactccctccggtttcattttaattgacgctttggacaatgacacgctctacaagatatacatttgaccttatttttttattataatatatacaataaataaatacatgtttatttttattatagtgttttgaaagacaaatctatatatgtttttctagtttctttaaactaaatatctttaaagttattgatggttaaagttataaaaggttaacattaaccttgtccaagaaccagggggagtatatcgtttagtagttcgggcaatcaatcaaaagctaccgaacgcagccgaatacatatggcgatttcggatagcctcgccaatatgctactacgtggcaatatctagaacgaaattacgtggacaaatccactaggtaacctatgcgaaagcactaaatgaacccacataacaggatcagcgagaacgtaccgtgccggggagaaatgtttccaaatggccgcttgaccgcaaaaagcttagtgcctttttatcccttaacaagaattcctaaatatccactccccggaaaagaaattcaaggtctgccgcactcggaaggtcttgtttgtgttaaagtcggatttcgcaatggatgaaactagggtttcccaaaccaccggggccggggttatcgtgccccggcagtaagcacggtaaccgtaaaaaaccgtacgaaaccgtgcaaaatttatcaaaaattcaaattattttttaaatttatttgaatttaaggaggttaccgcggtttttctattaccgtacccccgcggccggtaaccgcggtaaccgcacggttaccgacggtaagttgaaccctggatgaaaccaccataagcttgaaattttggccaattaagattggattaaattccactagccgaaaaaaaaaaccgaatacatcattggtatacctttttagccgtgtaggagtttgatatagactatatttaggggagtttaaaattcgcaaaaaaaagttagttgatagttccgttcctgagaatatgaaaaagctaaaaatcccatcttcaagtttctaatttattttctaaaaattttttagttcttggagaagttgtatatgcaaaagcttccaaatagcgaagtgagcgttggtagaatatgtgtgctagtatttacccgttaacagcaaggtgttcataataatttcatcaatcacaatatacgtcgaccaatattttaaaagtgcccatccgaaatatatccatactaggtcgaacgaaaacaccccggataaaatcgggcagtctcttgatgcgcgcggtgtagctgcagggagctagcaggagaagctggaggcgcaccgcgcacgcccgaccggagccagccatggagcgggcatggcgcgcgctccgcgcatggagcgccgcaatacgctctctctctctctctcgcgcgcgcgcgcggatggcatgtgccttccctgcaggcgaccttgccggcttgccgctcgtctccccttccgcccgccgatggcgaccagtctgtccactcgttcgccttcgtgccgctgctgctcgtgcgtgcggcgccctatgttgaaccggatcggggggacgggacgacgttccaccgttcacggcgcgcggggttgtcgtaaagccatcacattcatcggaatggggaacctgcctagctgctgccctcgtgcgccgtacccccatcgaatcctagccgtcggttcagctccgcctgatggcccagacggtccagatcagccgatctcgccaggagagctggttggtccaacgtgacggcctctgacgcacgcacgcaaggcaggcaggacgacgagaacgcgtccatgtacacgtaggcaacacacagctggagcttttctttgaagagaaaaatagcaaacgaaggaaatgattctgctcgttttagagaaaaacatataggttacgtgcatatatcggcattttcttttgaaatccacattaacatgcataaatatattgcatggaccttgacaactctcgctgtcataatgcatgctcctgtcagaacctagctaccgactaagtactctaacaatgggataattaatgtcagattactgcgtagggtgcgtcaggtgaaagagataactagccaaattaattgtgcgcgcacgaaactttttcctgtgtgcttgatttccacatcatcatatataggtcaacctagaaaatacaccactcttccttgaattttgctcgtggcatagttccccatttaaaaatgttattactaatctggttgtcaaattgcggtaagtggtgctgtgactaagtgtgaattatcagaatatatgtgacgtatgtggcacgtgcaccagtacatggtaaaaacctttactgtttgagcgggaatttgtttgctcgagagtatctagtttttgaaacatctctctggtgcagaggaattgtcgtgtttatgcttattttttcctccttctgatgaaagataggatcactattgtttgcagcatttttcataaaaaataatcatgtcgaataagcgtgtggctagttttcgacgatgaggaccagcacgttttttacagcagaagtcaaaactcgatcataatgtcctcacgcaccggagtggattttaaagtctcgcgttaattatatcacttaaataattacgatttttttaaaaaatatgaagatgtattaatatgtgatatatcactctacaaatatccaatttagaattcaacatgtcacaacggaaaaaataaatttgactcaacttctacattactaaatttgttttgtcttgcgacatgtagaagttgaattgtaaattttatgtttatggagtgatatataatatattaatacacattcttaaattttttttatacctgttcaagaggcatgcaaacaacgaggggatttaaaatagtatttgtcacggtgcaggccttgcctctaacgaggggatttaaaatgatttctgtcatagtttaccctttgcacgtgtatataggcttagatgtcggtgtcccatgcacacatgtgaatttccttctaatatagacgtataatttttttgcgcgatcgtgaaaaatgcacacatttagcatgtagtatatgcctctttgtgtgtgtgaaattttacagagtgcatatgaatttcacacgttgcaaatttgtgtgttcagattatagtaaggcatggcaattgctaagaatctgcgtgtgtgcagactgtttccgaaagatcaaatgacgcaacctagatacgatatctcacagacccactgtacataccccaacctgacaaatcaacactgtcaggatcggagtaacagtattttaatgcttcccaactccatcaccgcaatatcgtatcagccctaacggtcgacgaccggccggccagccggtgacccccatgggccgtcacttagctgggtgcgccaccagcgacggcgccccaatactctggtcaagaaacgtgccactacactgtggtttgtgcatatggaagcccagttcattctctgccgttgtctcatggtgaccggtccgacgaccaggaaaggtaaaatccagcgcgcgtactctgctctatacaaccgaacagtcttcaacgcaaaaaccgcatgcgagcaaactcagacttttgagggtagagagaagaacggtaatcacctagctagcttacacgccggattggactttccgttgcaaaaactacgtgtgcagcgttgaacagctaatcacctgtcctttcctgtcccacggatcatcacctatataagcgccatgcatgcaccgccatgagggaaatatcacagcaatcgcttcatcagctcgccgattgcaacgtgagttctactacacactagcagttgatacacacacacagttcaggcggcgataagctagcctgaggcctgaatatatatagcagctagagatactagtactgaattcacaatgcagcagcagcagctgtgcagcagccactgcctccctgcccgtgccggcagcatcgccagccccggctccggccgccgcgtggtgcccctcggccgccggcgggcgagcctcggaaaggtcacggcgtacgcctacccgacgactcgccgcgtcgtcgatgccgcaaaatccagcctgcttcaggatgtccacgttgctgcctcgaatcccagcctgcagctgctgcaggattatgctcccgccaagaagtcagcaaaacagcagaacggctcaaggtcctccttcgatcgagatcatttcaccaatctactccattaatcattaatttcctcacttcatttttgaatatatgcatgacattgtaaactttcagacattgatatttaccatcttactcaattttttaatataaaaaatactccatccgtttcagggtataagatgttttgacttcagtcaaagtcaaactgctttaaatttaatctagtttatagaaaaaataataataataatttcaactcaaaacaaatttattatgaaaatatatttaattattgatttaataaaactaatttgtaattataaatattagtatatttgtgtataaacttagttaaatttgaagtagtttgacttttactaaaatcaaaacatcttctaacctgaaacgaagggtatatcatacctaaagtacaattaatgttaaaacaagtccccacagaataaataatacttacttacataaaagtccttttaaataaaataaatgatcaaatatcatgtctaaaatcaccatcatcataaattcatttaaaaatggagattgtaatttctattgttgatcttttgatatttcagagaaaaaaaattaactctgatgttttgggtattatgaaatctctcaggacgaaggacgggttttacgaggtcgagatgacggtccaggacgacgagcttgacgagtacggcgtcgtcaacaacgccatctacgccagctacatccacagtggtaagctaatacatctccaaaagtaactgaagcatctgcatgctaaacctgttataaataatctgaaccgtgcgtttcatgtgtatcaggccgtgacgttttccttgaaaatgtcggcgttggcgtggactactggacgtcgacgggcaacgcgctggctctttcagaattgaacctcaagttctacacgcccttacgggtacatcttctttcttgttttacttattactattttggacatctatctcccaatcttgatcaacttcatgtttttatggtcacggcacacacaccgagaaaatctaacaaacatttgccttgcgttatttccagaaggatgatagattcgtcgtcaggatgaaggtcgtgaagatcaaaggtgtgagaataatcgtcgaacatttgatcgagacgctgccagatcgtaaggtaagcatgaatacacagggattctacagctaattcattctctgttaatttagaggtgattttattaagaggtattatactttttagtgtaaagcttgataccttgggataatttagtgtaaattttaattatctttaggtacttttcaagcatagtaaagtttctctaattttagctaatggtgatcgatcgatctcacacaatgattttactgctgcttctcccagctcgtagtggatgccaaagcaaccgccgtttgcctcgacaacaaataccgcccaacccgtgtgttcccggagttgtcgacaaagttacatcagttcttcctgtcataaacggctctttgttgctctcatgacaagaagtggatgaaccttatgtgctctaccggtgtacagagcaaggcacaatttgtttgatctacattttttttaccagaattatgaagcatactgtagtaaataaagagtgaataagttagtgctgaccggcttagccgtgagccgctttatgtgaggatgagatgtagatacgcaatacaaatgtgcacctgttcagcagctttcatttcaatgggcattccattaaaaaaaaattatgatcttccatcgtgccttggatttacagtttgcatgattgtttctcaacaagtgaaaagctgcgtatttttatcacgtataaccgtagactacactcgagtacagaacagataaaactcgatcagatgtataatccacggaacaagtattagcacttcagcaggtgaacccacaaacgcacgtgttgctagatgagaacacaagcaacagcaagagaaacaaatgtacggctgcttgaccgtttctaccacatggcaataccagtcgttttcattcaaaaagatcacatcaatataataccacaacaaacttctgccaggtaatgacaatagctaaaatataaagaaacacagctagtaagtagtaagacagttcctgtgtgcttgaattttggcggcggctgtgcttttctgaaactgaacatggtctacacatgtcataggtgcttcgacccttgccagttcaaataccaaattcagaagtcagactcaattggagaacagaaacagtttttaatgccaaatgattattcaagtcactggttaataaatttgagaagtgcatgttccacaagcattagattgaaaatctacctacacaaacattagattgaaaatctacaaggtatgttgaagaacctggtctttatgatttcaaccagtcacttatatataggtatgtgacgctgagagccagttttgccaccaatgatcaatccaacagcaccaatattcaccatgatgcagataggcaccgtcattcttcgtgtcagtcactgctaccctggcctgggcacacatgatggagatacagtgtataaattcgaaacccaagtgtccatagcttcaaaatttagattctttcgaatttgaaacttaggtgtccattgcatgaggtgtaaagtactttaggtgtatgatataccactagttaggtgaatttgaatttgagactaagtttcaaagtactttaggtgaatttgaaacttagctgtctattctggtatatcatacatttaggtcagactttgaaagagccattgcataagtttcgaatttatacactggtatatcatgaatttaggttatggattatagaattggtgtccataccttcgaaatttaggttctctcatgttgaaaacgaaactatgttcctcaattatttcaatgcataagctaactaggtccagtgtataaattcagagatgtgttggggcatgcaacccacatttcaatcctagttcacataaagttaaggttaactgtcccccaaagcaaacaaaattgatccagtcaaatccatgtcagataacaatatatcagaaaagttcacaaaattgttcctatcaattcatcaagtgaagcctgaaaatcaaaggtgcaagaataaaagcagaccacatgattgaaatacagtcaataaggtatggatttacctcacatgctcagatggcttgccaatcctgcgtgctgacagggtccctgcatatgtcatcatataatagtgaaatatcattatctacggtgcccagattcatggtctatgaacagttaatgatcttgcttaccatcttcatgtatctagcacttttgtttcacttgccagctcatacagaaagtcagaggaaccgctgttcgcctcaacaaacacttttgttttacactcatagatttgttgacaaaaagtactgcagttcttctcatccaagaataactaaaaagctcagatagcaagattgcattcactgcttcgctttcttaataagactgagcttatgaaacttgtgtgctctcctacattcactgcttcgctttcttaataagaccgagcttatgaaacttgtgtgctctcctgattttttttttgggtgatttttctctaaacaccatggcaagcaatatgtatcttacacccgctgcttaagctggtcttaaattggactgatggagtatcagaatttaacaattcattagaaagccaaaatagacatatgtagtgttatttccttttctgaagtaatagtaaagttatacacgaaatagaagcaaaaagttgagcaataatttagcacaacacacaaaaagcatagcatcgacttccaatggatgccacaagaacattgattcatttcacctgagagtggctgatgttgaaacgccgaccacttcgagtccactacaccatacatgtcaatgtacaccactacactatgctgcgatgaagccaaaaggtttctctgctgcgttcctgcttcaacccattgcatatttgagagaatcaccagctccttggaagaacaggcatgatagagcgaaatccgcaacgaaaatcccaactaaagaaacgaccactgcagatgtggtggactctccaacgcccttggctccaccatgggtggtgacaccccaagcacagctcacaacagcaataatggcgccaaacacctgagattttagcaaggaactgatcaagtcccatggccgcagcgcccttcgcgctgactccagaatgatgctggtactgacaccgaagatcgaatcagctaagaatgccgaggacgccagaccgagcgcgaagctcatgagggttagcacgggcagcgcaagcacacaagcgacgacgcgagggaccacgaggtaatcgacgggctgcgcaccaaggacgcggagggtgtcggtctgctccgacacctgcatggtccccagctctgcagcaaacgcggagccgacccggcccgcggcgacgacggcggtgacgaccggggagagctcgcgggagagcgcgagggcgaggacgccgccgacggagcggtggaggccgaggcgagtgaactcgcgcacgaactggatggtgaaggccatgccgacgaatgccgcggtgaggagcgagacccccgcgctcccggggcccacgcggcggagctgcgcgaggaggttgcggcggtggacgcggccggtgaggacgcggtggaagacctgccccgcgagaagcagcgccgagagcccccgccagatcgcgcgcggcggggaccacctggagaagggagggggcgggggctccggggacgccggcggaggcgagggcggagaattattgctgccggtgggggccggggtgagggagaggcggggcacgggcaggcggcggcacgaatggtggaggcggaagaggaggtgagacttgtggttcgcgctgtcgccggcgccggtacaggataagctgatgagagggtgggtggtagcggagattggacggagtaggaaggcggcgccggcaccggcggacggcatgacggtggccggagatcgggacggtggcggtgggtgggtggtgggcgattgggtgggtcggacggacggaggtgatggggatggcttcgtgctgcgggaaggtagtggttgttcttgtgggcttcttgatgttgggctttctgagctctcatgtgatgggatcactgggccaaggcccaagataagtcaactttgacaaaagttaatctatgttttaaaacttaattttagcatgatggttttgattttgtttttcgtagtttattttttattgctgacttttagttgtttagaaaaaatattatttataaattatttttattggaaaaatattatttataaattatttttattggttcgtttaacttttcatgctttgtaccatagcggcgcaacaactaatcacaaacacaatacggaacgggcgcacacgcagccacccgatccggaacagaacaccattaacacacgggtataagcctccattaatccttacttgcatcttcatcctcccatgcaaaattcaacctgagaattaattcacgtacacgaaagattagtggcagtagtgaagctgtggctatctcgctattgacttactatctcaataatggggcttgcatgtcagggcagagtcgcacatgcgttagtttgccgtgttcaactgcttgcaagttgcaacagcgatcgatgccaagctaataggtacagacactgcaaatctgcaatcctttgggcaagtacaggtacgtacatcatgggcatagggatggcaatgggtcgggt

SEQ ID NO: 74914 - DNA, 56612 bp, Oryza sativa
gtcatctattaaaaaacggaggtagtattacttttcatgtgtaaaacaatgcccactccgcaggtaccattccctctacaaaatttatcagtgtaaagctatctccatatgtactccctccgtcccataaaatactaacctagaatgagatgtgacgtttcctagtttggttttttttttatgaacggaaggagtagtgcgctaacctttggtcaggtcaactagcttatgtctcatgtgcgattctaaccatcctataatgtgctatcaataataagttttaaaagaagttatgttgttttaagaaacatgtttatcttgtggacagtttaaaagaagtaacataaataattgtgactattatctggctttttacgggaaacgttgtaatgtatatcaattataatagccatgtatgctaaaatttaatgagataaataaagctataaattaaatttaatcttatttaaatatatagtttagaattttgccctaaaaataagcacgcaagttttcttctctatttattggttacatggtacaattataaatgatgattggggagagaataatgccatagattgagaaatcaaacttttcaaggtgttgaatgtaaatatgtgagaatgaatgggtacttttgcaaatattttcactgatcatcggagtgcactgtccttcccgagacttcaggagagaccatataatttccacatatccttcatcgtacggttacgattcattctagtgttgtttttatctgcttttcaatcacagtcatcatgcaccacatggcgtggctctttccgtttccatgatcagattgtattttcactttggcatgtcaatgccgcaatgcctaagctttatggatgcggcttccctgttcccaatttgctgttcccttccctgttccttcgaggtgcatgctcctttctcgagagatatatgacaccatagttaattttttccccatcggatcttttttttcccgatcggatctttttttagtacctaactattataataagtggcttaaatcacgttatttccaattaatttactactaatacaagacatgttgtttgtatgaggagcacacactgtgctgaggtccatcagaagttctaacaatcgtcttgtgacacctgaaaggaacagggaagcgaacagcaaattgggaacaggaagccgcatccaaaccttcaatgccagaacttgaggcagaagtgaaaagggcacatcagacactgcattaacaggatagcttgatcctttcaactcaggctctgtgtagttcccaaaagaaaattttttacactgacaaattgaatatttggacacatacatggagtattaacaattacatagattacgtgtaaattgcgagacgaatcttttaagcctaattgcgccatgatttgacaatgtgctgctacaataaacatttgctaatgatggattaattagtaggggtgaaaacggatcggattcgggtggatagtagtcataccatatcctataccatattttttaatcggattcggaggcggtgcggataatgtgcggatgcggatgcggagcggattattttggatgtcggaaatggtgcggagtcggtgcggactcggctcggaaacggataaaaataatcggatgtggcatgtatatacaatcgatacaacatctgatcatctgtacaatgagcaacaatgactcacaattcacatgactcatgaaagcaccgatcacatcataatataatgtcaagttgttaacgattgacttgtcttctgtccatgtaatcgacacatatagtattgacatcatgatatatcgcattcacataacacgtaagacatagaaattccacaaatattagaaaaaacaatatcacatgacatgggtgatagaacattggaggtccacaaatgatgtccaattctcatacagtactactaataagttgcatattgcatatgacataataacacatatgcagctaaggtcagaaggagatgatctagagaagtagacttcaattctgataataacacatacgacagagttggtgctggagatggcaggaggcgtcgccggcgccgagacggagacaaccaggtgactttggggtggagaaggtaggccgcggcgccggggtggagaaggcaggtggcggcggtggcgctgggtggagaagtcaggcggcggcgtgggaggaatggaagaagagaagtctcgatgaaaaaattggttgacacgacgccgacggagtcacggactgaactcctagatagattgatggataaggtggacgtggatgggctgaatgtttacacgatgaaaatgctcgtgtcaaatgggccaaattgagaggttatatgggctgtgaaattcggattatccgccaaaacgtttatcggataatccgcttaaaatagcggataatccatatccgccggatataaccgataccatatccgcatccgcatccgcatccggccggatatctaaaaacccttaccatatcctcacttcggacggattcggagcggataatatccgtttcgttttcacccctattaattaggcttaataaatttgtctcgcagtttccttacggaatatgtaatttgttttgttactagattacgtttaatactttaaatatataccgtatatccgatgtgacaaacaaacccaaaaattttccccaactaaacaaggcctcagtaagtttacttcatgatctgcccccaactaaacagggccactaaattgatcgagcagtggctgacatggaagcctgctgctgctcctatggccggaatggcgacgtggccagatgggccttgagatataagatggtggcctggcccaatggcaaagccaattggattaccagaacagaatcatcaattccaacgtggcaatctcggtacgtgattacctcgtgatgtaagcaacgaagtcatccaggtctttgcgcgacgaccgacgagccggcggcggccacggaggcgcggatggcatctccgagctcccgtgcacgttgtcgcatggctactcctccgttagaaagcatggcctcctcgatggcttcctggatgtccttcgccggcgtgacctcgttgtgcttctcccatggccgcacgaggacgccggccttgaggtacttgcagaggagctcggcgtcccatggctggtcgcagtgcatgggccaggcaagaatcagctacccgtggctcaggctctccatggtggagttccagccgcagtggctcatgaacgccgccgtggcgtcgtgcgccaggatctccagctgcggcgcccacccggtgatcaccagccccgtactcccttcgttgtgctgcgtgaactcgcgcagcagcttcgcgtggcggctgatgatctcgccggagtcctccgcgaatatgtctccgcggtcggcgtcccgcaacacccagatgaaccgctgattgctgccgcgcagcgccgatgcgagctcttcgatttgctccgctcgcagcgacgatgtcgtgccgaaggagacgtacagcaccgacgcagggggctgcttgtcgagccagtccaggcactcgtggcgctgccgctggtcgccctgcttcgacgcgttcccgtgcagcagtgggttcaacggtccgacggcgaaaaccttcttgccgtcggcggccaggttccccgcgacgacgtcgatgaactcgccctcgagcgcgcgacacgtgttggtcaggatacctctgggaggcgacatctccttggtcgccctcgtccgtctgatgtaatccacgaactcctccgttgcacagtcttccacggtgatgttggtgaggccgttctcgcgcaggatccgttggtgctcctggggagcaatcctcctagcgagcatcgacacggccaagcagtacatgacgaacgcctcgccgttgcgcagccgcgccgcctcctgtgcggcgaagtcgttgatgcggtcgtacacgacgacgacgcggcggtaggaggcggagagcttgtcgaggagagccgcgagcggggcgggcgcgccggcggtgtaggcttcccagaggggcatgaggtgggaggggaagggcgaggcggcggcggggtcgggaggcggtgaggcgtacgtggagatgccgaggtcgtggaaccggacggagcggagcgccgcgtcgtccccgccctgcacccgctcgcgggcctggcggacgtgagccgcgggcgccgcgtagtgcacgtccaccccgccgcgcgaggcgagctgcagcgacaggtgcaggagctggttgaggtggccctgcgccgggaacggcaccgccacgacggccaccggctccattgtaggctcgatgactgtgctcaaccttgatgggcagatgcggctatatgtaggctgcgggcactggcgtttgcgggtcagagtgagctcagccagtggtgaatcaaaaggcaacttggcatccgtgtggaaatgggttgcaccggaagcttccgctgcaccgctaacggctagaattgctccgatgcacagccgactagcaaataatattccacagtccacccggctccattgtgtgtcataccaccatttttctgcgggagaggattctaataactcgagtggatgtccacccgtttattgcatatgaactagatggttatgaaaaatttttaaaaaaattgacaagatatatcaatatgtaatatatcactccacaaacatgcaagttcaaattcaacttctacaggttgtaacaaaaataacaaatttaattgtaaatatacatatagtaatttgagttttgtttgttacaacttgtagaagttaaattttaacttctatgtttatgtattgatatattacatattgatctatcttattcatattttttttatttttttataactatttagataacatacaataaacgggtgaacgtccactcgagctgttaaacagtttcccatttttctgcgcctcgttcggcggcctatatatgaggttattttttcccaaagacaatgttgtacgtagtactacgtatatgcttacgtgcagacaccaccatacacatccatccatccatcctctcaagcatgcggttttgccggctgcagattggaccacgtggcaccgttaaaagttgagataaatacgagaaattacgaatggtaaaaaactccacagcggtaatttcgggtgtttggtctcgcgcggagagtcacgtccttgtcaatctctctcgtggatgggcttgatcagcccatgagcgtagccaggagccatgttggcccatcactatgcgtggacagtgcgggctgagccaacctcgtgcagtcgtgctgagctgcccagcctcccacgcacgtgggatgtggcttagccatgttggtgcacaaacattgctacgggctgaacgccaagccttgtggacagtataaacatgttgcagtatcaaatcctaaaataataataaagaagtgtggtattttgaaaattgaagattaaagatgtaggtgccaaaccaagctgttagggcatccacaatgtacttcaaaattaagtagtccataagcaatataatatttattcagctacctagcaacattgtggaattagtccataaaaaaaaataacaaaagctacccataagcatatgggttgcccatagagaataaaatatattatttgtctctatctcttctctcctactaatactatttgctatccatatagtttgtgaaggttacaatagttaaagttcatatatatgggtctcatctctatagactacttttgccatatacattgttgttgcccttagcatcctgtattatcaaagtaatattaacatacaaaccataaagtagcaaagcttttatccttccttcaaataacaaataaaatataaattgtaaattgtaaaaacatttaatgctaactctacgagttttactgtttagggaagtgtggatataaacaactccaagaaatacaatgggtgaaactgaaattcctaacaagcaagttaacaatgatgttatcctatatctatattcgtagagaatgaaaaaaaaaagaaccagagaatgcaaaacaatcagtactagtatatgtattttcttataattccccaaattcaaacagattatatgtaaatactttcaattcacaaaagtggcaaaagattccaaaaatacagttttctacattaaactaactaccaccttgaatgctttttaagcatatattactatcatactttcatttttttctcttcataattctacaaacatgaaactaagaacacactaaaacatacctttaaaagtatggtgtttataagaaattttatgagtatgtaactaactgctataaaaatgtaaattccaaaaaagatttaaatagcatatatataatctccaacaaataagataagacacatgcttaattagcgatcacgccaacaagcgcgcctatcttctagtacatctttctattattctatacacattcgtgagtatttctttctaattaatatattttgattttgaagatgtggaggctaacggtgaatttttgagctccactaaactctattaagatccgccatttggaccttcacatttcctaattgttatttccaattttttcgagtgccgggggtatatgttcgtaaataaataataacgtgtttctatatctgagtaagattgttcagaaaaaaacaaagactctgactcaccaccctcttccccgctgcccgccgaccttgccgctggtctgtcaccccggatctggacggcaccttctccgctgcctcggtgcacctgcccgctgtagtgtcctcgggggaaggaagggagctccgccgttgtgatccttgcggtcagctggcttgtcggtggcctgctcaagcagcggcgatgcggagaagaggagggaggtggcgggcgacgcgggcgcttggtcgccatctgatggggctggagcgagacacaggtagtcaggcagttcccttgaaaaaatatatatcataccaccgttcataaatataatcactttaggttgtttagcgaaatttgaagataagagaaaatattagttttcagtgattgatcaaattttaaatttggaattgttagtatccccctggtaggatcctcatagtctgaaaataatttgaatccccgtaaattgagatcagtatttcagaaatgcttatattgctgacataatttgaattctacaaatacttatatttgataacagagagagtagtacatatattttcctactgtgagcatttttcaaatttaatatattttgacgaatgattcaaatctactccctccgtccagatgtgatacatcctagtactacgaatccggatatacatgtctagatttatagtgctataatatgttacatcatgttctagatttgtttttaataggacggagtatagtatatccgaccgctcgaagaattagagacattcctgcttcatcttgtgatgtagccaacgaagtcatccaagcctttccgcgaggacccgccgtctgccacagacgcgcggacggcctcgccgagctcctttgcccgccgccgtattgtcatccctttctcaggcagcatcgcctcctcaatgacctcctggatggcctccgccgggaccacctcgctgtgcttctcccatggcctcacgaggaggccagccttgaggtatttgcacaccagctctgcgtcccatggctggtcggagtgcatgggccacgcaagaatcggcttcccgtaactcaggctctccatggtcgagttccagccgcagtggctcatgaacgccgccgtggcgccgtgcgcgaggatctccagctgcggcgcccacccggtgatcaccaaccccactccctcggtttctgcggtgaaccgggacagcagctccgcgtgccggctctcgccggagtcggcgaatatgttggcgcggtcggcatcgcgaagcacccagatgaacctctgcttgctgcccttcagcgccgcggcgagctccgcgacttgatcgccacggagggacgacgttgtgccgaatgacacgtagaggacggacgccagcggctgcttgtcgagccagtccatgcactcgtgccgcgtctggcctggcgtccgggcggtcgcgtcgagcagtgggttcagtggaccggccgcgaaaagcttcagctctttgaacatcgggtgcgtcgcgatctcgtcgatgaactcggcctcgagcgcccgggacgtgttcatgagtatgccggagctggccgcgttctcttcgtcctgctctgcccggctgatgagctccacgaattcctttgtcatgcaggcctccacggggtggaacttgaggccgtgctcgcgtacgagccggtgctcggggtccaaccacccgatgttgtacgacatggccacgcactgcagcccgaacgcctcgccgttcggcagacgcgccgcctgggcggcggcgaaggagttcaaccggtcgtacacgacgaccacgcgtcggtagctggccgacagcctctcgagcagcgcggcgagagggacgcgcgccgcgacggcgaagctctccagcatgggcatcaggtgggacgggaagggcggggcggtcgggtcggggggcggggactcgtaggcggggacgtcgaggtcgtggaagcggatggagcggagcgcgtcggggtcccagccgtgcaggcgcaaccgcgcctgccggaggtgcgccggcggcgccgcgtagtgcacgtccagcccccgcgacgcgagcagcagagacaggtgcatgagctggttcaggtggccctgcgccgggaagggcaccgcgacgacggccaccgattccaccgtgccaatcgccatcgagtgctcttgtcactggttgcttgtttatgcttgtctatttctaggatttttaatgccccgtagcctatacacttttacaggttatatatagagttataggcacacacgcacgaacagtcgaagacaaatatgtggggaaaaagttacatcagtagcttccaattcccattgctgatatcgcgcagatccagagcatcagagattcgagggctgacacggacgcacatctgttcccgccccctcgcgctcatccgcccttcctagaatgctcgtcagcaacaacggcgcttccagccgctggctcaatcattgtcagagactgcaggagcgtggcgcgctcgtcatcagtgacgactaacgacggcgtcggcgggccgatcgcttgtatcgcggcctctccaaaacggtacgtaccgccctgttgcggctctgcgatgatatcgttttgtataccattttggcatgtgctctgtatctcgattctcgaggcagagaagttgttggttggttccagggaatcttactgtttaaattgtactacgactaatgcactgttgtcatgtgatgttttagttcactaatagtatatgcacttttggtgcattagttaaacttgcagcaaattcatgtgtggaactgtggatcgacgaccagggcgtcgcacatcgcacatcaggctgattggatactacagtactactcccgtgcgatgaggctcttggaccagaccggcctccttcttcgttacgtacgttacgcgaagatgccatcgtccggcagtcggcagagtcccagagattactacatagccgttctcaccgtgtggtttgtttcttcctccctcgcgcgcatgcagcaaacgcgaagaatctaccgcacggtccgcaccgcgtttaattttctgcatggtcgtcgccgtccttgctgcggacccttgcctctgcgtcgttgtccaaattgggtgccacgaaaaaaaggcccaactggctgatcaccacttgccaattgtaggtcgagcgccggcaggcaagttgctcgactgctgcacttgccaacttgcatttattgtacttactcctatcctacaaaatgtatgtcgttatagcagtaggggtaaaacgattatataaaacgaaaaacgagataagttattaacggatgattagggttcaattcattttctaactgaagattattactggtacgtaaaatgagataagttattaatggatgattaattaaatataaactattataaattataaaaaaatatataaatatacctattgtttaaccgttcattaagaatgttaattgaaaataaggaaaagtcaaaacagagatgttgaaacgaactcaaccttacaaaatgtaacaaatgctgtactattttatgggggttgctatatgttttttcgattttttttttgcgctctccccatttgctggcgcgttttccttttctcgatcttttaatctttagcgagtgtttttttatttttaatgtattttacaatttagatattttatctcaactttcaaaacattctatttaaaactttcaacttaaaattcaaaacttaaataaatcttgagttgaaagtttttaaatcttaactcgaaagtttaaattttgagtcaaaaattttcaaaatttgacttgaaagttcaaattttgagttgaaagttttaaaaatttgagttgaaagttttaaaaatatgaaatgtaagtttatatacatgtatgtatgtatgtgtgtgtattagtagtgctatttgtagtatagtagtagtactactaccaccaccacctagcagcagcaacagcaatgctagtagttctagctgcgcgtggggcccactagtagcagcagaagcgctagtaggcgctagtaataacagtagtaatctcttcatgttgtaagactttcaagcattgtttatattcatttagaagttatgtgtctagatttattaacatctatatgaatatgggtaatgctagaaagtcttacagaggaagtagtagactggtactctagtagtagtactagtagactagtagtagtagtaggagcgaactgttcatgtgcccacaccctgcgcgaccagtcgcgcattagcccccccccggaaaacttgtctgtcggcctgtacacgggccacgtgtggaggggaggaaaggaataagttcaccagccgtcccttaagctttatgtcgagtttgtataacatccctaatccttaatactagaaattttcactcctaaactatataaaaccgtgcaatttatatcttatagcagtactgatctctagtttcacttacgtggcatcctagtaacaaaaaaaaaaattataggacccatatgtaagagagaagaagaaaatgtagggtccacatctcttattttttctcttttctcttttcttttctactctctcttatcttcttcagcgagcctgggaggccgtcggtggcaaaggggggagaggtggttcaacggttctgggagagagggggaggtgtccggtgagcccgtccgagctctgccaccgccttgagctccatgcgaagggaggagggaacggggtagatgtagagattgacgaaaatcttggcatggtagacgctggacagggtggcaggtgaggatgacatgtgggcccgcatattttgttttaattttttagtttctagttttgctcctaatgccacatcagccactgcggacttaccatgcatcgagggaccttgtttgaatgattttgaaagttgggggcctcgtttgcatgattcatggacgattttgaaactcaacgacaaagcgagagacctcgagtgaactttttcttttcaccatggtagagcaatgtgagcccattagaatatgctgggcctgttggcccgtccggcatacatctaagcacctgtaggtttttgtttagaaaaagaaaaagataagaccaaatatttcgtttcaatcaccttatatcaaattttaaattgttaaaatcccctcatagcacttgattgtctgaagatgatttgaatttccatacaatggaatcagtatttcagaaatggctactgcatacagaatttgaatccgggaaatgcttatttgagaatggagggagtggtacacatattttcctacttaggccattttttaaaatttgatatgtttcgacgtaagattaatatttatagcatatccgaccactcgaagaatcacaggatattcctgcttcatcttgtgatgtagccaacgaagtcatccaggtctttccgcgaggacccgccgtctgccacggacgcgcggacgacttcgccgagctccattgcccgccgccgtattgccatccctttctcaggcagcatcgcctcttcgatgacctcttggatggcctccgccgggaccacctcgctgtgcttctccaatggtctcacgagcagaccagccttgaggtatttgcacaccagctctgcgtcccatggctggtcggagtgcatgggccacgcaagaatcggcttcccatggctcaggctctccatcgtcgagttccagccacagtggctcatgaacgccgcagtggcgccgtgcgcgaggatctccagctgcggcgcccacccggtgatcaccagccccactccctcggtttctgcggtgaaccgggacagcagctccgcgtgccggctctcgccggagtcggcgaatatgtcggcgcggtcggcgtcgcgaagcacccagatgaacctctgcttgctgcccttcagcgccgcggcgagctccgcgacttgatcgccacggagggacgacgttgtgccgaatgacacgtagaggacggacgccgccggctgcttgtcgagccagtccatgcactcgtgccgcgtctggcctggcgtccgggcggtcgcgtcgagcagtgggttcagtggaccgaccgcgaaaagcttcatctctttgaacatcgggtgcgcggcgatctcgtcgatgaactcggcctcgatcgcccgggacgtgttcatgagcatgccggagctggtcgcgttctcttcgtcctgctcttcccggctgatgaactccacgaattcctttggcatgcaggcctccacggggtggaacttgaggccgtgctcgcgtacgagccggttctcggggtccaaccacccgatgttgtacgacatggccacgcactgcagcccgaacgcctcgccgttcggcagacgcgccgcctgggcggcggcgaaggagttcaaccggtcgtacacgacaaccacgcggctatagctggccgagatcctctcgagcagcgcggcgaacggggcgcgcgccgcgacggcgaagctctggatcatgggcatcatgtgggacgggaacggcggggcggtcgggtcgggcggcggggactcgtaggcggggacgtcgaggtcgtggaagcggatggagcggagcgcgtcggggtcccagccgtgcaggcgcgaccgcgcctgccggaggtgcgccggcggcgccgcgtagtgcacgtccagcccacgcgacgcgagcagcagggacaggtgcatgagctggttcaggtggccctgcgccgggaagggcaccgcgacaacggccacggattccaccgagccaatcgccattgagcgcttatgtcgtcactgatatatggttgtttatgcttgtctaccttccagaattctagtgcccagtagcctctagacttgcaggctttatataggcacacaataatgaggctgtgtttagttccacgctaaaattaaaagtttaaagaaattaaaacgatgtgacggaaaagttaaaagtttgtgtgtgtaggaaagttcgatgtgacgaaaaagttagaaatttgaagaaaaataggtgaatagttaatttagcccctcaagtttcagcgaaggctcaatttgatccttcacctattattttgtccacatagatacttcaaatatttgttttggcttgaaatcatccttggatccacttaatatgccatatggctatttctagtcaatatttctattagaaaatgtcctttttgcccccaatttatatacatctatatactagaaaagagaaagccaacataaataaacaacattacagatctacttcccattatttcaacatgtgcacatgaaacttaagcaattgctatcgtatacacttgctaatacatatttttttttcgttttacataatatactatgtattatctataaaaaaaattcaagcatgcaatttctctcttatatatgtgaatgatgaggggtataagtatcatttatgaagagagttgttggttaaggataagtttgaactaaaatgaaaacttgaaggactaatatggatagattgaaatatcaaggactaaactgagcctcagatgaaatttggaggaccactttgcctattcacccaataaaaaatattagaatctaaacagggcaagagttggagtataagagccccatcggtagaactaaaaatcaataagcaaaagtcaaaatttaaattttcaaacttaatttttaagtagcatattcttataccagatgtgacatattcttgtatcacaaatatgaatatatgtatgtatatattcgtagtgttagaatgtgtcatatctaacattatagtttggttttttatgctactgagggagtacaacagtagccgttctcagttctcaccgtggtttctttctccctgcgcgcatgaatggtgcaaaggcgaagagtcaccacgccgcgtttaactttctcattctcaccgtggtttcttcctccctgcgtgcatgaaccgcgaaaggcgaagagtcaccacgccgcgtttaactttctgcatggtcgccggacccttggctctgcgtcgttctccaaatcgggtgccacgaaagagaggctgagtggctggatcttgtagtattggctgactgttgctcgctggtttaatttgggagtttaggacggtagcggctggatgagatggagatagccggacagggaggtgataccggccggatatatgacactgccgggagatttcgacatttattttgtagaccttgcagttgtggataaacggaagtagcttgctgcaggctgcaccgtttgattgattggaagagtgtggcattcaccccatctcaatcgatccacaactgctatttattggctggagttacgtttctgatggagagatttaaataaatgtatcaattatgtcctgcacatcagcatcattgggtccatagctcagtggtagagcatttgactgcagatcaagaggtcaccggttcgaacccggttgggccctatttaacaatttcacatttttacttttgacggtgaagtttttttttttccacagtgattttgttgctgccctggcctatgtttgacggtgaagttttttttttccacagtgattttgttgctgccctggcctatttgagctccaaaaggagagatccatggagttttttttccacagtgattttgttgctgccctggcctatttgagctccaaaaggagatatccatggaattttccctacaatctctttgttgatgttctgatgaagccgcaaacgatttacatttgacggtgaagcttttttttttccacataagcccagttagggaggtgattttgttgctgccctggcctatttgagctgcaaaaggagagctccatggaattttaccaacaatctctttgctgatgttctgatgaagcggcaaacattttttcctacatttttgtcccgatgatgctacaaacaattgaataatagcccactagagaaactatattttctaaactttattttcattgtggctaaatttgtttcccattccagaaggagccacaaaagactaaataatagtccactagaaaagttatcttttatacaccttatttccctcgtggagctacggacgttgaataattttctttcctgatggagccacaaacgtttgaataatataagtgaaagtgatcattgaaaattattattattttcttcttcttcttctgagaagatcgctgcaatttttccgcacgtggtgcttttggcctgtaggagatcactaaaattgcttgtgcatggtttcgtacatcttttttttttaaggaatcaacatgagattgtactatttcattatttcattagatatagacgtaaaaaaaaacttcccctagaagtaaaaaagagctgtacaaaattacataagcgccgtagttaagttgggatgaattcttcaagtcgccttgcgcttaccattatccaggttcttgcctcttcctttatttttgccataaggttggagactgccgttttcttttgctcgaagatcttttgattcctttctttctagatttctcaggctatgagtaggattaaggatcataactctttcttggacactttttttttttgatagtaacctccaaaacagttctgaggaatgttgtgcacagtagcacggcaggtaataggaaccccaccctgagcatagtgccgtggtggcgccgtgcaaacaaagcttaaggcctattcgtttttgaagaatttcaaatgattcagattcttgaggattaattcctctgaacgctatttagttcataggaatgtagctatagaaaaaacaaagaaattttcctttcctacaagttgtaaagagaaggtatagtgaatttttcatccactcagaactcatggaaaagttcatatggatagaaatgtgtatgcattcatattccttcatttttcttttttctatgtgtcataattccttcaaaacagatctacccttaagggtccataatgtgatgaaaaactaggtattaagcattgaatgcactcttgctaccaggtggcaaccattgtaaaagtcataagcaactaataccttatcatagagctactaccggtacataagaaataaatatcatcatttgtacagtaaatgagtagtagaagtaaatctggcacatgcaagtaaaatattagtagaagaaaccatggagtcattgtttcgcaccgttcacaggaatcaacttttaagtggatcctaccagtagcgcaggtaaggggagtgccaaagggtgccaacacccccctatccaaacactaccaccactatacccctatgtttttactctatattaagttagctaagataagtatctatctagtttattttgtgtagcttgaaagtattatcagtttagttagttagcaagtctaaaaatattagcaagaaacatgatttacaaaactagtttgtgatttctcatatttttcaaagtaaaatagatgatacttatttgtgagattattttatagtttacattaaaagaatttagcaataaagactagttttaaacttccaatgatattattaaagagctaaaattcaagtttttcttaaagaactagtttacatattgcttgttattgacggtgactatttgatctcctttactatcaatattagttatttggtctcacggtttatctttatcccacaccccctaatctcaaatcctggcttcgcccctgatcctaccttacttctcactcacacaaataagcattgtgggtaacttcatatactactatcacctgtatcttgggcccacgttactactgagtctggcaagatacgttgctcatgccctaaaagaaacatatcgctgcaacaaagtgacagatgtaggatctggctagaaaaaacatcacaaccagttcagacatgagtaacatagaaaagttaagcccggccatcgtggccgccgcagccgccgccgccgtcgtggtggtggcaaccattgttatccttgaagtcaccatcgagcaccgccgccactggatccgtccccttcaccatcaccgccgccgcagcctccacctcctttgccaaagagatggaatatataagctagtatatcatattcttgcaaaaaaaaaagcattatcacaaattccaagaaagatataccatcccaacttcaattttagcaacaactaaaggcatgttcaaatcactgccaaaatgaataatgatatggtttagaaacatccatatatttattaattttatcaataatggtatgctttaaattggcatctatgtgaacggggccctaaatcactcggtccgtggagcgaccggtgagtcacgtgactcacgttgacgatcgttgccttctgcggacgcgctcccatccggcgccacctccgtagttgccacctccgcggaacgcttctcgccatcatcgttgcaccgtactgcgtcggagcacggctgctgcggcgcctgcgccggcggcgtcatcatcagccgttcttgctcagctgcagcagcggcttgagcctgatcgatacgtcgttggcggaagagctccttcacgagctgccaaagcacacgcctcgcgtgcatctcgggcgtctcctgcgcgggccgtggctggacgacggacggcgacggcggtcgtcgcatcaccagtgtccgatcaaaggagttgccggagttagtaggcgctgccgttgccgggcgaggacgcaatggcgtcggagggacgttgttgaatggccgcgcctgcggccgctgcacatgcgccgggcagttgcatgccgccggcgcccgttgcgccgacgacttcgtctctccgttttgttccacctccgccccctgcgctggcatcatcgcttgcggctgttgtgccgacgtcgtgtgtgccaccacctctctcccctgtagatgctgcgcctggaggttgtacgccattgccgcctgctgctgctgctgctgttgcagaagcatctggtgatactggtagttgttgtacgccgctgccattgccgcccgctgtcgttgtaccggcgacatctgtccgttgcttgccacctgcgatccctgaacaacaagcgcctgctggccgttgcacgccggcggcggccgttgcgaggacgaggcctgcccgttgtctgccaccaccatcccctgctggccattgcgtgccgccagctgttgcagaaacatcatttgccgtctgttgtttgcggccgtcgccatttgccgtcgcatcatcatctggtcgccgtataccacctgcccgttcggcattcgcatcgggccattgaccgtcgcgtgctgccgaggaggaggcgccgttgcgtggccggccggacgtgccatcgggtgcccggctcgattgtcgtgcacggccgttctcagcggcatttgcatgccgccggcgccgccgatgtacgacgcgggcggtggcggcggcgctcctcccatggtcagcttccgctgctgatgcggcctctgcgccacggcggcgtgctcctccgcaggcctcttattgcccgacgcctcttcgctggttcccattgccggcccgggctgcggcgaggagaattctccatcggaagaggcgatgctggcgattgcttggggcccgggctgcggcgaggggtgctcgacgagctcctccttcggctcgaaccggaacccgagggggaccttctccttcttgtctcctctgccaccggtgcccctcttctcctctccttctgccatatcggctattcaacctgcccaatcgaggttgcctggataatggctcaaataaatttttataatcacccgacgttaagtttgcaatttgagatgaactcaaactctatggatggcaggagcagctggagtccggaacaagacgggtttgattccaattcaattccaattcaaatcggtaaggaaacggtaagaacatgagcatatctatatttatacctataattaaaaaaatacgcaaggtttccgtaattttttttatttttcaccttttttctttttcttttatcatttcctttttttctccgtccttttttttctttctgtccgcttctttttttttcttttttatccgtcctttttttctttatttccgtccttctgaacctttttattttttttattttttttctgtttttttccatccattgtttttttcgtccgcctttttttcttcaccttttttctctttttttcatccacagtttttttacttttttctaggcctttttactgggttttttttcatactttttttctttgtttatgtttttttagttgcattttttcgcatgcggtaaggatttttttacgtgccatattttttttgtcgcccggtgttaacagtgaaatttggtaagtccggagtagtcatcggctttgaagttctgagattagccgatgagagttgtcaagtcgtcagttgtcggattcttgctatattcggttaaggagattgatctactaaatgaagcttatccagaaaagaccgagttcaaagagaatgcggcatggcaagttatctattaattagaaataatttgttagtttccttttatctttaggaaagtttctttcttgtccggcaagaacttgtatcaacacatgggtataaatatgtacacccggggtctatgtaatctatcttcacgatcaatacaattcggcgcatcgccaccttttaccttttctactttattttatcgtccggcggaacttggcacctgacgcggggctgcatcggtgttcgatctccggctaaggggtaagtccaatgtttcgctggcccgggcaattgtatcatttacgtcggcgtcgttcaaggctgcatcagtacattcgacctctttgattgctctggtttggatgatatatttgcctacctatttatcatatgtctatgttaatctagtcttagcatatcaatttagctctatcgactgcttctctttttagggtttctgccggtatcggctaaatcgcgttgttagattagattagcttagacatctaccaccctccaccctgaaaactcagtcaacggcttgattgcctagatattatgtttcttttcatacttagtgctgcatcaattaagtttgatctactaagtcgtgtttagaaccataatctctaggctgcttcttgattgccaataagggtttcatcgaggtttcagccaatgagttatctggatgttgcatcagctcataaggattgtatatacatataagctggatttagccgatgacaacaaaggtttcactgtttaatctaatcttgtggatttcatgacatcagacctccagccgatgtgtgctctaaccttcggatcgatgcttatttatcatatcattatttgccgattggtttatactggattatattgttattttatttcatcatcatcagccgattgcctttatatcattatctacattggacatatagccgatcgcttaaaccctatcgctatcggctggtatcggcatcggctattatcggctatcggctggaactactccatcggcttgtcagccgattggctgtttgatctactgtttgcatatcttgtcagttgcaggatcaaactgactggcatggctgcatctcatcaagatttggacctgcacaggagctaagcagatctcccaggccggtgtgttcaattttttcgtcaacacccggctaaacactagcgccaccacctcgtcgatctgccttcccatgcgttccctcctccaattgattgccaaaaatcaattccccgctactccctaaccattttactatgatttccccttttaactccgctttaattcactgaatttaatctccatttaaaattcaccctttttatcccgagttttgtcgcttcgattttaataaaaacggaaagaggatatctcccgagttttgtagctccgattttaataaaaacgaggggattgagtgtatcaaaaaccctcaatcaattttggaagatcgagaaagattcaaccggatttgatggggaggatttgatcggatttgatggggaggatcggttttggcatgtacgaacacgacattgtcttacggaggttgaagacaacagtcggctctgcgagctggacctacaactccagttgacaaggaaggaatgaaatgaacttttggtacaaaatcaaagagtaaaatgtatagcgatccaaaaatatttctacccgttgcaacgcacggatatttttctagttatataatagtgggcattttttctagtttatataatagttttaagaacctcagcatatatgtacttttatggcattggatttactatggataataattaaagtttgattctgaatactatgccaagtcaaaccacgcgttataatttgagacatggcatagggagtactgtatcattatatatgcaggggtgaaaacggtagggataaatatcataaattccggccacagatcgcttccacattccaccagccaattcaatcagccatttcattaattgtctaaaacattgttgattactacaccggtgtatgaaaaaatgaatttaaacagggagaagcgacagttgactctggcatctttaggacctgactaacaaaacaaatcagctgcacctgcatgaggagaatttcatgtacaatattgtggtaccttgggcctagtttgaaattattttttccaaaacttgagttgaatcttgaaagcttgtaagcaatcccttatttagggtgatttctgttttcctgcaactgataatcgtctggaaggaccatacattggagttttcagcagcacacactgaagagcacttcggacgccgtccactgccagggtttgagcaagattgacaaatataagcgacaatatgaaatcagatacttccttgtaagttgccaaaaaaaaaacaaaaaacaaaggaaggaaaagtagtcggacacttctaacttgttaagcaagagcatacatcactatatcagcgttgccatgcgcttacattacttgatttttccatttctgaacagaaaaacatagcaagagcgcttggctcatacagtttactacaagaaaaacatgatatctagtggtgattgatcctgtagggagcgatcaaaagcattcaaaagttgctttctattgatactaccatgccttaccatgtcatatatatcattctgaggtgtcatccgctgctcaataatatcggatcggctaccagcaaataattgtgctattgtcccaggaatatctgaaagtacggtattagtttgactgcctttacttgttagattgctggggggtaggatcatggcatttcattttgcagattgacgtgccaaccactctgatctggttaaaccacagtaccttgtgctacttccaggccacataaggaaattccagccaatgggagatccaccgacaatataagatccttgcaaacattgtcctgatttctttgtagaatctgttacactcggtttggcatcatgcttaatgtccacaggattgagtggtaccttctcaccagaactatgcataaaggatgcagcctggtctgctggacgaacttgattcttctctccgggtgggattttccctgcaggcatatttctggcatctcttgatgtaggctcatccatcagttttacaggcccagctgcagttgggagatcaagtcgcatttccttggataattccatgagaacttttatctctgcatagtgtgaaccaagggaagattgcttaaacttatcatcaataaacacatccagatataacattaagctccaggtgctcaacagattttgtaggccaaacaacagggatccactttggttgaccttttaactttacagataacatgtacattttcaaattgctaattatgattgggctaatgcaggatattatgaataagtacatcagtagccttttttacactaacagaatgaccgactaatgcactatatttcacttacttactaatgtagggtactaggcatcttattattggagtatgtaaccgatagttatgcttgcattaagaagcctaatacaatacatcatgtgacaatataagtaggaatttgtaaaagtgtataatgactataaacaacatgtttacaagttatagaaatgtaacaactgatgaaaaattgcaagtgtccaatcacaagggttttagatatcttaacagcacgaagtgactatggactacatctacagagaggcaatgactgtcaaatcacctgaggtaatcttagtgtgcaaaatatcaagagagaagtgtgcttttatgaaagaaggtgaaagtaaaattgttcgagtgatcaacataatctcctataccatactgatttctgtacttgcgagcatgatgataaaaaatagtcaaaaactcaaaatgtaatcaggacgttccgcatgtctgttcaaaaacaatataaattaggatttacctttcaggatctcaagagcggcatctttcttttgggtatcagtgcctttgcataacttcaaaacaacaaggaaaaagtaaacattttagagcggattcatgttcttcccagaacaaactgcatttacaattgtcaaaccaacagcaagcagggatatcaatttggtgtaagttatgatacaataatatgatttttctctggtccttgggaggtagagaggtatttttagtgttaatcgggaagtatagtctctactgagagcgaggtatacctcttgattaacaatatggggtaaaactctcaatacctcccaaagccacacatcagccatgaaaatgttcatttgcatagtaggacaatggtggcattaacaactcagttcagaatcatcacaccataaatttcagctagaaagagattacgcgcctaattgtattgagacttggcccaaaattcaacttcaactttaatttaaattctcccagagtttcaccagcaagcacagcacggagcaaatagcttcgagctctcgaactcgaaccattgatcacacttatccacgtcaagcaaaatcatcccatacacgttgcgctagaacacgggaacatgacctgttcagttgattgtgctgctgctgctgctgctgccatggcagagcagagaaatgccactcaacaaatatcttagggttcgaggtgggggagacctgaatgaagcggccgcggaggttggcgacggctgctctgatgttgtagtagggtgagtgatgaaaccccacctcctccagcttccgcttcttcggtgccgcggtcgaagacgtcggcggcggaggcgggggctttgggtcgctggtaggcgtggactctgacggcggcggcggaggaggaggcggggtggtggtcgtcggagcgaccatcgcggtagcggcggagcgtggggtttttctgcaaccttccctgcctactttggaacaaaggaatttttatcccctctatctcaagaggagtgtcagagcattagcggtatatagatatatagaacaccattaatattaaataaaatttaaataatatggataagaaaacatagagattcgtctgatgatttttatacaatatataggatgcatgtaactctatagagcccaagtccaataagtgttaaggtggatgtttgtaaaaaatatcaattttttatttgagatatcaggtctaagcaaagagcccatttgctccatttggtgcttaagatctacatttacaatatactgataagattcccttaggatatcccaataacatggttcatagataatataatattacatcagtcatacagtaacattgtacaataaatcaatacgaagaaaataatgaaagatatccattgggctattcggcaagcggacaacatcggctgtggctatgctaccgctgcgtgtgtgcggcattgttggtgcagctacagcgcaaccataaatctagtagccaaacaaaccctatatgcatatggactacccatataaaataaacaatactcctattatctatctctcctaatgttatctcgtgtatattactatatttaaagtccatgtatgtgagtcccatatatattaatcactttttgctatatacattgctgatgctgtgattactcttattcccacattgtagatactgctatactccctccgttccataatataaaggattatgaccttttacttgtactgtttgaccactcgtcttattaaaaaaaattatgcaaatataaaaaatgaaaagttgcgtttaaagtactttggataataaagccagtcacaaataaaataaataataattctaaattatttttgaataatataaaatcctaaaatataacactttttagttatgcatataaacaagcaatcacttattcatatttcttaccgcagaagcttatatttaaaatctgctttgaggctttttttggaacaacatattattgaaagaatttaagaggtttgcattcctctagaaattttccgtatagacttgtttgagacaaaggaaagatgttgaattaataaatgcatcaagaaaaaaaaaatctcacagctctttaactgtatggcgcaaaataatcgttggacagctgactatggcaaaataaccggaactggttcgacacaacttttcatgggcctctgggcgcaccgctcacacatgccgatacaacttcccatggcccatcgagaaccgcgagcgcctcaacttcccctgggcctccccgccgtttcgtttccgttctgctctcactgacaaagtggcccacaccgcagcaggccccacctgccattgtcgtgcggagaccgtgtccgggacgaactggagaggcagccgcccacacggccacacgtctgtcggcttatccgggtggggaagccatggccattggccaccaccacccaaggggagcgcaagcgcagaggacaagagcgcctcctcgtctggtctgcttcggccccccgctcgctcctcctgccgaagcactcactcttcggctgctcatcctcctcctcctcctcaggtcagcaagattcatccggtttcacttggattgtctgggatttggtagttgaagcatttggctattcttgttttgcgcatgctcctagttcgtctgcgtgggagaaaatactgaaaagggggtagttcgtgtgtgtgtgtgagcatgccccattgtttggcattttgttggagctgtatatatgtgtcattggctagaactttgcaatgtcactacctgcttaagctcagcaattgtgcttcagttcgtgcaaccttttgtactaagctgaacttttattttttcctctcctggtacctacaataaccttgtctcagatgcaaaaggatctctttagtaaaaggcactttgcttcatgtagtattattgctgtcagatgctggcaaacattattggggctcggcattcttttctttctcgaactcaaattagcagtttggaagagtgcgtcctacaagtagcaatcgtataccgcaatagtgtgaagtaagttgcaaatcaaatgcatatggcaatctagtatattgacaacttttgccgctatgcaagttttttgggagaacttaagctccccaaatataagttgcacgttttgcggaacttgcattgtccaggagaacccccaacctcccacaaaaactttgagtgacttaacttaagattgatgatttatagggccttctgttccctctaatatagttgcgcatttttgtacttgtactgatttctttgtttttaagacaggtcaagtttgattcttctcttgttctctttgttctttataggagcagaaccagacttgccacgaaggatttgataatctaggggttcgggacgagatgatattttcagtcagcttatttggtagttcccaccagtccattcacaaactttacaggaaatgctggtcaagtaactcacattctacactgaatgtgctttcacttgcaaaaactgtgggtcaaagtatgagaatgaagaggatacgtgtcaagcctcatgccactgacctgaagaatcgcccccaggcccatgaggataatgtgttctacaaattggtttataggctccctgaaaacctcagctggctgttggcgtcaccagaaatggctagaagaccaccctcaaagaagaaactaaagaaggaagaaatggtaagtagtaatcaatttggtgtgatcttggagtgggaaggagttgttgtggaagatgatgatccagatttggagcctcgagtttggtacgtgttatcacttgaagaggcaaagtcttttcctccagatgcagtgctgaaggaaattgaggggatgaggactgatcaggctattttagaagtcttacattggtcagaagatccacaagaagtacaaaggctggcagcacgcaaggaggtaatatataaaacattacgtggtagattctaccaactgcgaccaggtgttcttgatttcctgaacacccttgtggattttgacattccaatagcaatcacaactcctcgcccacggttgagcctagaagaagggataaaagctgttggtcttcaaggctactttgatgctatagtggcagcagaggatttctgccgagggaaacccgagggggagatgtttgaggtcacagcagggcaacttggtcttgagcctgatgtttgtcttgtgctgggtaactcaaattcgacaatagaatctgcgcatactgctgggatgaggtgtgttgcggttgcaagccgataccctgcctatgagctccaagcagcaaaccatgttgtaagatggcttgatcagctatctgtcgctgacctgcaaaggattgccaatggcgagattcttgggctcaggggcagaagatctgacatggacatggacatggagattgtgatcgaggagtgatttttctatatgtatggtgtgctaatattgccctatgtatatagctccaattgcaacctaggtaatgcattacattttgttaacagatcaagctgattaacattggccgttagcttgttaactgcttggtttcttgtaatgcagaaatggaacttttgtagcctagatgctttcgatctctagaagaattggaagctaagaaaaactcccaatctgtatctcttttaccaatgtaatatataatttatatagattattatgccttgtattttgttccactccaacttttgtgcagaaatgaatggagaagatctaagagcaatactggtaagctctaaataattttctatctaaaaaaactctagataactgaaaagagttcagctgttgtatttgcgacttcaatgtttccttagaataaaaacaataatttctaattctgtaaaactagtctttgcaggatcacaaaacattaggtcaccattcattgttgtgcaggattatcttaagcaaagttacatgtggtattcctctattttcttccttcccaccagcatctataattctgagtttctataacgtttatttttccttagcaatcaggttgagcaaaactcaacaaacttcagaacatgctgagcttactaatataatgtttatttttaacacacatcatccatgatcaactttactcacatttacgccaactgccactcatgacaaacggaagaacttccgaagaagaagtaagtatgtgggattgcttgtatgcatacaaaccaattagtttgtagagagtacctttgtacgaataaattcagagaaagcatatggtggaggcaatgcagtgcccaagttcacgtgtagagcttttctcagaatcacatttcagcagatctcatgccgtcatgcagtgcttaaaaaaaatgtcgacaaggccgcatacaatgaataggtgccacattcctgtacactttaagtgactgatcatatcgcataatcgctataaggtggggtgatgaccgcataaaactgcttacactttaagtgaccgattatatcgcataaacattataggtgggtgaccgcacaaaactgattaccgatttgatacttttttggaacattgaattctcatgtgagacagtaagcgtttcttgttcttttgtatctgcacaaacgatgaaataagatgcaaacaatctactacagatttgacagccgtgctgattttgtttcacatatgtactgtcataataattaaactcacaatagtcaactgtgtaaaatgtttggacttgtttctttttttttctttccttttttttaaaagaaaaacgtcaaacttcattgctaactggaaacacatcagacatcagagtctccccagtagaaggacgggtttcagaaaaaccaagtgttgaaacttgtcgatagcccctggtttgcactttgttattaacatgctaagcgtgtctatgatattttgccttggatctgatacctttgtcttcagttgatatgcctatttggatgttgaactgcataatttgggaaatgtatcttgtacacgcaagttttcacgtgtatacaccatacacagtaactaatacataggaatagaaatcaactaattttttttagataatggattataaaaaacccggcctctacaccttgtgagggtgtacacagcctaaaagtcacaaacacgagtacataagactctcccgttacatgggtaaaacataaataagttttaaagatggataacaagtaagaggaattaaaagctaagcttcaatccttttctaaagttccacctaaaagtagagaagagctccatcatacgcttctctaaaagcttggacttcgcgattacttcaatgacttcgtcttccttaagaagcaaagaccgaagccttgacaactgagttgctttgaaaattacctgagagagggtcgagattcatccacgccttcctggacttagccttttcaagtgaatgtctcccgctgctgcccatcaacctctcgctagccctttttggtgtcatcgacacctctccaacattagccagctgaacaatcttttcctgctgcacccctgcctcattttcctccaattcctccctctctaccctttcatacacctcttccaacacatcttggacagccacatccaagatattttcagccatcatagaaaaatccatttctttcgctaaatcagcaccttcctgtgcctctttactcccttcacccctatcatgattgtcatcggttaccatatcatcaacctttgacatttttggtcccttctcccttccttcattgtcttctccactttcctctccctctacattaccatcctcctcatctccatcccaatcctccaaattaaactccacttcttccccattctcatcgactcctttcttctccacctcaaattttaactcaaaataatgatccccaattaccacatcaagcaccttaggaatcaattttgggttaaggatagccacaaacaatatcccaaaaacattctttttagtagttttcatatcaaccaattatgttgcccctaaaagagagcctactgcccataaagttaaatattcccttagtttcttccttagtccaaaaaccttaacccataccttaggtagaagaaaaccctcttcttccacaaaccactcttcaaactccaccctcactcccatggctacccctccttccttcacatctgcacccccaaagttgatggcccattgcaattcgccctttgaagggaaaagaacaacaaaagcgtccttcccgtgcggcaccggctcccacttccatttagttggacacaacttgtggagaagagtgaccaacctttccaccgaaagagcaccaccaaccacacgcacaagagccttcttcgtgtttttcttgttcctttgaagcggttgatgtgggatgtgctgaaaccctaggccttcaaccgcatacccaaccgcctgcaccaccggctttggaagctttaggactggacatttgtggttgacatgctcgctacagtcgcagatatcgcaataaacatccaccttacaatcagcaacaccatgtcccttttgagtgcacctagagcaaactttcacccgtgcaccacccttttgatcatcccctttcttgtcgctaatcacccgcggctccttatcgaattccaacaaatcatcttcatcatcatcaaactcagaaacataattctttcctttcttgacttctgaatttaccgagacaaccacatctcctaccttgatctgacccggtttcttgcttcctcctccaccttttgcctcctccttcgtctgcgtcatctcaccggtccccctgctgccgccgccctccttcattagaaatcaactaataggaatagaaattgacatcccaagatcatattacagcccttctggaaatccaatgttccagtggaggagtgatatctgggtgagcgtcaagtataaatcttttctatttaagtcgacaatcgttgatttaatcgtggaaaagggctaattattttcttgagtttttgccggttgggctagaagaatagctatggtgcagagccaaaacaaccatcctatttaaactagcgataatgatgactcaagcttcttttcctatggagaagaaggacctgggactgggagaggcagcggatgatgtcaagggagaggataggggtggggaaatagaagtggatagtgatgccaacagtgatgatcgggtcaagcaagagaagagccgagaaggaattgatcctggatgctaatgaaaacacatcttctccgtttatataacttgtttaaaaaacatttataaaacttgcccattaaaacattatacaggctggaccattgatatttcctaatggttggcctattacgctgctttgttgcgtttcttttctagtaccttatgaatatgggtaaagtgggtattattatctctatacccaaaacttaaatggatgattcatctttactcataacctcccaaaacaatatagatatgggcaacaaatacctagttgcagccacagcagaccactttgtgatgcagcaatgttctctctatgttactattcactcaatctcgttcgagagataattgaacttgtgtgcaatacacaagtcaatgagcgttagaaatgtatttcgactagggtttaggcccatgggccaagctaagcactaggattcccggttccatggctagtggtccctgagcatcttctaggaatattgggattattctttccttcgtgaagagcgttgtctaagttttagcttgaatttcctttggcaattgtatgctcttcgaattacttgagagcttcgcgcgctttatccctcaagtgtattattgaagagttttcgatcctttgaggactcgactttaggccatcgtatttgatatgcagaaatccaatggtcttcaataaaccaccaatatggtcccttgtatccttggtggctttctttagcggatggggtaattgatggggatctctactccaacacttattacttatcagctactataaaagaggagtttcatccgttcgcctttcctacctccatagcttgcatggcatatacttctcctctcctgtaacaaaactgaataacaagtaggggtgggcagaaataaaccgtggaccgaacaccgaatcgaatcgagccgaactagtggtttctccagttttcgggagaaggctcaatttttactttgcgctgcttcggtcctcggtttagagatcagttttatcacgcatgaaccgaactcccaataaaaccgaagtagtcgtcctcagcggctggagcgcgcactatatcccgtcccgtcgtgagttctgggaaatgttgctccatttgaaggatgcataagccctcataggcccattgtgtacataatgttcttgtggggtctgagcaaacaatggcccaaccagaccactagtacgactgcacctccatgggtagagacagagcgcttggttggcttgatcggtagaaaccgacaccgtacttgtcaacgagtgatactcgcggactggatgaatagagtattaaggtacgttggagcaggggtctacgtagtacgacatcaaaacagacaaaagacaagaattatactggttcaggccccttatcaagtaataaccctagtccagtttatatgtgattgatgatgatgagaacagattacaaagagagtaactgaaacaagtgataccgatgagatcgtagtcgagggattcgacgagatctcccggcgagttggttcccgtggactctggcttcgtaaactttggtgagtgtgttggtgatgagatgcgatgccctttgcctctccctaggggtcccttttataccgtggaataccttaacccccaagtaaaacttggagatatgtaaaccgacacgatatactagagattttaccctttccgagtaggacttcggaaattcctaaacttatagatatattttccataacttgagataaattcctaaagcgtatacggaaacaacccgtatacgtgaatgtataccttatcggtatattccataagtcatatgatagagggtatgccttatccgtaaccctgacagtaccgaagttattcgatttatctgggctcattttttaaaaaaattttctgatgaaatcggttggtatttttcaaaaaacgaacatccacaaaaccgtacaaaccgaactgggaaccccgaataaagcgaacgcccacccctaatgacaagctgaaaaaaaggccagaaccactcaaccaatcttatgtatagctaatataattttcaaaaaaaaataaaaaagataggaaaataaattatatgtttacttgatctattttgttgttccataatagtgcacgggtaataattaaccagttgtttaaataaatattatcatcaacgaccttctgactgtttttaaccgaattaaaaaaaaataaatactatagcacggtggatcgttggagcgaaaggtttatattaacatcaacatggtagtacatacatagcacataaagtatttcgttggaccattagtatagctagcgttgcggtcctcctgcgaaactagcttggcgaagacactagcgacagtgccaccccgtgccaaggcccaatggtcgacacatatagtatggtctacgactctactctactgcaggccaacgaagtgtttagttgtttacctaattttttttgacatatacggatacatatttaaagtattaaacgtagactaataacaaaacaaaagcaaaattggttatatagcatcgaaagttcacgtttttggttttatagcaccgaaagttaccggttcactttaatagcatccaaagttcaccctgttcctatttttagcacttccgtcaatttttccgtatgtcttgatcgttattgatccagccacacacatgatatgatatttctacccctcattgacatgcattatacttgtacttgtgaggggtagaaacgtcatatcgtgtgtgtggctggatcaagacggacggaaaacaatcgagaattgacggaagtgttaaaaatggaaacatggtgaactttgagtgctactaaagtgaaccggtagtattcggtgctataaaaccaaaaacgtgaactttcgatgctatataaccaattttgctaacaaaacaaattatagattttgcctgtaaactacaagacgaatctattaagtctaattaattcatcattaacaaatgtttgctgtagcaccatattgtcaaatcatgatgtaattaggtttaaaagatttgtctcgtaattcacatacaaactgtataattggtttttttttgtccacatttaatactctacgtatgtatgtagatatgacggaatttttgaaagttggaagggaactagacactgccgtgatctgacagagttacacagaagcatgtcaatgtcgtcgccatttatcgccactgatcagagaggcttcaatttatcgctgacacggatgtggctaaaaaaaaaaactgatagcaatccactgcggtagtcaaccaacgaagggtcggggaatcggtgatcggggatcggtcacggtcacaccctccagcttctgcgctggaggaaaccaacaaataaacggatgaaccaccccgtgtctcctctccgcgccgcaagcgggacaaccggcggcgacggagccaaccaggcaaaaccacacacaactagccggatttacaaaaatatactgtttgtggatttgttttgtaaaaatataccggatgaagaatgatttgcacaaatatactatcagtatcgtggcttgaaagagcgataccgagtttcgcgacaacaaatgcgataccgccactatcaactcgtgagggtgcatttgagctggcggtgtcacttgtagaaacaacgagaccgccacatgaaggaaccgacccgttgttgcgtcggtatcgtggtgtgcaagcgcgagagcgaaatcggtctcgtaatcccaacgcgcgagaccgagcacgtcgtgggacccacattggcgaaacgaccgggcacgagtggaccgccggtctcgcacacgcaaagatatcggtctcgctgtcccaatgcacgagaccgacacgcggtatcgctctagcaaagcgagagagcgctttgttatcgctcaatcaaaaatcgataccggctataccggcgaatacgtgcatatcgttagtgaatacggccgctgaatcgtgtccatgcaggccacaagtgaacatgccgtatatacgaatatgcatacacatatatatagccctcaaagatcatcttcttgttggctcatgcatgtatacgcatatacattagccaagcatgcatgtatatatggctgaacacacatatagatggacatatgccagtacgtgtatggctcatgcattccattagcaggtgggacgcgctctcgcgctgtcaaagagactgcttggggccctgccggtctgggttcgcgtcagacggccgcgaaattgctctacgatcgtgcgagaccgagtcgttctcgagcttttggaatgcgagactgatgcattagcgctcccgcggtttcaattagcaatagcgttggcgccttcgctaatccatgatgcgatatcgcgctctcgcttaatcaaagtgcgacgacggtatattttcgcaaatcttcccctatttagtatattcttgcaatttcggtaaaaaaattgtatattttcaatttttttctctactagcaatgatgtccatgcgttgcaacgagtaaaggtagttttaatcatgtatactggtgggaaaaaaatataaaggaataataataataataataataataataataataataataataataataataataataataataataataataataataataataataataataataataataataataatgaaataaaattgcagtgacctttggtcaatcaaaaagataaaaatatataattaattttccattaattccattagctaaaaataatataatacgaagtaggaaagttattctcaaattttagcaattttcaaaaagcttaaatagagcaaactaattatataaatgaaaacaaatttaatcacctaaataaaacaattagacctgtaattgaaaatctgttgtcagttcagttaaacatgagcctgtgggtgtgtgtggggtatatatctctcacttatatgtcgtggtctttttttgacatagaaaaaatacccgtgcgttgcgacgggtaattaaaattataacaaatataaaaatattatatgattaaggtttagttttacatgttatgagctctttaagaaaatatatttataatgaaataaaaaagttcagctgaagtgacataaagtgaacttgttccgtacggagggtacacatggtcaataaggcggcccaatagcgtgggcggcctaggaatagaatcggggaggaacaacttaagcgacctaaagtgaacttattccgtgtgggcggcctggaaatggcgttcggcctgacgcgggagaagccagagccgtccgatctgatagacggtcattccgacttatataaaagttcaacagcccaaaccctaaccctaaaatcatttcccctcctcccctctctctcaaaacaatgtggcagcggcccgacataccgacatccctgcgacggcggtggcggttcagaagcgacggcgacaccctccccttccggcgtcggcgttttcttagtgttcttgaatcttatctagtattcttgtagtagtgttttctttagaatttaggtccaaatttgatgcggtctctcattttttttctttcctttctttttttatcttttgccatcggaggggtattaaagcgggatcgatcgcacgtgcgatggcatttctataacccataagccatacaaattttcttaattaggtatatatagatattgaatcggactttccttttttttctttttttcgccattttttcattactacggatgtcagaaacatctttaattttttttaccacgtcacatataatcagattcgatttttttcgccgatttcttttttacgcttttttttgcggatggacgacggaaacactttttaatttttaagtagtagacatagagatagagatagagaaagagaaacggaaaacttttttcgcaactttttttttttggaatcggacagaaaaaaattttacgcttgttttttaccgcgtcgatggaatcggattcgatttgtttttttttaccacgccgtgtcacatataataggattcgattttctttggaatcggacatatactttttttctttttgcccttttctttaccgcgtcgacagagtcggattcgtttaattttttttccttttttcgcccttttttaccgtgtagaccgagtcagattagtttcttttttttctttatttcgcccctacttttttggatcggacttatttttttctttttttcctgtttttttccccttttttcgcccgtttgatcggactttgtttttttttacacggtttttttcgtccgcggatttttttttccgtccgtttttttatcggacatagttttttttgcacggtttttttcccacggtttttttacggacgatggaccatcatctcttatttttattttttattatataagtagtagagacgtacgtgtgccaacgactgcgagcgcgtcaagccgtcgtcaagcacggctgcgtgagcgcgcggccacaaacgcgatggccgagggacgtgtgcactgcagtgcgctgccccgggtgtacaggtgcgtgtggacggtttatatatagattatgtaaaattttaaccatgccattatatacgtcttcaatacagttagaccacatagtggtaatgaaaaggattaaaatcaaatgcagtttgctattgtaactgtctaatagcaactgcacataagtttaggctatctgttttttatccaacagttagagtgagtgctacagtaccaatataatagtaaatctctgttacagtatttttgttataataccgctatgtaccctagcctttattttattctagatcaagatgcacatatataactgcttaagttgcagttctaatatataacaaccactgcacaatatcctgatccaaatgaaagcgatacagatatcatacgtacggtacctcatcaacaccgtacagtatactaagaactaacaccttcatattttaatgtataacaccgttgacttttttccaacatttgacccttcgtcttattcaaaaaatttatgtaattattatttattttactgtaacttgatttatcgtcaaatgttctttaagcatgacataaatatttttatatttgtataaaaaatttgaataaaacgaatggtcaaacgttggtcgaaaagtcaacggcgtcatacattaaaatacggagggagtagtatgcatgaacatgaggatgtgattgaagctatcttccgaaacaaatatttttctggaccagcgagcatataataaataaaatttcacgaggatcgtattgtagttctgcacttctgcttctgcttcttgcatttcaaattcatctaacgtacgtgtgccgctctcgacgctagccaccgatagctttctggagagcttcgctgatcatcccaggtgccactgaaccagaacaagcaaactgcaacaacatacgaacagatcaccataactccatacggcaaaaaaacatataagcatcgttcagtactgcaattctacggcgcgatagaccttaccttagcttgtatcttcagtccaagaagaccatccggtgccgacgcctgcacggagagaacgtcaagacagaggctcttgatcgcgtcgaacactcgtgtcatcaccaactccttccatcggcactgcacctccaggagaaccaccttgtccgtgacggtgacattcacgtggtggtgttctctccctgcatcgccgccgccgctgacaccgatctcagagaccagctccttcccggtgatctcacagcgcctttgctgtcctgtttcggttgcgcgctgatgtgatggctcgctgctggactccaactctttcacccttttctccaacactttgaggtaggcaatcgtttcttcaaggatggatgctttgtccacctgtagtgacaaatcatctcgatgaataattcatataactttcagtataatatagaaccgttggaacactagattaattaattaaccttgtggatggaggggactattgacttcagaatcaggaacatctcattgagcttctctcggcgccttctctctgatatgacatggttcttgatgccactctcttgagttagcgctgctctactaccacgaccagtgctcatccgtgcaccacagtccacaactttcttcagcaacttctgtgactctataccggtgacgaccggcacagccatctcgtttgacttcgcgctcttccaagccatgaagcacgacacttgagaattcgcaacaccgtcgacatcattagccgccgccgccgccgccaccgcctccgttgacgacgccgggaccagttgaaaagagctggggttcacaggccagccattatcctcgagaaagcgcacggtgtccaggtccaggtccatgtccaggtccaggtcctcgtagatgctgtagagctcgtcgatctccatggtgattggatcgcggttggcgttggacacgcactcatcagagacaaccatctgcccctcttcgatggcgttgtgagtgatgaggccttcggacacgatgtcggcatcttccgtttcgttcggagaagggctagtgctcattagtacctctaagcatatcggaaactgaagctcctggaaatatgcaacgattcggtttaccaactttgggtcctccaaaacctgggaattcaatagcactccacatataattagttgtgaagagctgacttatactgagtggaacagcaaaaactacatcttcgaatgttgcaccctctagttttcataaacataacatttagtggaatatgtctacctttgcttgtagctcaaatgagaaactattctaaactatcgaggggacatcctctcattattttcatattattaaaatggttatagaaaaaattaaaaattttaaaaatagattaatatgtgataaatcacttcataaacatgtaatgttaaatacaacttctacatgttgcaatgagaaaaacaaatttaacagtgaatatacgttaactagccatagtttaatttgttctttttgcaactcacagaaattgaattagtttacatgtttatggagtgatctatgacatattaatatatcttgttgttttttttaaaaaaatctcataaccattttgatgacatgcaaataacaagaggatgtcccctcgagaatttagaatcccctcctgtagctcaatagtttgcaaaatgttattctgttcattaaaggtatgttctcttgtcttacatgtagtggtaaagcaagtatctaattattatggagaccaacctgacaagtgatgtcaatcataaaaaatacagtgtaacaaatatacacaaatttcaacatttcccacaggtaatttatcgtatgaacttaaaaaatcacatatagtagaaaaagaaaggcatcataagcggtggtaatatcatagagctaaaactgtaaattaccaggcaaacaatacgggaaaaaaacctatatcttagcaaaataagcaacaaactattatcttctgcaagtattaattagctaatattttaggaatataaattaaaatggagaggtaaattatgttagctacctacctaattgtaacatttcagggagagaacgcgggggaggggggggggtggtttgttgttattgggctattggaaaagagaaattttacagtccttaaaaggctaaaaaattctagtgcaaattttcatacctcctaatactgagagtaccaaattttacactacaaaatatggacctccagtacctttttaaaaattgtaaaatcattcattgagaaaggccaggaccccttcagccctaatagctgcgctttcttacatgttattgaaatagttataaacaaattgtgaaaaacaaatatgataataagggtatatctgtatatgcacttgcattataaattgtctttcctacctgttccatgttgtggcaggcatatgctataatgaaagtctaaaacatgatgtaacataccgagagactaccgctcggacgtccgatgcaacgcaaaatatcggacgctatcagagtactatatcagcaagctgaccacataactgctacctgatgatactatatgcatgtattgattaacatatattagtaacctttgagatgatttattttccaaaccatttatcttattgtcattttgatcatatggttgtattccttataattaaacctttacaacaagatctcatacggttatattttgattgaaaaattatatatgtttcaatcattaagatttaatgtttcacgtgttagaaataaatgtttcatatataatttgattatgttgcacattttaagctttttatccgaatgatgttttaccgttgtacacgggatcaataaatatattatgatgtttcattacttatttgtgaatgttgcacatcatattatttgaatgtttcatcaagtatattattatgtgcaactgtcataaagaaatagtaaacataagaaaatatctattaaaacatctaaataatactatgagcaacattttgttgcaacagtaaacttaaaatttattacaaagtgaaattccagttgaaacactatttctcacacatgaaaaatccatttacacctaatgaaaaacacacatatatattttttcattagaaatataatcatatgagatcttattacagtgatcttgctagaacatggaaaaacaccaagtgcaacattacaaataactatgtgaaacatcaaccaatatttattgaaacattccattaacactgtgcaacactaaaaagagtcagaaaaaaagtcatcggaatacaatgatgtgagatcttgttccgaagatttaattataatgaatcaaattatataatttattcatagtttggataaatagttggaggaaaaaaaacgtttgaattctcaatcattatgaatagttttcctaaatctgactgtatgcacctatcccaagtgatgtgaacgtccgatttttgccttccgcccggacggctgatttgaagcattttccatggaatctcgggtgttacggaatagtgctttactgtgctagactcaaaatgtgagatggtaataacataaaaagaatgtgggatataaaaagaagcttagcatcaataatatttaggaaagacgcaactatatcatatttataattttaggaaatggtgacttggtgagtacgaagaatcacaccctgccgcccaatggctttgtcgctccttgccagttgagcaaaacgaaccccggacatgctataacatattgagcacgtgatattctctcatatatacaccttagtttattaatatataggatattgttgatttttaaaataatatttgatcatttatcttatttaaaagattaatgtaaatatgcttaaagtatatatcatacttaaaaattctttaatgattaaacatgttatagcaaaaataaataatcgttatataatttttttataagatgaataatcaaatggagtaatacatacttcctctatcctagaaaaaatatcgtaaacgcattccagaaaaaatgcccttctaaggatgaattctaaggatgaatatggataagtgtttgttaagatatatatattatatatatttttaaaatgtgttaagattcattctcaaaagtgttttttagatggaggaattatgttgttctatatcactggacgattgagctagctatagctccatgcatagttgttcgtgctgaacaatcgatgagcttaccggatcagtggtccccagctcaagcacgccactcgtgaaggggatgcagatgattgtctgtaagatgtatagatatttagatggagtcagagatatcgatcgacgtacacgtacatatcaatttgaaagctaaaatacttcctccttctaaaagtttaaatcctatttctttttcattaagactaatgtatagttaactctttcactatgtgataaaactaataaatatgcaaccaataagtactaaaatgattttttgggtttcgataaaaaaattaatatagcacatagtgactacaaatagaacttagacttttaaaaaaaaccaaagaatgaaatatgacttagacttttggaaggagggagtactatgtacaactctacctacatatatacctgaatagacgcgctctgcagcattcgacgacattatattggtgcatgcatggagagcgtgcgatcgagtcagatcatgacattatatatggagtaaataattaaatatgatgattatatggaggatatataatgcatgaacattatctttgtttgaaggcatcatggttgacatgccatgatcgagcagcacagcatggaaatatataggtaccttagctaatagcgagcgtagaaatgttttgctatctgcagactgagcattgcgcagccaaacagatgcattgcttgcatagcttttgcctggcagcctgcagacagaatgtaccccagcagatcaataacaacactacagtacagcaatgtatatcttgttattaagatgtcatgagagacatttccaggctggtttacccagcttttgttttctcctattattggagttgctatcaagctagcagatcaaccgacaagtttgatcagtcatgtgtataggcacagatcgatcaacagatcatctcgtatgtgtgtattggcatcaagctagcagatgaaatactcacccttggccgggttggaaggagtaggtcatgcagacgacgtagtaccattctgtgtctgcgagatcttccggcgatagcgcggcaatgggcctcctcgcccggtggtcgcactcgccggacaggagagagtagtaaagctccctcagttgctcgcttctctgcacgacgagctgaccagccgtgaggtctgctgagttggatatcttcctcgtctttaccacgccgttgtagaacccatcattccaagtcaaaactctacaggtaatattttttaggtattatataatttagtatataaatactgggagataatatctaacggaacgtatattatgtaagtaagggaatatcaggtaaataaaatcaaataagtgaaaaaagggtaaaaatcggattaaaagttttctaaattcataaaacaaattacttaaaaattcagtggcaattaatatagttcatgcctacatccgtctctatttttttagatgaatttagaaagctcataggtccagtttttatcggtttttatttatttgatggttttcattggatatttccccatataggtaatagattaagtccttgatgagctggctagtgcacaatggtttactaagcttgatcccaggtatggttatcaccagatcaggttgttaaaccaagatgagcacaaaacaacttttaaaagacgccaaggcctttatgaatttagggtgaagccatttggcctgactaatgcttcaaccactttgcagggcctcatgaatactatctttactaccctaataggaaaatgtgtgcttctatctatttgtggatgacatattcaattacagcgaaaaccttgaggagcacgtgcaacacctaaaggaagtttttgctatcttatagcagtacaaactgtttaacaaggcatataattggtgtcaatgcagtggctatagatccatagaaaatcaaggttgtgcaaaattcgtcagtgccaacaacctcaaacaactaagtggattctaagggttggttgcttactacataaagttcatgaaaaactacggagtggtcatcaaacccttgacagagttggtcaaaaaagatgttaagtataaatggattgaatcattgcaacaaacttttaattacgttaagttggctttggtacaagcaccaattctaggattgccagatttctttcatgagtccattgtgaagacagatgcctatgataaggtattgttgttatgttgctttagaatgagcatccacttccatacattagcatgcaaggctctgggtgttaaggctctagcaccacccatttattacaaggaacatttggccatttagctagcagtaaacaaatgaaggaacagtaatggactagaggggggagcgtcacgcaaggggaggggcgcatgcctagtcaccgattagggtcccctgttgggcagtgccagccagggaggcaaagtgctgacaaggcatgcaggttgtagattggaccatcggaggcaggcggacttcagttgaaggttgggtgcttcttgtaaaatcaaaaacacggcggtcagatcggcggcatcgcggcggtcataccggtgggcacacgacggtcaaaccagcgtcggcaacaggaggcagcgacaagttttggcggttagaccggaatatcaacactggtcagaccggcggctacgcttcggtcagactggctagtctactccggtcagaccgatcggttttcggtttttgggtataccaatcattcacccccctctggttggcttagttgttgtgattcgatcctacacttctctcatttgtaattgtgaatttgtgatcctttgccgttttttatttcgagatttgataactgagaagctgatagaagaggaaagggaaaggctcaaggacattgggaattttgtcgatttagcatcaaattgaataattgatcaacattcgtcattgcttcctgttttgttgaattattttttcattcgtacttttatgtgcttttgccaatgaatcgtggttgttgccctgtcgaattttgaccttcttgtgttccaataatatcatgcaattgagaatatgttgtttttctctttgttcttcttgagtaatcactctagcacttgtctatggtccgtactttttttctccttacctgcgccactggtctacaactagttactaccttccttcataaatataagggattataatatttttaagtaaagaattaaggaaataacaaaatgtcacgtcatagtggtatacgggagaataaagtagtactccttccatcccagcttaaaatttttgaggtcttcccaaaatgatcatcatctaacaagtgtcttttcgtttatttatgcaaatagttttttatgaaatgaacttatgcaaacagtaaatgcacatcattaaatgtgttgtatgcaaccaaccaagattaatttatattggtgcaatgacatgtaatatttaaaacatgggaatccacgggacatgaagcgatgaaacaccttaactgtaattaactgtaatgattaatttgagaatgatgcatattttgatgtccttagttttggtgctttttgcttagggaatgattaaattgggattgagggagtacatataaactatggtaggtgaggaacaaattagtacaaaagttgataggtatgaaataaaatagtacaaaattatgtctcaggataacaaatcttttatatttatggataaattaaaataccataatcttttatatttgtgaacaatatcaccaagcaactgcattcgtattgaactaattattaccctgggcaactggttgaaatggaccaaaagatcgcataactccaactgatgctcctcacagcagcagcaagcaggctcctgaagtggttcgtccctggctgtaggggttcttcctgaactggaggagcagatgccatcaccacacaagtctagaaacctatctagctgtttaatttcctgcataggtgtgcgcaaaatcaaggaaagaatcagacaagcagataaagctgacaagcatatggtaatgacactgtcatcagtacggaggggcgaatgcaggcctagggcacagccatcaccacactagaagtagaaacttatagtagctgtttaatgtcctgtatataatgcatctgtcccaaaataagtgtttatacatatacttatcaattaaaatttgaattttcaaccttaaatttagagttaatttcaggatttttcatatcgaagtttatttttcagcctttgcttttaggctaagaatacgtatataaaaatttattcacaaattatttttcgtttgtgagatgggcgtatgtatgtgcaaaataaggaaagaagatgacaaacatatggtgatgatactgtcatgtacgcaggggcttatgcaggtctaaagtagtcttatctctaaaattaagtttatatctctttaaatcataatgtaaattttagataaaatctaacaacccatcaattgagatatagtttagctctaaccttcagtaaattttggctctgccactgtcagtacgtacaagcaaaagaagcgtagaatgaaggaggttacgaattaattcacaagttacagtcatatatatcaagcgtagtatatggttatccctaattgtttcgtatagctagctagctagcttaggctagcggtaagctctacatgtaattaattaatcaagtaccttataatctgtagttttgcactaaagctgatctacaaaacatggcgagaccgcgagatagcctgtaagttagctggtagactgctatgctagcttgctgttcgatctcttgttgatcacgaagaacaagaacaagctgctgaaggtactggaatggacaaattaaagaaataacctgcaatttaagataacccatgcatatagacggagaaaaacaaagggaaaattaacgctagcttactctttccagtctgcccaccaatgcaagaaggactccagctagctagctggctgctctagctgccaactatccaagttcactcttctgcaacccgccgttcttccagagggaggagctatatataatcgaaatatatagtttatatatatgctgtttatatataatagttcctttttcttttctcttttgcgatcacacacggaggagggcgtacgcatatatgcacaagccactacatgcacccctgaatatgtacacctatagagaagggatgcactaaaatcatatattgacagtgcaccatgtatatgcttatgtgcactaaaatttactgtaaatctttggtggatagaatcatatatatacactacgaattcgttaccgtactacgcattacttgttggtaacacatgcattcgtaattaacaaaaagttgtattagggtaataagtattttttttatttttagttttatatttttagatttacagcattattaattttataattttaaattttagaacagtacgtgcgttaattcatgcaaaaagtaatctttttcccacgagtacacaacacaacacacggtgtaaaaatccttccacccccaccccatcatactgaggcgttattgactgtatacaacaccttatgcgtgttctaatagttctaattttttaaattaacaaatataagtttttatgttttttaaagaatgttttaccgttctagacactcattctaatcagtattctctctatcccaaaatttaagctgcattttattttaacactctctttaacgtatactttaagtattaatttcttttgtactatattattagcaactactcatatgaaagtatttttaagagtaaattttataaaaccacatgtactatggtccaagttaattatataaaattacagggcttttagcacgtgatacataaccctatgtagtatcatgttgaaatagttctataaagggaagtgcttcaatgctcatcgaatagaaacctgcacagaaattaaagcgcatcaatggtgggataaaagtggactaagagcatgccaacaaatacccaaaaatctattctaaaattatgtttttgaaattcctaattaaaatttaaggtgtaaataaatttttgtcttcaagagatactttaaatcaacttccaataataaaaggtggacccactggccgtaactaccaactgatacatgaacataaattgttttaccccatccctccccatgcgtgagctctcctcacgtatcgccttctagaaattgggagcgagaaagcgtctcccaacttgtgaagagcaagaaaggaggataagggaattctaatttttagatacaattttagagaaactgttggagcaagtttttcacaaaagaaaccctaattttaaaattgggtttcatttagggatatatacgttggccattctccaacagagtaatatccaattccccattagccaggggcattttcaaccataaaaacttgaacccttacgattcaaggcagcagaccgacaattcgctcgcagcgccacccccttcctctgatgagcagcgccactgccccttactccagtctccacctagccccttccgcctctctgctgcccaaactcgttctgcttgccagctaccgagtgtctccgcgttcgaggcggcatggtagacgggccagatggtggtggtcgtccatgatgatggaacaacaatcggccgagtacccgtattgtacatggcaacctaatttcatctagagatcccaacagttgttttatgtgatcaccaattaaccaccactttacgtcctttcagacctaaattttaacaaatattaatttgcataaggtagataggggagctttggattgatcgatgggttttgggttgctatacacactgatatagaaccgggaatcgtgaatggctcaacagtgacaacggctaacgacctggtacataggcactaagatatgacatgaaaaaaaaatccccattgaagattgggtctcacggtcaaacccatcactgatgatccctcatctttgatgagtaatctacatcgccgtcactgtataaactttttttcacccattatctacaattggtgacggaatgggacctgacccatatgagattttcacatcactgacgactcattcatgacgaggcacccatccttgatcagacgtctatttattacaaatgagtgttacaactcgttacgaatgaccttcatagtagtgaaaagaatgtactccgtaagatgtaactctcaagttcaatatactccctctatcctataaaaaaataatctatgagggaatgtgacacaacctagtacaatataaatctagataattctccctttagatttgttatactagttatgtcacattctttgttaggctgagtttagtttcaaaatttttcttcaaatttttaacttttccatcatatcaaaacattcctacacacacaaacttttaacttttccatcacatcattcaaatttcaattaaaattttaattttgatgtgaaaaacacaccctagtctaatattattgggatggagggggcagttattgcggtttggttgttatttcagatttactagcatgtgctattctgctgtccagcagtgccttaaggttgtactcctaggtttggagcatacggagtacgagtagtacatagctaattgatagctgtactgactctgcatcgagaggaggccacggcctggtgcctaactgactaactgcctactcctactgcctcagaagaagctacaggaaccggactcgtggtgccatcaactagaagctaggaagcttaacgcttccttatatctttaaccgtgtaaaccatactccgtcggtggttgctgatttcacctaggggtggataacgagccagtcggctcgttaaggctcaacacgtttcagatcgtttttttaacactcgtttcattaatcttaattagttaaagcctagcttaactcagcttacgagctggctcgttaatataaatttattccaccttcatatattttttttcggggaccaccctcataattttaaatttactattttatcatatactacctttgtttcaggttataagactttctagcattacccacattcatatagatgttatctagctgggtggcccgcgcaattgtgcggctagcatccaaacaaaatcatatatatttttaggatttttttacttaaaatttattaaatagctatctcattgtctttaagacttcgaaagaccaaatcttatcatccccgtgtttctaattatatagttttttaaagtcacaccagttgctaccccttatgtcatctccttctttatttacttggtcgatctaccactatttctcttcattcttcttgtaacctttaaaaattggatcttaaagttttatagtttatcgttatgttgggtttcgtttttataatttctagatgtcccgtcaaacattgtcattatattcctctatgacccgtccactgtctcttctctttattgacattgcgattttaaaaatctaatataattatcgtttgggttcattttttacattctagaagtcccgccaaaccgtcagcggctttaccattgcacttctctacggctcgcctgctgcctcccttctttattgtcattgagattttaaaattgaacatgattatcattgttttttttacttttagaagttccgaacctttaaaaattagaccctatagtttttaaagtttattgtcttgtttgggttttattttttatgatttttagaagtctcgtccaacgatgccactatgctccttcatggcccgtccgccgtctactctttattgtcattgtgattctaaaaatcgaacataactatcgttggaattttttttttgtctagaagtcccgtcaaccgttggcggctctataactatactcctatacaccccgtccgctgcttctcctttttattgttatttagattttaaaaatcgaatataattatcaatggttttttttactttctagaagtcccggcactgccttgctcgtttgcttcatggtctgcctgtcatccctcattttaatcgtcattaggattctatttggtgttttattaacagtttttatacgtcgtatcaacctccaccactttactccttttataggtctattacttaatttatctcgtcatgtgttttagatggtattttctttcaatagtctttatttttatcccaattttagttatttataaattgtattcctaattgaaatcttattttttttctaatttcagaatttttatttcaaatttaattaatatcgtattgtgttcttttaatatttttattttttattttcaattttagttgtttaagaattatattcctacttgaactctcttttaatttttctaattttggatattattttatttttttttctaaattttaattaatctcgtattgggttcttatatggatacttatttcaatattgcttatttttaatttcgaatttcagctaattttaaattgtattcctacttgaactcttcttttatttgttttgctaatttcgaattttatttttatttttattctaaattttaattaatctcgtattgggttcttatatggactcctcttttaatattccttatttttaactccaaatttcagctatttttaaattgtatttttttggattttattttattttatttcgaattttgattaatctcgtattgggttattaatgtatacttctttcaatattgcttatttttaattccgaattttaaatatttttaaattgtatttatacttggactctccttttttttttctattttggattttattttatttttattttgaattttgattaatctcgtattgggttcttgtcactcccaatccggcaccgccgtacaacggcacctgacaggagcgtgtcgtaggaaaaacggcgcgaaccgcttcctacgaaaccgcgatcacagtaccagtcccaggacatagtgttggtacccacggtgacaaatatgaatcattgcaatccttaaaataaatagaggacttatttaccttaacttaggttgcagctcagaacagcccgagaatgcaaccgacgacacggacgaggaaacaccaacaacagcagcagtagcggaaccaacggactaacacccaacaccacaggcgacggctgggaaccaggacgaaaccatattcttcactccacttcatcttctctttaaggcggaggaactatatatatttatatagagcaagggtgagtactttcgtactcagcaagtcacgggaattttaggtgtttaatgcaagcttggaagagaggcaaggttgttttgtaaatcttttgttttgaaatcatttttgaaatcactaagtggtttacttctttctaagtttgggccgaaaagagacttgcgtctcgattcgacttttaagagatgtttttcaacaactcaattggtaatgtaccgacctcccgggtcagatcattacttctcggctcccagagccatttcacttgattagtcggctcccagagccttttcattttctcggattcccagagtccaactgcccagcagcacaacaatccgcttccactcgggaagcctagtctatgatgcccgtagacatcccgaatcacacagattcgtttcttgaccactcaggtcatccatctgccacataggctgattctggtaacgattcccacagcacaacaacttttcacaaagcataggcaaacaaatctatgctacaggaaacacctcacatccacccatgaccgtgggcacgactgttcgaacagttagttaacctctgcagagggggtacactttacccacacgacattactaacccggatcacccagtccgtgagatcagccacgtcgggagaccttaaggctttcatgacaaggcatttcgagagccgacacaggtttaccatatgccgacgagaggggtcccagaccaacaacaggtttggtcccagaccatactgtgccaggaagcccaggggtcctacccgacaccaccctggagaatccacttctcttggcatcaaggctcccctaattagctaattactcagccaggggtgtcccattgcacccgtgtggtcgcacttgttatatgctcggatgaatttcccacagtaatcggtccttatatgcaaatatgggacagtgccacataggcacaacccccgcatcgcaagttttcacattttattttattttcaaacacgccgacaccacatgacgggttttaaaggcttctcaaacccatttcccaagtttttacaaacaacggtgtatgtgggatatttggtatacgcgctcagagagcacagataccgaggtaccacaaaggtggggcgacaaggaatcagggtagtacagcctacaggaataagtgcgactactgggtaggtccgtcggtttggcacgcaaactgaggccaagcaagttgagtgtgtgattctaataatgcaagttggaaacaaaataataatgattttccaattataggagcaattggtcaaagggtgacttgccttgctcaaggtcttcacgaagcttcacgtatcttcgagaattcccacgattgacgaaaatccggtaaccgcaactatacacaaacaattaaaaacctacacaagacccaaaagaaagatcctatttagcctaattaatagtgccattaaatagatctcaattttagagaaaaactggaagtggaacggagtcaatcggaattacgcgagatatgaattttggaagattaattggaatttctggacaagggaagatattttgtggaacaaggggaaattgatttttgaaatttatagaaataatattctcaagaatattattgacagtcattgacatgcgggaccaaggaaaatgattcatggaattttggaatataggaaaatgatttatggaacaagggtggaaaggaaatcaaggagggatatatattagacttgtttcgggtggcattggtgtggcccaaaggagattggcccattagagcccgggtggggagagagaggcggtccggtggaccaagttcacttcgcggggtcccgagtggggcccgcttgtcggtgagacggtccacggaagaatgggcgcacgcgggacgcg

SEQ ID NO: 74915 - DNA, 49470 bp, Oryza sativa
catgtcatgcccctcgggccctcgtgctgccttgccccgaggcctcgcccaactgcatgtggcagggggagcgagcggagaggggacccaggctaaacgctatcaatgcgaggcgccccaactgcccctcaccgcatttaatgcggtaggggcagacgtgcggtgccgcccgactgacgcacgttagtcaggactgaccaagtctgtgacgggcccatcgccggtcaagaccgattggacaagcggccgtgcccccacgtcgcctctgtatccggcggagtggagataggtatgacccgtcccatcggagcgtcattcggagctccctccacgagaggaggaccaccacaagtcttcacccatttataaggggatgacagggttgtcccccgtgtcaggcggggggcggcgctgggtcgcgctcaaggacgggctgctgcttagcttccgggcgaaggcacggatcgtggcccggacaaggtgaagtgggtccccctcccatgaaaagttaggtagaggcggtgcatgtggtatccccttgagctataaaaggaggaccttgcccaccgagaaaagggacgactctcagcaagcctggactctaggaaaagaagagcgagagccctctccagagtttaggagcccttgtaacactcaaccttagtcccacacacaggagtagggtattacgctccatagcatcccgaacctgtataatctcgtcacccatatgtgacttagtagcattcagggcggatacacgatctctggaggcgagctctttcccccagccgaactcacaaaaaggggatctcacgatttcccgctagagaggatcactcctcgacagggacggagggagtatatggaattatatcaacagtagatatatatgaaccagtaatatcaaccggtgttagaagaagaatgttgtattgcatagtgcatacatgatcccgctgaccatcttagatacttcctccatttcacaatgtaagtcattctaacattttccacattcatattgatgttaataaatctagatagatatatatgtttagattcattaacattaatataacagaaaacctacaccacggcatcccgtggagacgggatcccctcctcctacctcactcctcttcccccaaatcatccggatcccctcctcctacctcactctcctcccccaaatcacacgacactgcagccctccccgtcacctcctcctacctcactctcctcccccaaatcaggcggcactgcagccctccccgtcgccgtcacccaccgctcgccggagccggcggccgccgccgcggggaaggtggcgatggcgaggagctcggcggcgggagcggggcgcggtggagccggaacggggtgcggttgcggcggcatcctccatggccggcaacaagtggatctgctacagcatcggtgatgaagaccttcatggccggcggcaggggtgcgccgagcacgtcgtcgtccacagccggttgaggaggctgtggaggcatggtacaaggtaggcaccagatctgtcgccttctcatcctcggcagcggcccccaggcgacgagctcgtcccgctgctcgacctcccggactccgcaactgctcctcctcctctctcttggggtatcacgctgttatcatgtaccaaggtttgatatctagataccagctcgatacctagggtaccagttgtcaaagtatagcccgtaccagggtaccaggtactgttacctaccgataccagggtacaggtacaaggtactagcccagtgtaccaggtaccatgtattacccggtactagggtaccaggtattggtacctgccagtaccagggtactaggtactaggtaccagtcgctacccaaggtaccaggtaccaggtactagcccagtaaccaaggtaccaggtaccgggtattagccggtactagggtactaggtacttgtacttgtcggtactagggtatcaggtatcaagtactagtcactacccaaggtaccaggtaccagcccggtaaccaaggtacaagtattaggaaagagtcattgaaattatcccgttgcaacgggatcccattgtatagcagacctcttaatataaatgtgggaaatgctagaatgacttacattgtgaaacggagggagtatctttcagtttattatcacatttttcctctatgtagatcgaatatatgaccaaaatgccaaaagcacgcacgtagtatttcagttgagaacgacaaaaaaaactcttttctccattgctataaaagttttttcttaaaaaataccgtttaccaattcggaaaatgtgtgtataaaaaagaagagagtagaagctaggaacctatagttctcagcttcaaccattccagcgtcaatctagcccgtatgcattgtcttcctctcagcgatccatcactcaacatcatgcacatcatgtactcagggtgtgcttagttcctgaaaaaagttaaaagtttaaagaaagttaagagcttaaaaaaagttaaaaatttatatgtgtaggaaagtttttaatgtgatatgatatgatggaaagttgggaatagagggaaactaaacatggcctcaaggaggtggatctagcgtggatgctgggggaactcaagtccccttatcctactgagggggtggatctagcgtaggtgttgagggaactcaagtccccctatcccactgatcacttttgatagaaggagagaaggaaagagaaaggagaggggaagatggaacaatatggaggttgaatgtgggagaagaaaatgagtcttctctttaatcccattctgggatctgtccctgtatgtactggacacgcacaccataaatcggcacgacggatacagagaaaatctagtatcgcacaatgcctgctagtaatagatcatttctccaccgagtcactcatctcctaaaacgtgtgcattgccgacagcccaggaaaggggcactgggcacaatgtacacgccagcaagtaccagcaaggcagaaagctaccctgtgctgcaagcaaaaacaacatatgagatggagtaaagttctgttcgagcatcagcatattgtatccaatcatccatggttgagctcacgactactccctccgtctcaaaaaaaaagacaaacactgtatccaactttaactatccgttttatatgaattttttttataatttatattttcattgttgttagatgataaaatatgattaatattttataagtgacttgtctttttaattttttttataattttttcaaataagacggacggttaaacgttggacacggaaatcaagatttgtttttttatacggacggagtacatgactgcatgaggatcgaggaacaagattctacagtgaccagcaggtccctgccatagccggagcgatcataatatgttcgagagtttagactaaccgtcccgtgcgcccgcagagctcgcgtccctactgctgccatgcacgcacgcacgcagagcggctctccaaccgggctacctgtcctgacctgcatctacgctactctgtgtcacgctgcatgcagccatcgagtgcaaaaggccacttggaattgaacttgagtatgattgagccgagagaacaggcgcaagaccggatgaccaacccatcccaatccaaccgccggaacaagatgacaagcgcgcaaatcatgttcggaattgggtcgtttactcgtttcgtgcggtccttggccccgtccatccgaactgccgcgcagcgccggcctccctcctttccccccgaaaagccacggtcccctgcacctccccctgcacctccccccgcacagctgcaccgcgcccggcaatttcactgtttcaccgggcgagaggacggcacacggcacatttgccggggttgacgggtggattgatcggcgatgaccgacgatgagtcgagacgagttgcattgaagcggtgggaggtgacaggtgaggcgaggtgaagccgcgctgtgcctgtgcctgtgcgtgcgcaacagtggcgcgcagatgtggtggtccctgtcacgctttgggtttggagtttggacccccacacattgcgggggccggggaggggaggcgcccgagaccccgagtgtggtgtggtgcacgactcggcgtcgcatgctgcgccgtgtggccgatccccgggtgtagcggaagcgcgttggttgatgaatctgacggtcattacaacactgcatctgttactctgatcgtgcaatcccgtttttggtgcctggtgccgctccggaagcgagaatttttcgtgcctctcgcggaaattgaatagtttgttgtgaaagaaaagacattacgatgtttagggaggttaataggcactacattgacctgatatgtttagggaggttaataggcactacattgacctgatagcttactcctacgttttgttcagagaggtaaacaagcgatttcaaaagcacttgtcgaactgttaccatcaacctcttgtgctgctgctgttgtttgctgctcctgctgctgactcgcgttcagaggaggacggacagcttgtccggttacttacctccggtgcaccccctcatatcagcatcaggccagttgtgcagagcgagagctttaaaagaataagcacaagtgttggtcagtacataaccccctggcttaagaaaagtcagcagcaataggaaggcaactttaacccctacggaccccagctttggtgtcctgcaggctgcagcagccagcagggcagcgaggagaggttgatccgttgatgcaaatgcagtactagtagtacacatgcaaacaaggtgcaaaagcattggcagggaaaggtacatggcagcataaacaaatacagtacgggctacacgagagacttgccatcgcttgcgtcgatcgcttaagaaaagggagctgtcagtctcatgatcggatagcacgttctcatgcagtttgtttagtgtcgtagcttaaagaaattcgtaagcagacatggaactaactcatccatcaggccatcacacctgtaacactttttcaaatccaagatttgtttgcaagcttcaagagaaacaaccggcttctgagttgtttaagctggcgctcaaagcgttcccttttttttttctaagcagaaaggggccaatcaagggacaggagatcatgaaggcaaagaatgcccaaatagggctttgcagcacgctggagggggacacaggccaagtgagaggtcaagggattaaataagccctggaaataaaggaccgttgtactgtgtctgtccaccattgatcaattttactaatcaacaactggcctctgtacttacgttgcaaatgaaaagcatggatatggatgaacactgagggaccacacgcaatgggtggtgggggtggtcgacgggcgaccggtggccgtgcatcagccactcgatctccgatgttcggttgcggtgccactgtcccaaatggtccacaagtcaggtctgtagatttgcaaatagtatagcagacactacagctgaacgagcacgattaataaggaaacagcacgagtggggcatgcatagcacatgagatgggtcagaagtacatttggtgcatatgaaacggatgagagcaaacaacatcaagtctctattgcgcgggtgacgagcaattttaaaggtgattaccagctgtgcctacacgcagcgatgatgaaatttgggtaatcgatgacaaggcaaaaacactttactactatgtactattccctccgtcccataatataaggaattttgagtttttacttgcaacgtttgaccactcgtcttatttaaaaaaaattagaattattatttattttatttgtgacttactttattatctaccgtattttaagtacaacttttcgctttttatatttgcaaaaaaaatttaaataagacgagtagtcaaacgtggcaaacaaaaacaaattacttatatcgtgggacggagagattagtactctagtaggacaggaagagtactaaatactgtagtagtactaatagatttgtgttctgagcaaaagcagaatacagtaaccatatgcaaccaaggaaattcgcacgttgctttcgacattagtctgagctgtgtagtaatggtagctgaatgaaaagtctgagctgctgtgcaattctgctgctctctagtgtgactgtgaggacatgtttagagctatattttttcaaaagcaaactatagagataatccagatggccgtttttatctccaaggtttcggatgaacaaaaagaaacagccaggaatttcaaactacactggcaaaagcacagatgaatcacaaaaatcgccaattttgagctattcaagaccaaaatacaaatccctatatacaattagcagaacacaaatatgtgcatcgtctgcatttgcaaactctgaggaatatgaagtctatgaagtattagtgagtataggccttaaaaacataaaagtataacataatcttttttttttgcgaggaaaagtataacataatctccgccgtagaatcagtgtatacatcgattccttgtcctccaattgcaggcaactattcttgaatcttcaacaaaagctagcaagtataaaaggaccaaaataaaatctgattctatccgattcacctcttcttgtcacaactacttatcatccatgccctccttttattttcagtagtataaaccattcaaacatacacttcactgattagaacttaaaacaaattaattcatcatgctatatattactaatgttgcatacctcagatgtacacaggaattttccaatttggtctattgtacacaggaattgctaatgctgcaaacctcagatgtttagcagaacaaactaaccattgcacccatccctggacaccctaaccattctttgtttccactaaacagaaaacctttacaccggcgtgcattttgtttcaaaatcatggcatatacctttttttcagcaaaatcgtctagtgtgacaataatcaataatatcccaagctatattatttgtgtaaaacaataaaatttgctattgtaatattcagttatggttattccagcatgtaagtgtaatgcatatttgagtttagacagatccatacatcaaattagcaatcattggatcaagcaatttgataatgcactccgtttggatattatgacagcctagcccctcctactattaaaatgacaggctaagctatgcaatgcctcgtgcgtgtagatatcagaggctgagtgaatcaacaactaatctaccaaacatcaccaaaagaactaaaaacagcaccgtatacacactaatgcttgtcataaggacattcaacatgccaaattatcttatctattcacaacgaaatgtttccaagaacatgaagtggccaattgagcggagagcaacaacatagtggtaagaccctagaggccatagccactggtcacacactacagagacactcataccaagattgccaaatccattaggcctacctaataaacaacagagtgtgcaacaaccatgataataatttctttgcaatgtttaaattgcaagacaaaattcatattactggagttaaacatgcctgcaaatggtgtaggaatcatgatggtcgaggcaggtgtgatcagcatcgccatgctgagacggatacaagctcgccacgctgccaatagagtgcaaggcctgctccacgcttctccacatggaagcctcggacctgcacccgcttcaagaggcagtcagcctgtgcctccgcaaggttgctgagtggttgaggtgcaaaccctgctgatgttagcactgtccgccaagcgatcgctttgtcagctctacgccgcccaagaactgcatcctccactctgggctgaatcagaaacctctcgatcttactgacagcatccgcatcagtgccagcagcatcaagtgattcaagaagacatagacaagactgtaagcaattcaagaagtgttgggaaaatgggaggtcgctccgatcactgccatagtcaatagcaaccacaatcttaggagcaagctgtttcaccaactgaagcatagctgggagtggagtgcgtgctgagcaaccaactgggaggcttactgcaacaacctcatcagctgtaggagcaatgagttccataggatcaaatgcgtcgagattaatagcattgaactcaaatggaataccaagatcagcagcaaactgtgagaggttatcctgagtaagatgcagctcaagcgggtggtgggaggcggctgagacgaaggctgtgagcttcaacatcggcaaggacacaccgccagagccacagcggtgagcaagctcctgcaagaacgaagcccactggccgccgacaccgaggtcgaaatcaatgacgcggatacaagacgcggttgtgctggcgatctcatccagaagcgcctgagttaccgtgaagttggcaaactggagcacgggggagaggtcggagaaggatttgtaagcggtgagcttcagggcgacgtcgagcggagacgtgagacgggtggcggcgtggtggccgtcggcgagcgcgaggaggagggcgtcctttaggtaggaggcggagcggaggaaaggcttcccaattgggggaagctgctgattgagccgcgccaatatctctcgcgcgcctatggagttgccgacttcggttgccttcgccgccgctgcaagctcgtccaggaggtgttgctgctgcgccgccgccgccgccgcggttgacttcatcgcgttgcgcggatgctgcatcgaaggctggagctggaagggtaccgcgctatgtagcgttggaaacgggaggcattgcgcgggcgccggcggcggtggctggggctggttgtggaggaggaagagattgtcgggcacggagtggtggcgcttcggcggtggctggagcagtggctgttgttgatggtcggagaaggaggggaacggcatgaacaaggtggaggccggcgtcggctgatgctggttgaggagtagtgtgggtgatggcaagccaaggagagggggcttcatgtcagcgccgttgtggaaaggcgcagtagtcgccggcggcggctggagcgccgcttcgggcgacaggaggccgaaagcggaggtggccttgctattgctgccgctgctgcttgtgagcgacctcccgccggaggacgacaggtcggaggcgagggcggctggcgaggagacgccaccggggtgatgctgcagcgggaacccgaacccggcggcattggcgagagctgctgctgcgagagccccggcgcctggggttccatgtcgccgggggcagccatgatccagttcaaaaatgtctgctcctggcctgccgccgccgcggcgtcgccgagcatggcgtcccagctctcctccgcgacgaagcccacatccagggcccccggtatgggcggcagctcaccgccaccgccgccgccgtgttcgccgggggccgcccatctggtggcttcggcggcggctgcgctgctctccgaaaccgccgccacgccggtagatatagaatccgccgcgccgctaccatgggacgaagacagcgtcgatgtggagttgggcgggctcgggctccccctgcagtccagcaccgacctcggctccaccagcaacgacccccccgcgcccccgccgccgccgcctttgtcctccggccaaagcagcgccgctatgctccccgcgagctccgccgccccgttcccgtcggcactgaagggtgccgccctcatctaccaacctactcgcgcatgctcccgccgcgcgccgccgcccgccgcccgcccccctctcgatcggcgcgagagagatatggagggaaggggatcaagaaaaacaataaaacagatgaggccgcttgcttgtgtgcgtgggtgtggactgtggaacagcgaagatggagagaagaaagccttgtgcgctctcggtctcgtcctcttgcccgtgcggccgtgctactaccagtatagttatgggttgccgtggtgggtgcctgccttggatttctctctctctctaacggtgccatggtccataggagtaggagtagatgcgtgcaacataaaaaaggttggaaagtgtactcccctctccctatctctctttccccatctctgcctatagcttttgtttttcttctctttggtttctcatcgttattattactccctgataccttatctgggttttatttttttgcccccgcgagcttgaattgtggacctcgaacgtgtcgattggcccagctagctttgacggttactagttcgtttcctctcagttgcaagtggagcagtacgagtacctctgtttagattttactcctacataaggtgtagatggatcataacaggagctgaaacgaactttcggtttcggattggaggcaaactttctcgttggtaatctcccctatacactgtagttgttctcgcgtccgacgccatgaatcgccgtcaatgcatactccgtaagtccgtatggtgtagagaggtatgtccactacacactaccgggctgtatttggacacggcccgcgtcttccagtcccaaccgccgagcctacgtaattgccggcccaactgacatgctgcgctcaacttccacattttcccggcccttctttgggccaactcgcaaaccgcccctgcgcggcatggaacgcagcgaatgctcacgcagtcacgccgtcatgcgtcggcgttggagtaacagcgacgccaagcgggcacgcaccgccggctagccgctaaaccaggttttgaaaataaattattgatgagtttattttaaaagttaaaaatgcttaaaaattattttaaaaatccacattctgctcctgcctttgctcgacgatggttttgagcaaacagttttttgttagatttctctctgtctcaaaaagaatcaaactctaaagataaatttagatttgtttttttttgaaatagagagaactaaagaacggtattactatatctttgaaatggtatagccatgatatctactccatataatatcattctctagattctctattaatagtatttctagacgatatgattagtctcttcctttatctttggtttttctctcttccctaagtctcttcctttatcctttgtttttctctcttttctgctataaatcggtctgactgatttgcattgtgtaaataaatactcttttcttctaatacactattcacgtattattattttacgtgttcgttaaaaaaatagtaggtgcaagtgtaacctgatgataatgtagctgtagccctgcgtctgcatgcgagcctgctaaggattgtggtgatagtgtggtgacacggccacaaggacgtttcttcattgcttgcacatgaatctggcctatcttctgtctcaatagccactttgctagggaaaatcagtcaaggtcgcaaaggacgctggtaaactttttttcctttcaatgccctgtcgtgttgacacttgacacaatgaaaaccctccaggacgagttgccacgggggtaggcgagagctgcagcacaaggaccgtgcgcaaatgtatgcatatgagatgtgatatgatatgacctgaccaaactcctggtcctgctttactgggacaacatctacagcaccgtaataagttctcattgctccaacgcagacagtactgggatatcagattggaccaaagaacagtaggcacaaggtcttccacaaattcaaccgctgtcacggtgtcacctaccacaacttgcaatattcagaccaaatcaccaaagtttttttttcctactttacacagggacgaggatgatttttttttttcaaattgtttgatgatctgacgttgcttggctgttttttcaggttttatctctccggggaatctccttatcatccttgtcatcaaataatgtgggaggttgaaattagttcgaatgttacatttcattccaatgccaatctgcctaacagccccaaagctgatgcatctgcccacttacttcggagcagtggagcacgcaattacacaaagctgcgttctggattccaaatgattacttcctctttatccatgatcatgtttttcaaactattacgtcccatgtaaaacctgtttgtatgaaagttttcgtaaaaaaatatatttttttcaaattcataataattaatcctatattatttttacttatagcttatcttgtttcacgcgcaacagaaaagacgaggaagagcagcataatctaaggtgactagttttcacttttcagaaaaccgtagaatctctcacacaacggttggtaccaattagggaaggacgtaatatcaaataaatataaggggtgagacttcgaacttagacaggctagctcaccaccttgtagagctaaccaaaatacctctgggcatttttcattgcagactagaagaaaccatggacattgaaatggtcagatcttaggaggattacgtagaaactaaatttctgaattaaaataggaaccataaaacattctgcatttatgcagtcgtgcataaataagcagagacgcgaaagggcacatagtcaagtaagtaattgtagtgacttgagtagcactacaaggttcttaattcaaatattcatagaagcaaatttcagattgaattatttaggggactaacttcctaatttaaaaacgttgcatatatccgatttgatgtaaagactgaataaaaaatatccttctctaaaaataaatgtaaagaataaataaatgagcagagacgagaaaatttcccgatcaccttcgcaacaggccgtgaagaagacaatcttaattggcaaaccgagacgagactacagcctggtctaggaataagttcattttgactcttttaactagtgaccgaatttgatgcgtatcctgaaccacagtaccggatatctcgacccccaactatttaaaccggtgcaatttaaatttcttggtggttttggagggcggtttcgctgacatgacgcatacgcgacggtgttgacctgatctttatcctacatggcattgacatgacgtttatgtggcactagaattaacaaatatacgtgggactcattgtcatttacacaaaaaaaaatatttgtggaccccacatgtcatcatctctccgctttcccttccccttcttcctcctccctctctctctcccttatctatttctctttctctcccctttttccaacttcggccggccgcggggagtggggctggagcaacggtgacatcagcgggcgaggtcggccgggtgtgcaaggttgggagtggcaggggcggtgggcgggggcgcaaggttgggaggagctccctacccagcgggaggctaccggcctccggttgaggcggaggataaatgggtgaatgacaaatggatcccacatatatgttttcacctaagcaccacatcaatgctgcagactgatcaacagtgctacgtagacgccacgttagtaaaatcgccatccaaaaccgctaaaggagtctaattacatcgttttaatagttggaatgtagatatccggtattgcggtttaaggatacgaattacattcagtcactacttaagggagtcaatgtgaacttattccgcctggtctaacccattttctgggcctctcctgaaacttagcctatccaacaatttctaccccctacggccctaccggcccatcgagttcctcacgtaacaaaccgatccaagtatatcgatctgcagatacgcgtgcatggtacgcataaggtgggtatactatacattcgcgtagccggtagcaatgggcacccgtacgtatgtacgcccgccgtggggacaacggagacggggggaaacggggcgcgcgctccgctgcggcagctttatccgacatctctcacgatcaccactccgccatacaaaaaaaaacctcccttgccaaacgcaaatccccacggcaactcgtcgtttttcacctccacggatcgcatggcattgcgccccaggcgaagtggtggtactaccagtctaccacacaatcactagtgtgtggtataaactggtagtacgtgctcctctgctccgattctttcacgcaccgattcccactcgtttactgtgtgtgggatgctcgtacaaaaaatgtagcataagcataacgccagtatggagtatgcagcatttcagttcaaacttgcatccgtgatagtggactaactgaagattagtttctgaaggaaggaaacatggatcagcgttgatgtgttcagcggctcatgtaattaaccgagggggtaattgaatttgaaacgatactcaatccgcgtgacgacgcttcctacttaagtattccagtacttccagaacagatggcggtaaaagtgatccaacttttcagctatcattagcgggctggatttacatttgcttaatgtcttggccttcagatcgtgcactaatccccacttaaccaaagagaaaatcacagctcttgtccagttctgggacacagtacatttaggtcttctcggccttctcaccgctcctatacaaaaaaacaaagacaatgtacatagcacatagctaactgtgtcatagaacttgggaaacaaatactactactgtactatgaacagcttttaagaaaccatcgggcttaacccatgcaactttctgcccttgtatatattcccaacggcaacccctccgtgtggcccttctctctgtttccctccttgcacgcttgctgctcgatccttggctcattacactgccatcaagatcacctcatgtctcccttcatatccatttcttcttgctgatcattatcactactcgtgtgcctagctagtgccttgccatgtcttgcttgacctctcctcagctggctcccaagatgcagcttaagctcactgccgctgtcgccgctctcctcgtcgtcgtcttctttgcgctcttcgtcggctcatgcgaggcgcgccgccttcgtgcccttggcagggtcagctcgctaaaaccatcgtcgtcacctcctacgccgtacaaggttggtgcagttgaaggaataacttggtatatatcggaatataaagtgttccttttttttggctgttctaatttttccatgcttctcccttgtgcaggatgcggcaagcatgaagcttcatggttctgatccaacgaaccagaagaaggatttatcaagtactagtatggatcatcacatggctagcggggacgatgcgaaggcgaaggacggagtggcaatggcatcaccaggtgcagttcagactacgattgtcgttagggtttcgaaccggctctctcatcaggagcgaagggtggacacagcgtttcatctggactacgctggccctagaacccatcccccctctcacaactgatgagtatgtcgttctgtggcattctctgactctgtctgatgatcttaattactaatatgcaacttaagtgatttatgtatatgagtgttcaatctctaattctggtgcatattcttgcttgtttgctcttatatatgctcaatttgctaataaattaatattatcggtataaatagatcgtagaatgtgtagttttgtagaaagctcgccggctagatattttgcttgcttgaaatatgaattgaagttcacacacatgtttatacatgtaagtttgatagccgtgtgagaactatatgttgacatctatatgttgactatatacaaaacttgatagaaacatgaatcgtaaatatgcattctacacgtcgataagataagataactttatgtgccaactactcaagtaagtaataacagatcgatcttcaacatttgtcagcctattattatatatatatatacccagctacaattctacatacactaattattatagccttattcaaacagcggatgatcacatatatatgcaattagacaatcattttatgaattgcaatattcttatctcttgtttaattccggccgccatgatcgttaggtccgttccagcattcattaggagctccatctcatgggcacttgtttctttgggaaaatatatcgatcacctattttgctaatttatggtcttttatcgtcatgtatcaatcagtctaaattttaatttttaattttggagtccttttatatattctttaatcgtactctatttgctagcattagatttcagaccataactaatataaatataaaagttataatggtaaactatctttaattaatccttttttattgcttatcagtcatggctcaaatggtcatagcaatattttaatttgtgtgcaaacatgcattcttgggcctagtaatatgtaaaaaattttagcctataaatcctaagggttggactgaattttgtatacgtgtttgagaaaaaaaaagaaaagaaacaactaagttggactgtaaaaagaaaaaagaaatcgtgggctgtagcccattaacgctcctaattatactagctagcacgatactaggtagggtaattggagtgggacatccggacaagtgaattcatgcccgacgtatgggcgcgatcaatgatgtgatgatggtgttgttattacgtacctgtgtgtagcatgcatgcaagattgcaagtaggggccaaggcggcaacataaatcgcgcccatccggaatttagaaatcacgtgttctactaccatctgtacactgctggtgctggccatcaatattgcagctatcagttacgcatcggttctactagttcttgctgaactctcacgttgaccaccagtccaccacatatggagatgcggtgtaatttgggaacaaacctccctgatcatcagttccatcccagccgagatttcaggccgcgcatggcaatatggcatgcatgctttgttgtttgttcctctgcgttttgtgtgcttacctgggattggagcgctgtgtgcacttttgttcattccactggctattctgcttgtcaaccaaagaaaactcggtgggtccatacaacaacaagcactagccacaaatccaacaccctgcaactctgcaaagacatggagtcttcacaagagtactgttggcctcgtgcgtaactcgccatcgatcctggtaatcttgggttggaaccttgcttcaagtaaacacaacagtacgtacgttcgctcgccgagcttgttcctcctgagcatgctctccgtaagtcacggtgccctgcttgacgcctctgtgtcctgactaaagaatatattcgcttcaaatccccaagcttattagagcaaggttaatagtatcgcttactgcgagctatacttttatccacatcatttataactaacagagtagttaatttgtataataaacaggctttaacattagctaatgcaaacaatattttattcctcatttatctggttctctctcttcttgtttcctctgatttgtccgtgagcctttcaccatcttgaaacgcgtgtgtagctgagcgactatttagtcgtccactcatattctctctcataccttttctccgccagctcatcgttgtagtttacgtggttgttttagcgccggtgtagcgcctcctattgcacctgctcttagtactgctgctgctgcctctcagtttaacatcattagaggaagattagagattgcagttttgcaccaaaagcaagcaagcacaagtactagtctcatccaagagaagctctatggaaaatcgtcgttgacttgacaaaaataaggtgtgcagaaacaagcttcggtttctggaacaaccaagcagtagtgcagtactagtacttatagttaaagttgccaacccgaggagtgatccatgtgcattggggggcatatgccacacacgagtccaatactgtgacaagtatctcaatcttcccaagaatgtcccccctccacctcaatcttgccaacaatcggctagtaaaataaggcaaatgtgatgggcaggagaaactggctgctccagaaaagacagacatcccaacccagatccaagctaacaacaacagccggtgcacctcgcagccggcccgtcgatcagggctccatcatcccgtcggagaggcgggaactcttcctctgttcgaaagcctccccagcgtccaggcctgaccacgccttttcacgtacaacagatgatacagcgaaacgcccgggtaagaccgtaggaaggagggaacaccgttgagtttgggaatcggcgtacgaaaaggtcttgatgtcactgcaccctgtccgcgccatgcgcgacgccagagggagacttgacgacgcacgctgcgcgtatagcggcacagaggcttgcggacgggggaggcgccgcgaccgcgagggcggttggagaagcggacgcagagagagtccagagacagtggaggattggggttgtaaccgatctgcgtacgggtcgttgcggctccacacttgacacctgcaagcccatggtgacaccttttaggtgacccaagaggtttgggcctgattggtgccatctgctgggccgatgagctccgaacacgacctccttgctgcttttttcctgatgggttggagcatctccgttctccaacaatcactccatcagtcttctcaagctaaattttgataatttcagttaaaaatcgtgcttcaacaacctctcccactgaatggtcaaaccatccggttgaccaaatccctccactgatcacttgccaaatttgatcaaccacactcacttattaattgtgggccccatatgctatccccctcttcttttttgctctcacgcatctctcttctctacatcgctattgtccgccgacgtccctgccactaccccttctccccttgtgccagtctcgagggaacagtatacatgccgaccacgagaaagtagctggtgtaggcttgggtgcgtttgcggtgatggccgcagtggttgtatggaggagatggaagcaaaggaaaggaaacgtgcgggacagcaggaggcactgcccagaggcaccaaccatcaccataggaggaggatggagttggcatgggctcgggcacagttactgccgtccttttctccagcatcaactgccactaccctgttcggcgtcgagctcatccttggagtgctggtcttgaagtagcgggggcggacggggatagagctgaggacagcggaagaggcgcctcaccttccgccgcgccgtcttccgccctcccgcaccgtctaatcctcattggtgttgcctcgtctagcgctacccccttcctcgtcggcatctctagtgggataagacgaagatggggaaaaagaggagggaggagaacatttatgaggctgatatatcggtcccactattatagatctagagtgaagaggctgttggagtgagcaactagttttacttgccaaatcaattagagagctggctatatagatgtttgaagagtctaatttgtatggtctgttggagatggtctaagagaggtctccaaaagttaatgagcatacgtgcgtctaaaaaataatgatgtcatctattaaaaaaaacatagggagtacttgtctttttctttcaacaactctttatttacatttctcctcactatatctccaccaacctcccgctactcatatactcctaatttaattggaggcgtcatagtttttttttccttcctccttaaaatcttcaaaacaaattagaattctttagattatggaatcaaggtagtagtaccttgttgatcaacatttgatactccacagtcactgatatgatatgatatgatatggcaacggccacggtcccagctctcctcctccttggcttaagattttttatctgtttctaataatctgatgtgacgaccctcagacctcaattatcatgtgaagttcaaaactttgatgattaaatggtgtataaataatgtgttcttcctattcttcagaagaataataattctgatggtggtcagaaaaatctaagattctcaagtgattaattgacatttgattaattttagattcccttgtgtatacacatcttcatacattttctgctttatatagtaccatttagactacaatacagaaaaggatactatatagggaccatataacacctgcctttcatgcaaagcacgagaaaaatgtctttttaaaaaaaatagaagaaaattaaatcgaatgaaaatcgaatgctacttttttaggacttactcgagtgctactgggtcattgatcaataaaaagcaaccttttcctcaaaatgaaacaaagttcatgaaaggaacagtagcatatataagaatattacctgagatagatggctttgttgaattttctccaaaagacaggacaataagaaaatatattaacgattcacaactttcaaattcgtgctattacaaatacacgatataatgactccaacttattgcaacctttgtaaacagaacaaacgatcaaacccgtagcaaatttatgaaacaaatacacaccaataagtgtacactcgatcgactggaacggctctagttctgcagaaccgcggtggaacgtttgcgacagaagatcaacggtggtatagctatatatgcatgcatgcacatataaatgcagcgtaaatgcaactatgcaagcgtgcacaggcggcggcggcggcggctacgagtgtagatagccacgcatatatatatgcatcaagtttgtttaagcgcaggtgtagccactggggacgcacttgccacagtagttgacaaggaggctcagcttcaccgggatgttgacgacgacgccgagcacgttggccttgatggccgtgcagaggcagacggcggcctcgaggtcggcgaggccgctgatgaggctgcagcacggctgggcgggcacctggccgacctcgccgctgatggcgcccagcacgtcggcgcaggccccgaacttgagcgtgttcacggggcacttgttatggtaggacggagtagttggagtcgaaggcggcggcggcgggagggccgggggcggcggcgtcgggcatttgccgcacgcgcagccgcaggcattggccgtcgtgaagaagaggaggttgatggccaagagaaacacgaggatcttggatgccatggagcttatccttaagggtatatatggctatttgctaaggccggtgtaggatatcagagctagctagctagtgagagatggggatggtctagtgagagggttatgtgggtatatttatagaaggtaaacctgcaaaggacaaaccctaacctctctctttcgtggttatattgtctagcagtaacacggaaagttgttttcatctttagaggaaacatcatatcatttctcccatcttacataaaaactgcattcatcctaaaatacagcaactagtatgagatttgacacaacctagaagtctatcaagatttgttttactagttgtatctaatccggtactagtttgctatattttgaaatagtaagagtagtcattattttttttaaaaaaaatgaataataagataagttaatatgagataatcactccacaaacataaagtttaatttcgacttctacaagttgtaacaaaacaataaatataattgtgaagtgttatagtaaaagtcgaatttgaccttacatgtttctgaaatgatatatccatattaatttatcctatcatttttctttaactatttaggtaatatacaagaaataaggggatgtcccctcgtggattgagaattcatcttcggaataacacttttattggagtatgagtgaattgtttgtacgtcttattacttagcttaggaatttatgtgaaatagttggtatattcagcttgatatggtattagaattagaggtttcaaattataagctgccaaacataataaaataaactttacatattaaatgttaccaccagtatttttttaatatatgacatggttgacttttttaatccacttgacgagctaaggttgcagattataaggttggtaggggtggatgggggaggtgaaagggcgggctttcccaagcttggagggatgaccgcaagtggcagaggactagcagtgggcgaaggatgcgaggaggtcgctaggcaatggcgatgtcgattgagccatcgagatggatgagagctatggattggtgttggaggcaagacaaggaaaacaatagggttagaagctgtcagagaccatgaatacagtagggtgggggcacctaactgtcgcctagcttggaacaatggaaaacaagaaggctggtggggccttgcctgcgctagcaaggctttttttttttgggggggggggggagggtggaggggacgttggctaggagaggtggcggtgcagaaggaggtggcatgtgacttgattgagaccactggcgatctagaaaattggtttactagtgtcataacatacatactggtatcatagcatgctaatcatgcttaagcaatggcgttatcctatatgagtaaacaatttaaccataggttttgctaaaagttatcggtatcaccagacactgaacctaatactttatattcatccctgattgtgacttgtgatggaaacaaggggaggagggaagaaataacattggaggtggtattgtagctgcacgaaccatggcacgatccgagtcatttaaaggtgacttgaatgagcgagatttttcttagaaatattatagcaagcttaatagtacagcaaaccgctagctctaaaattgatacattatctacaatcactctaatgacctactcatacaatagttttatataaatatatatcgcaccattaatacttaattatagccttttttttcctctctcctattctctctttttatatgtgcttgtagttagaatatactccagcatgttctttttctgagatagacagtctcttaaaaattagctacatgccttataatattatttttcctctatatatttattaataaagagtaaactacacgggtggtccttaaacttgtaggggtgtgtcatctaagtcttcaaactctcaatatacagatccgattccataacatgtcaacgtatgtcatataggtcccaaatctccacaacttctctaggatcctacatgacactaatgtggcatgccacacggacgtgacatgtcataatcttgactaacaaatgggacccacttaaaaattttcatttcctttttcttctatcttctttcttttttatttttcttccttttcttctctttttcttctctttcttctttccttcctctcagttcagctgtaggccaccactgaacggggtgctcgagtcatagagaaaggagaaaaaaaaatagatttaggagaagaaaaaggaaagaaacggaaaatgaaaatttttaagtggatcccatttgtcaatcaagatgatgccatgccacgccacactagcgctacgtaggatcctaaatgggttgtggcggtctgggacctagatgatacactttgacaagttctgatattttaatctacattttgagagtttagggatctagatgacacacccctataagtttaagaaccgcctatgcactttacccattacatatatgtgtttagattcattaatatctatatgaatataagcaatgttagaaagtcttaaaatatgaaacgcatagagtaataaataacgtgttgtactaatttaagcataccacttctaaagaaagtaaagatgagcacatttattaacacatgccatgcctgactatccattctacgctactccttctgtcccataatataagtgattttgacattttgcttgtaccgtttgactacttatattattcaaaaaatttgtgcagatataaaaaacaaaaagttatgcttaaactactttggataataaagtaagtctaaaaaaataataattctaaatttttttaataagacgaatggtcaaacagcgcaagcaaaatgttaaaatcccttatattagggaacagagggagtactttcctgtctttctgatcaatttacagaacaggcattagcccttgtttagttcccaacattttcttcaaacttccatcttttccatcacatcaaaactttcctacacacataaaattctaattttttcttcaaactttcaattttagttaaactttcaattttagcgtggaactaaacacacacttagaatcaaactaaaaaaattccctactcttcggtacagatggaaaaagatatggctggtagctaggcatatcaaagaaacccatgtggaaatgccagggccagggcgagcagcgagctcgtcctgagctggctggcgagagttggcttgggagctagccggcgcggcctgcgtggagcgcgcacacatcagcatcgtcgccagctcggccgcccgcacgcgctggtcaccacagggttgatcgcgcattggctccatggaccgatagaaagcgaagtatcagtcgcgcgcgacctcacggactgcacagtagcactagcgtgtggcagaggaactctctgtgatgtatcggccggtgatcaggtctgcacagtactcatggtcttggaagacgatgaactctgtctgtatttggccttttgttggcctgcttatgggtgaagcgctgcaccgacgttacgctcctgcttggctacagggaacttctggctgaggattgatccatgtaaaatccgtggagaaactaatgtgctcttcattcattcttcaattaatcatgaccgtgtaataaagcatctttgcatggttaattagatcgatctgtcgacgggctgtaaactggttacgggcacacatgcatgcccctctgtcaacggcagaagtacgtacgttcatcgccatcaagttttccaggatgtggcccaacggcagcccacggattggagcccattgcatggagggcggcacactgcacagttagcgcgtcccagcctgcggctctgtgccactgcaagcagcgggcaagaaagaacaaggaatcagtataagccacgcgtacgatatgaacagaaatatctggcgtaatcaagttctcgtgtctcatgcaacgtcgtcactttcaccggcacaaacagcgtcccggccggccgggaggtcacgggtggacggatgtacgccttgacgatttgatcgatgcgctacccatggtattgttgccgtcggcgacgagagattaaagtatgtttcgacagatcggttgcagtgggaatgttccactgtaccaagggcagggtttagatctggatctcttgaaacaattatttggggttagtgataatttcgcttatctctttgtacttttataatgcaatcaagttttttgcgttgggcggacgtgcatgtacaggcataccttacaaattaagggatgtacgtataagctgatgtgcgttttgtagccggatatccttgcgatattggacggcgaatttctttggatcctcctatactttgcgggtcggtcacggcataaataatcaatacggtaccgaacttgtttctctgatggatcgagaactatatacgtggtccaccacccggctagcgagccaaggatggtcgcgcgcggattcgtggtgcacctacgaaatccaccgcagccgacaagacctccccgcggtgtattagcccgggcgcgcgcgcccctgcggtgtaccgagagccgggtggacgagtaggtcagtaggccactccggcccacgtgcttagagcaagtttaatagtacagctaactatcaactcgaaatcatctataatcaatgtaatagctaatttatacaatagttgtttactatactactaatacatagtcacatatgtcatatacacattacgtcttgaaatccgtgctgcaactgactacaaatctgtagcccgctgctcttctctttctttctttatatctttaaaatatgtttatagctagcttttagcttgctattgtacctgctcttaatagtatagctaactatcgctccaaatcatctatagttaattttatagccaattcatacaatagttacccataaacatatactacacaattaatatctggtctctcctgtcatatatacatgcatcttgcagttcgtgttgtagctggctacagatctgtagcccgttgcttctctctctctctcttattttatctccttaaatatagctggcttatagtctgctattatacctactcttaaccagaagaggtaagtaggtaacgtgtgtgatggcttcgttgcccttgtagttgcagccgtccactattagctctaatttatctatagccgatctaataacgaatttatacaatagttgcttactatactattaatatatggtccgacctgtcatacacacactgtgtcttggagtccatacaaatttgtaacccgctgctcttctctctcatattttatctcattaaaatatgtttatagctggctaatagtctgctattgtacctgctctgaatggtgggttcaccgagcgaatgttcgcacgcggtctaggtccgtgaacacttttggttcaacccacgtatgttatctttttgccgaacatgagaatctgttgtgagtgaattgcatattgggccatataaatttaccagagcttcagcttagaccactgaagcatctaggcccctggtgttaattttggtaattaatgacaagcactaattatggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctctctttttcattacacacacattcatttgcaaattcactgggttcggcctgaccaggggcggtcagaccggccacatagtggcggtctgaccggcgtgccctggccggtctgaccggccccgcgggcggtctgaccggcggcactttcccggtcagaccggccccctggaggccgagatgatgctgctcgggatggccgatacagagccgacggagccgtagtcggtcagaccgagctgatggcggtctgaccgagccgaggccggtctgaccggccaccccatgtcggtctgaccggtcaggccgatggggccctctgacagcacttcaacggctagttttctagccgttgcagagtagcacggtctgaccggccacataccttcggtcagaccggcagagcacaaagttgggggatttcgccaccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggcttccgccttgcccaccccttgacgaagggggcgtgcggtggctttgtggttgagcggtggagttgggctcgcctcaatggggagtaggaaaccagcgagtttccgaacctcggtgaaaaatctcttgtctcattgtctcatttgattgtcgcatttacatttgtgcaatttactttcctagagatataattgagccactatcaccctaggtttgcaaaacataacttagttacttagttagagttcaccctcaccaagtctagcaacttaggttagatttgattaggtgttatttaatttttaaatcgcctatttacccccctctagtcgacatctcaatcctacaaccacccctaatacaaagatttcactttagaccatataactttactatttttttcactttggaccacccttgtccaccatctccaacttcagcagcctgctgccactgttggtgtgtgcgccaccactgtgaggatgccaaggtgccgtgagggcttccacacgattgttgctggcctctgtccactcatcccctccctttcagtttgtacaatcgagctgccatcgagcatgggtggcttcctcaaaattgatcaacagaagcttagagctggtcggcacatgagctccaaccgttcttcgcctgctctggccgattaactcgagctcagctgaaggctgaagctatctctacgcgaactggcccgatgcacgtgctcgcagcctcgcactcgactgtacctccttcctagcgcgctctctctctctcggatgcattgccggagttggtgaatgcccgaagaagcaacggcttgccgcttgcgtagtgcagtagtggtggcagtcagctagcaaatggaaacggatagactgacagattgatagaatagtggcccaatgtgcaaagatggtaacaaacccttgcctaaagtgaaaatattgcatatggcctggtccaagatggaaattaggcaataatacttggcccatgatgcaattcactcaaaactttatgcatagctaagtgattgtccagtactctaggaggtattagaaatacatcataaatgtgtaaaatttgataccctactattaattaggagatatgaaaattacactaaaacttttttttaccacttgttatctttgagctgaggcactgtaaaatttctcttacacatataaatgatttattaaaattttattgtaaaagtatttcaatccgaattcgaattaaatttgaaaatatactgtttatttaattttttcttataaatattcgggatgtaaaattttttgcgtaaatataccgtcaatctcgcacaaccgttgcgcgagaataacgtgggaatgacgtcgtgagcggtatccgcggcgaaagcgcgagaccgctcggtctcacggaatggtacagcgagacagaacggtctcgcgcaaggactgagcgagaccggtgccatgctgattcaattagcgactaattatcttaattagcaattatttatttattaattaatcgctaattaagataattagttgctaattattattagttaattgctaattaagtaattaagcactaattaaatggaaccggtggacagtttcgctgtttgattccgcgaaaccgaacggtctcgctcttccattgcgcgaaaccgcgcgctctcgtgccttcaccgcgcgagaccgtgcgctctcgcactttgaacgcgcgataccgcccatgacatcacacccacctaggtttcgtgcaacggttgcgtgagatcgacggtatatttacacaaaaaattttgcatcccaagtattcatgagaaaaaattgaatgcatagtatatttttaaatttaattctccgaattcaaggtttaaatcggagtcgaacatgtaaactctttcagtgcataaacttaaccaaaaattaaaaaaaaacatgtgctgtaaaaggaaaaaccataggcatattcgcatgtctaggtcacgcgagaatgttcacgcctgcaaccctgcaccccttgtccgattggcctcttgttgacttgttgacgtgtagcttaaactccggctcgcacctactaatagattgcatcctcattaaacatgcattttttaagaaaaaatggttcatgtactagatttactaactatatatctacaatgcagatgagttattttcccaactatatatttatgatctcttcttgttaagaatatgtatgtgctattacaccaattaaacgaaatttgtgttaaatttattgtgggatatatatgtgtagaatttagtacaagttacatgtttttttacgtgtgcgcacgcttatctttgggggccggggtatataacattgtcatatatttcctccgttttatattgtgtgtctagatttattaacatatatatacttttttcatctcaaaatatagcaacctagaatcgaattgaacatatcctagtactacgaatctggacatgggatacgtcatatccggtcctagattgctatattctaggacggagggagtatatgaatgtgggcaatgctataaagtcttataatatgaaacggatggatggagtattttagtagaatacatttaaaaaaatcattacattttagacgatgacatgaaagtgatgagtaaacatgcaagcacttcagttacaaataacagagcagagagactttatttttacgtactgaatacaatacaagtgatatgaatcaaacaataatttccaaaaaataaaacaaacatgtaccccgatgcataatctcgcgtacgcgcggagaaggccacaaattaaacaaaatcatatcgaatcaaaccagatacgtacttcttgccaccaaatgcacgcatgcatgaacatgcccatgcatgacaagtgacaacacgctgctagcacgtaggaaccaaataaacccctgttgcgttgagacgtgcatggatcgatcgcgcggctactttataaagcctttagaagcacttgaagccggtgggcacgcgcttgccgcagtagttgaggatgaggctgaggtcgacggggaggttaaggttgatgccgagaatgttgcccttgatggccgtgcagaggcacaccgccgcctcgaggtcgacgagcccctccagcagcgggcagcacggctccgccggcggcacgcccaccttggccttgatgaggcccagcacgttggcgcacacgcccagcttcagcgcgtcgcgtgggcacttgccgaatgcggcgggagtcggggtgggcgtcgacggggtcggcggcgtcggcgtcgggcagtggccgccgcaggcgctgcccaacgagaagaccaccaggttgacggcgaggaatagcgcgatcgaggccttgcctgccattgctgctgctggatcacgcgcactaaaccgaaacgatattaattatctcttgataactcgatcgatttgcttagtgcttgtgatggtttggcattcaatttgacgtcgtatttataggagatgattaaagcaatataatgctgattggttatatgttatgacgagcaaccatgcatgtgagggtgattaggaagctgatctggattctccaaggaaagtacgctggaaatactttagctagtattgaacagaactagctagagaccaagattgctgctttgtgaatgcacgttgacgtttgtacctgcttgaaggttttggtcataattctgcttaagcatattcgcgtatggggtggctgctctgtctctctgtgcctagctaataacgtgcacaaaatgccaaataaagttggttttaattagtaacgatgcaataattaatgatcagggaaaataaacagcgaaagaatcattcgacgaaggacacccgtgttaagttgttttcaggtttcatagtgtacgtacttgcagaagagggaaaataaattccaggctgcagttttgtttcatttggctcacgggatcgtcgtcggatgattctatcgaaaattcgaacatatgcacttgtagtcttgtttggtttgcctcgtatgtaaataatctaatcacgtcgctgtgctacctgatccaatatatataatcacgtcgttgtgccgtcgcaggttttttttggctttttcttcgtgtgggtttagcctaggtttttacttcaaaccatgcttatgtgagggtttttggcttggttttctcttaaaatctaggccaagtcttttcttcttaaataaaaacagacactctttgtcctcttctgtgtttttcttttaaaaaaaaactatgatcttagacgttaactctaataaatttcggctgactttcttcagccagcctagtggaaaaaggagtagatcttgaattttgtctgccagatgagttacttatttattacattgtgtttgattttattcgctacaacataaccgttcatctctgacggttcaataaggttatcactaattattgagtgatccgatgttgattattactcggttgtgagaaatgactcattgtaacatgtgaacatccgtgagtgatcaagacatctataacgggccaaaaaatatcaaatgtgacatatatgaaaatcgacaaaaaaaaaagcaaaaaacataatcacagtgggagcttgcagtgctcgaggctgagggtgtagaaaagagagggagaaacgacagtccgccactatttcattgcttctgctcggatgggtgagggttagcacttaattagcagcatccgtgtcggtgctccggcttgggataggagctagacggtagccgcgttggtgctcgccgtcatatgggccactgtagtggcctctagtcattatcgtcgtcgtactacataagatcctatgttcttgagctcaaactagtcgaatatggcatcctcgagctcgaagtagtcaaattcagttactttattatttgtggagagggttaagcaagggagcattgctggttgtagggggcgaaggaagagacttggggagggaggggggaggggaggggtaagctggcaacatctgcattatgctcatgagtacgatgagcgctgctcgtttcaagagttcaacttgtgcgagagagataatagagatgcaggtcgccagttgaaaatcatatagattagaaagacctgctagagagcttttctctaatggctcgtatttatcattcgttatttatgatgctcatgatttgtgatggttcttatagactctagagatcaaagctcatctttaacgactacccatatattggttcataactatggcccaccataaagggtcctatacctcttatgggtcattctccacaggtatatttcaaacatactactttttagccattagaaatgagttcatctcaatgttttgtgttgggccgttacggcaccttttttttaaaaaaaaatagtgttttgcatgagtttctgaccccttttgagcttacccaccatatgcttacaaccttcttacccaccctaagcggtttggtaaacccagggtggcattcgttcacatcacccattccacgttggacatatgccataatcccaagcggtgtcaccaagccaatagatgacagcgggcatttattgcgcaccagacacaataggttgacaaggagtaaaaattcacaatttagtcaatctttcaaaacaatttaaccgtcaatattatattagaataagttttaaaaatctaacatctttatgatattatgatagtactagtatttttcaaggaaaatttatctatatataccatttatttgattttaaagtaagtattcgagaaagtactatcgatggtcaaaagttcacaaattttgataacttttgtcttaaacgtctaagtacgacgaaaacagctagtaactctttttgcggacagacattgggcattccaaacaaagtgtgaaatttattttattcataatgcaaaagaaataatcaacagatcatacaaggacccacacatgaaacgaataaaaacacggaaaatcgagtagctccatggtacgtgtgcatgcttaatttgcaggtgcacgcatgcatatttgtcgatcgatccatgcatgcgcgcaaatgttgcaagctaagctagcacgtagtagcaatcaaacagtccagataaaatagccagcggaacaaatgcgcagtagcgccgccgcctatcgatgcttagcatttgaagccggtgggcacgcgcttgccgcagtagttgaggatgaggctgaggtcgacggggaggttgaggttgatgccgaggatgttgcctctgatggccgtgcagaggcataccgccgcctcgaggtcgacgagcccctccagcagcgggcagcacggctccgccggcggcacgcccaccttggccttgatgaggcccagcacgttggcgcacacgcccagcttcagcgcgtcgcgtgggcacttaccgaacgccgccggcgtcggggtgggcgtcgatggggtcgacggcgtcggcgtcgggcagcggccgccgcaggcgctggccaacgagaacaccaccaggttgacggcgaggaacagcgcgatcgaggccttgcctgccattgctgccgctggatcacgcgcactaagctgacgagcgattagctctctggagtttcaggagctcctgattactagctcgattgctgtgtggttgtgatggtttgatggcatttgtggcttgagtatttataggagaaattttggtgcaatgctggatgattagtgggtgcagctgtgagcttgcatgtgaggatgatttgctggttgatctggattggcctgaatatattttggtagaacattatagtgacccagatgctgcatttgaggaacatgctgacgtttgtttctgttcggtgattgatgatagtttagcacacaatcttggcgtatggcatggctgcactgtacctcgtaacatgcaccaatggcgaaaaaccgaattaattaggaatgttttttggcgtgatcggttgatagatcacggaagggacgtcgacatgtactggaatcaaagcaggaggaatcatatcatgctaacttgcttgagctttccagacaaccaccactccagcccatatttcggttttttcggaaaatgctagggcaggcgcccgatccggcgggaaaaaaaatcggacgccctctcccccacgcgcgcctctccgcgaaaaaaaggcgccctcctccacgcgcgtctccgcctgcctcccacacgtccccaccactcaatgccctccgttgcaacaaatctcccacatattacggaaactctctgttaagagaatacgtttcattttttttctcaactagtgtacttataatggttaattatgtatggatgaaatgtgaaatgttgcagtgaattgaaatattcttttgcaacaaattacccacatattatggaaacgctttatttagagaatccgtttcaatttttgttccaccaacaatgtttcagtaagtgtactcataatgtttcactatgtatagatcaaatgttgcagtgaattaaaacattatttcgctatttgctgaaatattatttttatataaggtgaaacaacgcctgattttttaaaaaaccgttttcatacgttgtagcaaaatgttttatgaggtgattttgttgtgtttcagctttttaaacgattgaaacattttcgatctatttagtgaaacaattccgatctacttggtggaacaacgtgcaacatttaaaaataattcaataataagctaaatattttttcatcggattatatccatgtgtggtcttgtttttttttaaaaaaaatcgagcacccgatccgtaggtgcgtcgattgttttctaaagtaaatttcgatggtactaatagtcatgaatggattttaaactgttgaggaaatattccctcgttgtttgcaaatcatccaaataattatgaaagaaaatggcaagatatgttaatatgtgatatatcactctgaaacatgttggttaaaattcaattcctataagttaaaaaaaatcaagttcgatttatataagttaaagaaggagttaaaatttggtttctatataagttaaagataaagaagacagtcgttgctcgttagcttggtgtaagagcatctccaacaacatctctatcttcctctccaagttaaaaattgacatttttggacaaaaacacactccaacagactctctatctccctctccaagccatccggctggccaaaccactcctcccgctggccaactttggccagccaaaattgacttgccaatcatgggccccacgccttttcccctctccctctcccctcccatattctctctccacgccctcaccctcctcccagattgctcgcgccggcgccgcccctctgtcgtcgttgccccttgttcgcggcgccgtcgaccgctgccgtccgctcgcatccttcgcccgtgctcgccgctgccactcgctcgcatcctcagccatggctgactggtgcagcgagcagagcggaggaggtagtgcaacggtgagggagggagggtgcggcggcgagggagtagcaagggaaggaggggaggctcaacggtggagggctgtcgaggaagacgaggctggccgcgctcctgtcgtcctctgctgcccgtgttgctcccgccgtcgcagcctccatcctcgcgccacactctcgtcgtcctccaccgcccgcaccgctcccgtcggcgccgccttcatccccgcaccgctcgagtcgtcctccgccgccgcgccgttcccgccggtgccgcctctattctccccacgccacactgcagagaagagaggagaggaataggagagaagtgggtgaagaaaaaggggagagaagtggaggaagaagggttatttgaggctgacatacgggtcccaccgtcatagattcataatggagagtatggatggagagtctgttggagcaactaactagtctgactagctaagtcagatagagagttggctatataggtgtttggagagtctgatttagagaggctgttggagatgctcttactggtaaacgaaacatggaatatttcagcccagataggccccaacttctctcaaccgctatcatgggtcacagatttcagccctgatagcccccaacttctctcagcccagatacgcggagttgcccatgaaactgtgaggcctgaacgtttataagctttggcccattgtaaacactattcacattggatcttgatgatttcttgaggttagttaggcctcattgagaattgcagtggctcctcccaccactgagaaacgagcacagcctcatctcacgcggcacgatgcattccatcaaatcaaatccaatgcacagccgctttgcggttaccgaagcgcccgtttcggcgaagagtcgcacagcacaactcctcttcaaagcccatcactcacacgcgacgcggccgctcaaacaaaagcaaaaaccgcccactactttgctcgatcgatcgagaggaggatcgcgcagacgtagttcgtgcgccaccgatcgacgacgcgagcatggacgtggacatggagaggccgccggcggcgacggcgcagggcgtgcggcccaaccccgtcgtggagaggaagctcggagagctggacgcctgcctcgccgacgcgatgtcctcccgcccgcggcggagcgacgtcgacggcagcctcttcgcggagattcaggccaagaccgacttcctaaagacgcttatcgccgcggagggggagtgccacggcggcgcgctgccggagcacctggaggaggccaaggcgcgcttcgccgtcctcaagggcgcgttcgacaagtgggcgcggcgcgacgacgcggcggcgccagcggaggaggagcagcccgacggggcggccggctcggggtccgagtgctcgtgcaccgagtcatgcttcggggtcgaggtcaccggctgcctggaggcgacgtccgacgtcgagcgcgaggccgtggaaatggcgacgctcggcgccacgttcaacgccgagcgcagggccggacacaagccgtcgccgtcgccggcggctgcgacaaggaacgctgctcggcggcgcggatggaggcggagcgctgcttgctgcggtgcagccggcgccgtggcggtgctcgcgctcgccatcggggtggcgattgagtttgcgtcggtggctcgccaaaacgtttacgttgttccgacctgacagatttgtttcccttgcaatttcgctgtttttttcgttgtggcctcctacagtatttagcaacatgtagagtagctaaatttcgctcttcctgtttcttgtgtggtatccgactactcataaacatgtagtagtttactgtaagaagtaaatcaaggagatattggtattttatagtctgcatacattctaaactctcttaaatgtgtatgaaaaaatttgaaaaaaaatcaacatgtgagataaaatttaacaagataaattaatatgtgatagatcaatccacaaacatacaagataaaatttaacttctacatgttacaataaaaaattaactgtgaatgtacattaactagttgtagtttaatttgttttattttgtaacttgcgtattagtggagtcatatattacatgttaacaaatcttctgatttttttttcatttttatcataactatctgagtcatgcaaacaacaagaatgttctctccgagactttaaaatcccttatttgtttctgcatataagagattataatcctgcataaaacttgtcttaaataggttagtggggttgcttggccaaagctatgacgacttgacgagtccttgtccatggcaatcatctgtgtctgttcattttgtcatctaggctcatctcttcacttcttgagtcaatagaggaagtagtaaaactttgttttctctatctatcacggcattacagatcacaagtacttcaattatgctatacaatttacatgaataaaatgcaaatagctcgtcttctatctgaaaatgtacaacctattgaatattttctatgcgtacactactactctattgcctgtgacagtattatagatagcggagatggtgcgttagcttggtggaaataaacagagatcctttttgcgtaaacatatgactaaaccttgatctgcttcatgaagtgcccaatgcagacagatgacatgaaaactagcagcacaaacattgctgagaagccctgttgagatgatcttgctgccctaagtagttcctgaagcaatattaaatttaaatgttcagacgtttgacaaaaaaatacaactaatacttgtctaagcagtcgttttaaaaaaagtgtgttgcagttgtgataatcaggtgttagaatttacaagttgtacactgaggttgttcatcaatattgagggcataataactcataattagcaaaagcctgtaactgaaattgtagttctggtaacatttaactcgagagatagaaaatgccaagccaatttcagtcatgtttcttaaagaatttattctgtccttatatacctaccactaccggtgcatcattatttcagatgagaagatacaaacaggaatagcattattcctactccagtttgtcgactactgtagctcagtaacgcaaatgttcccttcatggaaactaaaggactagggctcattaaaagatcacctatctatcaccaaacgccaatgcatcccatatcctcattgattaaccaatgctgctattcaacagtttcctggagtcaaaagctcctttgtacatatttatccaataaagatatccagattcggtggttttatgtcactcaaaaataattcgctttgtaccaaactaccaatagatttgattgagtacgtgtcatttttgcagagttcaatccagctttttagtgcaaacatattcagtttaacaatattgttgcctcaggcataatcagggtgaaaaagttaagtattatcactatttccttcaagatataaacattgtttcaagaaaacgatttagaagcaggtactgcagtagaatccaacgctgaaatggcaggctattcaaagagcgtaacatacaggaaaaaggtactgaaatcttaccatctgttgctgaagcttctgattttcttctactggatattctctctctgcaaccagcattgattctacagagacaccctgaacagccacacgcaaatgcaatatgagcaaggcagagcaaactgatagattaaagcgtcagtttactgcaaaaaaattctgagtataacccgctaaatagtattgtctcaaccaaccaaacaagacaatacactgaattataacatacaggttctttgttttaggtatcatactgctgtactgacaatggcatggtaccaaacaaggtcacttatctacccagacaaaacaaactgaagaaagaagttgactactaaacttttgataatgacatcaagagtctcattctgcaggagaagcatcacaaggttgttaggtaaaacacgttagagataactttgacatgaaaatttttagtattacattagctaacatgtgattgtgatgaacctgaaatttttgttttcttttaaaatcggacatcggctcgtgtgcaatgtgcatttttactatagaaaaagcatcagagtacactcaatattttttaaaaaatgtaaaacccggatgccattatgacaatgcaaccaacaagactatgcatcactcatcttagtgactaaaaaaactttaaccgagcaaatggttacctcagcagatgaaactttgtctgctgacctatcggtgagtgtggatacctgagaaggaaacatgtatgatattgttttctctgtagcaccgaataaacatcaatgcatgatattacttacagttacagcatcaaacactgatgtcattttcactccatggctcatgacctctgactgaggggatgcatcctcttcctcttcctcttcctcctcaggcactggagagggaggattagcagcaacatacaccacccgcagcttgaactcctcgatcaccctgcctggcgctttagtaaactagaaaccacaacaccatcagctctaaattttggtaagccccggctagagatatcagatatccatgaagattgctacaagaacttaccaattcagggacaaagtctctcatggtcgccccatatccaaccgccacgctctgcacgaggaacttgtccttgcagtggtaatcggatagcatttaacgggagcctgcattgtaactacaccgatttcacaatttcagtaacgacatgaacacaacagaccgatcggcaagtcgagcaaattaactaattaagcactgtaatagtgtaatcatgtagagcaaatcaagcaaacctcacctgtgatatcgcacgagctccggggcggcagtataccgcaggcgtgccgcacagagtacttccttgggttcgtcgttttcacctacggattgtcagttttgcagaacgaaaatccgtcaccctttcctccaaacgcatcacatgctcacagcagcatcagctcagagcgagaagaagaacagagtattcattcaccttgaacgccacgtactggttggtcttgttcgtcagctgcatgcagcaagacctcttcctcttgtactcatcttatcaaaccaccgcataaacaagaaatcaagaagaaaatcagtcaagaaaagcttgaagccaacgctgcgaacaatcaagagtttggttctggaaagcacttacaggggatcttgagctcggaagggtgcacacgaagcagcgtattactcatggctccgatcggacagagcgagagcgagaaaggaggagcagcaacagcggaaaagattcggccttttgctccctttcccgttccaaagaacctgtgtgacctggacgtcgcggcgcgggaagtggctaagcggttgctgcctcttgaagtaaagtatacgggcaaaatggcgatggtatgatgagcggatggtgatctggaattctggattccgtggagcagctcggggatcggaggaataggatattggcctgaactttatggtgggatcgttgcggcaaatatcatatttaagggataggattagaatgctcgtcatggtaattgcaaaaacctccaatccaatcgcattcgttggatgcgacatcaacgttgccgatgtgagtcctctggattttctttttggtgtcagctttgggtatgcccttttttatatactagtatattactactactactaatctaggatttttttccccctggaatgtgtagcctatttcagttaactaactgcctaatgcagaaatttatagaactcataatgggcacactagtttgttgcaaaattggctaaaatttccatctgcaaagtgcatttgcagttctctactctgaatcaacatcacctgtcaaacaacctccacaaaggataatgtatcatgtagctagaactgggtaatccaagatttggtagagtgtggtagggtaagcctaactaaaggcctcctcaactgcctgcctctgcagctgaaacctgaaacattcagctaattgatattcctgagttttgtttccttcttatcttaaaagtgcacattcggtagtggttgggcaatcaattattgttgagatatcagcttccaagactatacgagtgcgaaattgtttgggcttgtttagatatcgactggatttaccataaattgcagaagcacaacgttcaaatgccccatgtataattcagttgttctttctctaattcagtttatccatcataattcacggccggcttgacaggccaacaccacgttgaggcccattagttgtcagcccaatgctcacgtggactcaaaaggcccaaatagcctattggaaaaagtccactttgactcccttaattgttcaccgaatctaattcgtgacccttaactacaaaaccgggcaggatgactctcccaattactaaaaccaatacaaattgaatccctcaacggttttggagggtggttttgctgacgtggcacttggcccattatgctcgctgtcagcctagtcatgaggcccacatgcaattgattagggaaaaatataaaaaacgtagggccagcttgtcagggcactcttctccctctatcttttaaataaaaacagcagagcaaccgccgccggcagcgatggcgatggcggtggtgcgggcggcagcggtggatggcaatggcgatggctatttgtggcgccgcttcggctcgtcgccctccttctcctcctttgtggccgactgctgcgtcgcgcacgccacccttgtggagcgcggcgccgctctcgccgaccgcctggaggtggcgcgctcgctcctcggcgagaacggctacaccatcacgcgctgcagatgtgggcccgtgtggcaaatcctccggcgcaaccttgtcgccgagacgctgcacctatcgcgcgtccgcctggcggggaggtcgagggaggatacaacagatcaacagcaactcgtgttttctagtaacaactacagagctgagcaggacacaagccgccgcaagatttcatcagtgatattcttcttttgaaaattaatcatcagtgataatcgagcggggcaggcgtatccttgagatccatccgctggaaatggacatcctgcatgcacatcacaagcaaaaataattcagtcatcacaaacctacacaaagcacacatcaagattgggaattcacacgcacgaacgtaccgatgcgaaatggttgacgtcgcggtggtgcgcctcgtcggcacgaacaacaacgacgacgtccttgagcgtggcgccggcggggagccgccagtagtcgatggcgatcggcggcgcggggacgttctcgatcttgccggcctcgatgtccttgaggtactcggtgtaggagtggatggcctcctcctcgaggtagccgacgacgcggtgcgcgagcttgggggagaggaggtagccgaggaagtaggcgttgaagaagacgcgctggacggcgagcacaagcgtgcgctcgtaccacctcggcttggccacctccatgaaggtcatgaggtgcatccgctcgttctcggcctcctccagcagcgcgcgtatccagtcgccgctgtgctcgaagctagtggcgctggctcagtcccgggccttcctctccgactgcctcatcaacgccaccaccggtcacccctttatcttcgagggcgccttcttcctctccctcgccacccgcatcaacttcggcacccccaccaccgaccccgtccgctaccccgacgactgcgtctgggagtccgacatggcgcgcagcccaacttcctcgttgaggtcgcgcccgctaccgctcagacctgaccgaggctcgagagcgaagctcggcatcgcccagatgcggagctcggcggccgtcgccccccgcctgccgtcgcccccctgctgaattgggagggagagagataagggggagattggggaggatgaggaagggatagactgacatgtgggcccacaaattcttcttctatgtgaatgacaaatgggtcccacgtgtatgttgttagttataatgccacctaagcgtcacatcaacagcagaccaagtcaacattgccatgtagatgccacgtcagcgaaaccactcttcaaaaccgccgagggattcaatttgttccggttttagtaattgggggagtcattctacccggttttctagttaagggtcacgaattagattcgatgaacaattaagggagtctaagtggactttttccttacaacaatatcgatcccatgggccaccgtggtgcaggcctagttgaaggctgcaaaatcccccttctacccctccgttctcgatatatacgccgccgcctagatgccattctcctcttctctctccttcctggtgcaacacatcgatctcaaattcttcacaggtttctctcatttcccttcccttttattatgaacttttcgatcttttctcccgcgcgctctcaatcggttcgagaatgagaggattcgttgtcggctcgccttgtgtttttgccccccttattttttttttcgtttccaattccatgatatttcacatccggggtgcaagtttgtagatttgaatacttttaggggaatgccatatatactagatcggaactgttcatggtgtagttacctttctggcatactccgcgacatggtgtattcatgccgcgcacgaatcgcatcgatgttttctgtttctgaacttgattgtctaacatgtcgttattactttagatcgtatttattccatgatagactcaatgcatgtgctgtctattttgtgatggatattccccccccccccctgaagaatcacttccttgtagttctctaccgtcagattgaatttttacagaaattatgcatgattggtttttaaaatcgaagtttacagcaatgcaaattgactttggtgccctcatgattcacttggcaaaagagaagttaggcgtacctaccatgtcattaagggttaatgatcgatactagttacttattgctaaatgttttctcgggtagcttatcactgtggatggttggcattgcattcgtaataactgaatccttctggtaaatggcatgccattttcagattatttgaagcaacaacaatttgattctgcaatgtgggcagatcggtgcatatttgtactttgctctttatttgaagggaatgtttatactttgctccaaggccttttcaaccaaaatattgagataaacttttctgcccacaggataaaaattcaatttagagcgttgagatcaaagtttttactatgccgaccattatgttgttttcattctttcctcaatgacaaggacgctgatgtagcataattactttctgcgggattaatctaggtgcaaaggggattcctgttggatagatgccattatatgagtttgctcatgtacgcatgatgtcatgtaactcatcttgtattttgagatttttcaagataaatgacgcctcttggctcttgcatgcaccaatgctatatgaccaggtatatgcgtagggcggattacatggccttttctatctggctgtcatttttctgatgcacataccttcttgaactggagagtacatgaaggtaaatcacatttttgtgattgtaaagtatatgtgcgtttagttgcgtcatattattatcttgtgttttttttttccagatctctgctaactttctgttgaacaactgtgcacgcacctacaccaagaagaaaacactcaagaagtggtttttcattgacaagaccctgggttaaatctagttgaagaaggcctattccacctcattttggtagtggatatgagcaacggtttgccactcatgaccaatcccatgatcaaaagccagccagtgttggcactgccttcaaatctaatgccatgtttggttacatccaagaagcatccatgttcttcattgtgtgtgacatacatcagtaagcgtgaacttgttgaagtcgttgatggacttgtcggggtaatgatgacatcatcgaaccgtgaaaagccagacattgaatctggttacgacggttcgtctgatgaagattccactgagaattctcgtgcagtaagttgcttctttcggttttctgttattctctttgttttctacaaaggattttaatatgtttatcttttatatcaggaaatttgtccttctgccttatgtttcttcgaccaaatcgtagctagtgcgcaagacaagaaggttgtgttgtttctagactatgatggcacactttctcctattgtgaatgatccagagaaagcattcatgtcctctgaggtaagccagctggtgtaagataaaatatgtattgaaacattgctttatgtatgtgccacttactaatattctcaatctgaataccttccttcagatgcgtgctactgtgaaaagtgttgcaaagcacttccctacagcaatagttagtgggagatcccgcgacaaggtctgaatatattttttacatgtattggtcttcacgttttagtgtgacaattatgtcagtatgaaaatcacatatctgatgtttgatgctggcctctccatgtccaggtgtttgattttgtcaagctgactgagatatactatgcagggagtcatggtatggacatactagcatcttttgcagattcagacagtccatagaaaaggtgagtagttgtaggatcattttaggtttcaggcatgaatacatatatttgttgctcttacatttttaacgattgaattcattacatacacgtcccttcatgtttcatcatttgaaaatattgttgagctctctattgcagaccaaagaaaccaagctttttcaacctgcaaatgagtttctgactatgataactgaggtactctttgtttcagtcatcagaaagcaatagatctggatggatgatattgaaaatattactctatatgctaatgtgcctgtgtacaataggtttccaaatccctgatagaggtcactaaagcgattaagggtgcaacagttgagaacaacaagttttgcgtatctgttcattatcgtaatgtcgacaagaaggtttagttggaacattcttgcctcccttgtggccttgtcgctttgcaacaattgcaagttttctcctataagttttttttttctcgaatacagtttctcatataattttcacctgtttccctccagaactggaagttggtcgcacaggttgtcaacaatgttctaaaagattttcctagtcttaaagtatccactggacggaaggtagaaggattaaaaagatagcaatgtaatatactgttcctaataggcggttcatcatttgtatgctaaacaggtatgctattatgcaggttttagaggttcgtccaatgatcaactgggacaagggaaaagccgtcgagtttttgcttcgatcgcttgagctagatgattctgaaactgttcttcctatctatattggggatgataaaacggatgaagatgcattcaaggtcacctttcttcagaaattgcataccacattttagatccatcttacttcgagcgttagtgaactcaattattattcctttttttttttattatacgaccaggtgcttcgcgagcgaaagaatggatgtgggattcttgtttcgcaggtgcccaagaagtctgaagcctttttcatgctgagaggcccatcagaagtagtgatccttcctgtcatgcttaacttttttgctgcccttctgattatgcctagttaattcaaaattgctttggtcatttcacttaacaattgccatgtaggtgatggaatttctcagttccttggtgagatggaaggaacaatcaacatttgaagattgacagcttagccaatcagttttagttgggatagctagctgacgctagcgtttaagcattccctgggcgacaattttacagtgcccggacgtggagctggatagtagctagatagtttagctcccatagttgcaaagaaccagtcgatgctattccgtttcttctaatatttatcatcagaggcagagttctagtagttttttttttatgaagtgaacaatctttcagttctaccagtgaaaattcacaagcattacggcactgtgctaatcctgatattttctccattagtctccatcttggttaggtaccaggatttgcaataatgtcaactcgcatcccctttctcccctgaaaatgacagggaaaaaaagaagttcactggacccgccgtagacggcgacgtgattctctatatctctaagactaaattgtggggtaggattccgaaaattcatgaattggttacaccagtttacaacaaaaaacttcttgtcttagtaatcaattgaaattagttcgatggcatcgaccccatccggtcagcctcgtggatgcagatgatggtcaccggggtgtccatttcttcatgacgtcttcatcctatccatacaagctggctggcagcccaatgatcgaatgcatgcaatgcataagatcttttcctggctttgctgaaagctcacgaaattaggctacaattcacaatatatcgtttaaactagaaaaaaaaaatgttccgcaggtttgctcacccggcccaaaacgagcctgacttttctgaagttagtactactaccactactatttacgaaaaccaaacgttaaagctgacagccgttgcccgttattacgacttgttggagtgatatcactgatatggcaacaaccctcaaaaccgagtcaagttcccgtataaatatttccaccacctgtacataattcgcaagaattttgagtcaagccgtttaaaagatccggaa

SEQ ID NO: 74916 - DNA, 13496 bp, Oryza sativa
  unsure (1)..(13496): unsure at all n locations
ctctgttgacatgtaaggatggaacccccaggccccatcacatccaccagtaatcgctttgatcgattgtgaaacacagagggtgctgaatactcttcaaatgaatcaattcaataagcatatcttgcaaccaaggagatgaatagagtcacaaacaaaactctgcacaaacttatcagcggttatcatcattaaacagcaccttgtaaaacttcctcctctcctccctcttctcagcactatccaaccgcgctgcttcctcatcgtcctcctcctcttcctcctttatctcaatctctcctctcctcctcttcttctccaaattatccgaacgccgccgctgattatactcatgcagcccctcctgcatcagctccccgagcctatccttcgccgctaccaccggatccttctccctaagctccgacccctcgtaaccctcccggagcaccaccgtgtgtatcttgtacctgtttgagacgtagaagaggcacggatgccgatgcagcatcctcgccgtgtcctccggcaacccgaactccctcctgaaatgctccagcttcagaaccgacatctttttccacaatgtgagcgagaggagctcgtgcaccaccgccaccgctcgcttctcggcgtcggcgtccgtgcctatcgccgcccatctctccgagtacggcgagatgtacggcgtggaattgaattcctccatcttggcatgagacttggcccaggagggcggcagcgagcaggtgaaccgcgggcggaggagtcggcggcggaggcggccgccgcctcgacggaggagacggcgagggaagggacccaccggagaagctccagctcggcggcgttgcggcggtgcgggtaagggttgccagtccgaanaggtcggtccggcggggaggagcgnnagcaggtagtcgtcgggaggcccgagcgggccccgcagcgcggcgagctggacacctggaggcgncggccgcgggcgagcatgagcacccgcgcgaggcggtcggccatcgccggctcggacgccgcgacggccgcctcctcggcgtcgaccagcaccgccatccgcttggtgaacccgaagcaggcctcctccccgccatcgccatcgccgccggcgccgccgtggaagaggtcgaagcaggaagggtacttgcggagccagttggcggctcggccgaggaggtcgagcgtcttgaagcgggactggaggaggcggacgggggcggtgcgggacgggaagcggaggaggaggcgcttgatctggttgttcacgatccagcggcggttgcggcggagcgcggcctccagcgccgggtccttcggggaggaccaccgtgccatgcggcggcgctccggcgacggcggcggcggcgggagggaaggggtgtgagagtgtggtgagccgcgtcggagtgttggacggctgagattggcttgcgataatgggctgtaggattgtaaaaatgggccttgcatatttctttaatgggcctgtttgttggcaattggaataggttcactttagattcctcttcttgacgtcgagtttaaatcacgccctgaaccgcaataccagaaatcatgactcccaacttgcatcccgggttaaattaggtcctctagcagcatagatttgatttggtagatgaaagttataaatttgtactagtactaataattatctcaaccgtttaatttggtagatggaagttataaaaaatttagatgcattcatagcatgacatgtcagtgttagtactaagaatttacgtaaccatcgtttctcttattcgcgaaataagcaaaacggtatattcgcaaatgaaaagtaatttgtgaataaaacttttatatatgtgttcttaacgatctaaaagcaaatgctgaaaattaaacttcaatgaaaaaaaccttaaattcaactccaaatttatggttgaaaatttaaattttggctgataagtataaatataagtgaaaagttgagacccttagttagaaaaagttactccatgtttatatatatttttcctatttttttaggttatagttgacttgtagtattaagggggtgttcgggagagtttagtcccttttgatagggattaaagttttggtgggagagagatagtccctctctcccaaacagcccctaaacttgctcttatggaaagaggtagtacgtactgtacgaaccaagtgcaagtttgaagtttcccaacacgatggcaacatcaggcacggcgatgcgaggtggcgctaacgtccaccgtgccgaccggtttggagcctcctccccgcttgcaacgcaggggacgaggagttaggctctgttcgttctgggggacagaggagattgtgtcccgtcttccaagcgcacatttttcaaactattaaacggtgtattttttttaaaataaaattctatatgaaagttgatttaaaaaatcatattaatccatttttaaaatttaaaatagttaatactcaattaatcatgagctaatggcttacctcgttttgtgtatactcccaatctccttaatccccttctgctcaaacacacccttaggccaccagctacatgcaagaactgcaagctgcagttattaggggtatgtttagtttcaaagttttttttaaaactttcaactttccatcacatcaaatcttttatatatatagtaatttttcagtcacatcgtctctaattttaattaaattttaaactttggttgaaactaaacacactctagatgatgatgcgatgaattctgaaccgggggcctactaccgtctaccactagtctggtccttcccctcgagtaataaacgatccaggcgctgctgctatgctgctgcctgctgctcaatggccagggccagcctgatcctgcagatgatgagtgtggtagagagacagagagaaagccagctaggctatgcatggcagaaagtagtataggagtatgtgcctctaggcacaagtacgtactgtactcctacaggtacagtagagtaactggacggatagatggacgggatcgtcactgtcctcaccctcgtagattgcaccccaaggcacaaaactagggctttgcgtcaaaatggccagagacccgtgccgcggtggtccacgaaagaatctgagagcgcatgtacgtatgagtatcatcttaaggatatgaatgtgttcaaagattatacgttatgttttttaaaagtgtgtttaggcccattattagaattagattttttttataggacggagggagtaattggtaactaagctaggcctaagttactaatactctccctaaataactcaaaccctagcttcccaaggagttttcaaggaaaaaacaaaatagcacaatacccttaattaatgtgaattagttgggtgcccgcgcaattgcacggctagcaccctataaaattatctattttttacatatgattttatttaaaaatatcattattatgtttctaattttatagtttttaaaagtcatgtcaatcgctacacctcactcctttgtcacccctttatttgcttactcgatctaccactacttctattcattctctttacaactttaaaaattagaccttgtagattttagagttcattgtccggtcaaacgtcgtcaatgtactcatttaccacccgttcgctgcctcatctctttattgttattgggattttaaaaaccgaacataattattgtgtgtgttcttttttactttctaagagtcccaccaaaccgtcagcagcttcgtcactacagtcctctacggctctaccgctgcctcccatccttattatcattgagattttttaaaaccgaacatgtttatcattggctttttttttttactttctttaagtcccgccaaccgccataactatgttgtttaacgggctcgtcatttctcctcttaatcatcattgggattctatttttcaatagcctttattttttatgatgaaattttatttatttataaaatgtattcctaattgaaatattatttttctttttctaatttcaggatttagtttattttttgtttcaaattttaattaatattctatatggactattatttttaatattcattatttttttatttcaaatttcagttgtttcaaaattgtattcctacgtgaactctcttttttatttttctaattttggattttattttatttatttttattataaattagttaatcttgtattgggtttttatataaactcttctttcaatattgcttactttaatttcaaattttagttatttttaaattgtatttctacttgaactcttattctatttttcttaatttcggattttattttatttttattctgaattttaattaatctcgtgttgggttattacatggactcttattttttattttgaatttcagttatttttaaatcgtattttgatttggctcttcttttctttttcttggattaaacccgcgcgattgcgctcatacaaaattactcaaatgattttggtgagctaatattatttcttttccaaacgtatacgcaaagagtggatttttttttaaaaaataatacaccaaaccgtagatatataccctacccagaatgttaggaggaacaacgaacggtgctattttcaattggattgctgctagcactttagctttgtaattttcgagcgccagccacatcatgtgctgttatgccttgagaattgtcgtccaattgtccatgctgccagtgccaggcaccacaacgtcaacggtgaagggatgacttagcactatcggtagctttctcgaccaatgctacaaatacataaagcgggagggaaggggacttctaatttgttttatcttctccgtttacgatttctcttcaaacttctgtatgtaatgtactcgatctgattaattacttttcttgatatgactctacatacggactgtatctataaatcttttttctactttctataaataagattatattatgtattaatctccaccatcaaaatagagatcttctacaatctaacgattaatatctttttctttttcttcgattaatatgggaatttctaacgctcacagcgaacgtggtgtcttctttcaaagctgttttaataatataatagatagatgttgtattgaatgatgggtaggtgaggggtattgaagtaataaaatttctcgttttgcagattggtggaacttcgtaggcaagaagtttgaagttggagttggtttattttaagacaaatttgaactttagaagttgatttattttgggattttaggatttaaattttatcccaaaagcatgttattttagagtaatttttatcacatcaatcacctcgaattcaaagttttctttattctactctcaactatcatctcactcccaaccccatatcatttatcataatcatttttgttaaaatttagattttactatcttcgtcccaaaataagtacagctgtgggtatccatgtcaaacgtttgaccgtccgtcttattttaaaaattaaaaaattaattgcacataaagtactattcacattttatcatctaataacaataaaaatactaatcataaaaaatttcaaataagtaggatggtaaatcgtttgatatgaacagtataaaactaactaaacaacctcaaatgataattattgtaggacggaggtggtacatattgaaacggagggagtaaattttatactcctgcgtagtaatagtactagtagttgtaatcttttactcactttgtccaaaaaaaacttaagctaggtgaagatgggatccatcattctatccaaatttcttgtaatataatagattgcatttccacctagattggtttattttatggaggagaagtgtacactatgactgtttgtttatgataagatgcataatttaccttaattattgttagcacgattttcaaactattaaataatgtgtcttgcaccaaaactttttgtaaatgatgctctaaaatataaataaattcatttttaagtttgtaataattagtatttaatttattattcacccatagcttatctcgtattatgtgcatcaaaaaatcttttatcttaacctataacaaacgaggccgtcattccatctagaccccatttgttataggtggagtgacagccttgctttattcggcaatagtttaatctcgtattgtgtgagttaaagaaaatatttatcttgacctacaacaacgaggttgtgtttaggctgtgtttagttccacgctaaaattaaaagtttgaagaaattggaacaatggtacggaaaagttgaaagtttgtgtggaggaaagttcgatgtgacagaaaagttggaaatttgaagaaaaaagttggaatctaaacagggtcttagaactgctggttcacatctcctatttctcgttttttgtgcacacgatttttaaactgttaaacagtgtgtttttttgccaaaattttctatacgaaagttattttaaaaaaatctgtgcatgctaggtaggcatggtttagttcctaactttttcttcaaacttccaacttttccatcacattaaaactttcctatacaccaaacttttagcttttccatcatatcattcaattttaatcaaactttcaattttaacgtgaactatataacacaccctcctattgttgcgaacacagccagttggagtggcgggctcgctctactcctagatccaccagattcgcatcaaaatactctgatgcctagtataccagtagatactcccaggtatacttacactgtttctcggtactcccatttactggggtagtactcgtagcacgaagtaccagtacactctactcctattcgtacctcttactcgtaaagctgtagcctgtaggagtatttatttttctccgtccacgcaacgcattgcattgcaggctacagtacgagaagcaaaaaaaaaaaaaagctttcagagccaaagtcgtgacaacataatctcaaaagggaaaaaaaacaaaagaaacaacggggaaaggaaatgaatcgccatcaatgcaacgcaacgcaacacaacgcaatgcacccccccccccccgccctctccccgggccagtttcgccgtgcccaaatcatgacctcgcgcacgcacacgaacccgcaaacacaaacacacgcgcgcacgcatcgcttcgcactcgcaggcgcagcgcgcaggcggtgatccatccatcatcccaatacatccagcgcgtcgtcaccgcgggaagccagcgtgcggcaacggcaagcggatcggagctcccccgtccatccatggcaaccacctgccgcggccgggctgctgcgcgcctgcgcctgcgcctgcgtgcagcgatgctcctgtcgtcctgtggctctgctgctatcgtcatttccgcagtaattgcggggctgtccagtgtccatcgcttcccgcgaaaagtgggaagcaaatgcggtggcagctctgccatctctgggcgctagctgctgctctgccttgcctgcctagcttccgtttctcctcgcacgcatcagcagcagcagcagcagcagcagcaggtcgcatgcgccacacatttcccgtaacttgatacagccactaggggtacgctggtcgcagtcgcagagcaactagctggcccgcgcgggcagcagagtgcagaagaagaggtgggggtggaggggttcacggcttgatagcgaaaagaaaacaatgcccactttcctctttcaaactccacgcactctctcggtttctcgtgacacaaactatggatgatcggataacgtaactttcccttgccttggtggccgacatatcggcccgatagtggtgaggcttacagtacatatttcacggtgaatagtcacgtcagacgatccttttccgataatagagcatcaacggagttgtttgaaatgcttgatccagagattaatttttagtctttatcacatcggatgtttggacactaatttaaagtattaaatatagactaataatagaactaattgtataaatgatagctaattcgtgagacaaattttttaagcctaattaatctataattagcacatatttactgtagcatcacataggctaattagagattaattaggctcaatagattcgtctcacgaattagtccagggttatggaatgggttttatcattagtacgtttaatacttctaattagtatcaagcatccgattggacattgactaaaaattggttataaagaaaaaaaatcagtcatgtccgtttggcgcacacactctctctaaattcaatgcatggttattttatctccaactacctgggtggcccgcgcgattgcacggttagcacataaaaaaatcatatattttttagtatgattttacttaaaatttattaaatagctaactcgttgtcttcaaactttgaaataccaaatgttatcatccccgtgtttctaattatatagtttttaaaagtcacagtcgctaccccttacttctgacatctcctttatttatttgctcgatctaccactatttatattcattcttcttggaacctttaaaaattggatcttatagtttttagagtttattgccttgttgggtttctttttataatttctagaagtcccatcaaatgttgctattatactcctttatggcccgttgacggagctcgtggcccctcaccgggagaccgcacaggcccccctttgccggttcggccgggggctcagggtgagatctcaagctctcgctgtagatgacggaaagatcgccacctctcaagagaacatgaaacacaagcgatgtatacaggttcgggccgctgagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccaagcgtcggctcagcaacgtgcatgtttgcccttcttcacacaacatcttgcttgtaatggttaggatgaagcctggcatatatcgatcggggctaacgtgtcatctctgggatgtaacacgctagctccagccgggaacgagtgcctagaagctctcgtcttgacaggatggggcgaagcatgcgtctgaccgcctgtcgccacctaacccgcgatttgaccggtctgtgactggtcacagaccggataatcgagtgcactgcaccgcacttcgtgcggcgtgacacgcttagccgaggcgcaataaatgcggttaggtgagccctgctgtgctcacctaacccatacacgtggagtagaaaacgcgaggggtcagggcgcctcggccctcgggggcgaggctggagtggtccgacccccccctcggggagaccaagaggtgggcgcacacatcaccctcgggcccgacgtcccccgagggtgccaggccacgtgggcgattgtgtctgcctcaagcctcgagtcatgatactcccagtcccatgtcaccgacagtagcccccggcgttatgccagggcgatcgcccttcttatgggaagcggccgggcgtgacgccactcctaaagcctggtgacaggtgggaccggtctccatggttgggcaaaaacccaacggtctcaaaccatgcacaccggtaatggtaatttggctgtcaataatgggcggtctcttcaagactgccacatcacctgagcggcgcacgaatctgggcgagccgatttgcctcgcctggagatacggtaatgtcgcttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggcgcgagaaacgaggagccgggcacagcgttggcaagggtataaaggcactgaggatgagatttgtctccttcctttcgccatcatttcccttgccttcgccgcttgcgtcctaactccttcttccctgcgcccttctttcgccacacgcgctcgctctgaggatctggctgcgctcactgcatgtttgcaatgaggacaccgttggggcgtgtcctcattgatggaggagcagccctcaatatcctttcccccgcagcctttgatgccatcaaggccccggggatgatgctccggccgtcccagccaatcatcggcgtgacgccggggcacacttggccgctaggtcatatcgacctcccggtcacctttggtggacccgccaatttccgcacggagcgggtgaacttcgatgtggcggacctcagtctgccctacaatgcggtcctggggaggcccgcgttggtgaagttcatggcggctgtccactacgcctacctccagatgaagatgccgggccccgacggccccatctctgtccatggcgacctcaaagtcgcgcttgcttgtatggagcagcgtgcggaccgcctcgccgtcgtgtccaagcccgagggcggcgacgagaggcttgacacatccgcccccgccgccccgaagcagcggatagtcacgtccgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcagggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaaactgggagagaaggcgctacccttatttaagctcctcaagcgctccgggccgtttacttggacggaggaagctgaacgcgccctcactcagttgaaagcatatctcagctctcctccggttctagtcgccccggagccaaacgagcccctgctactctacttagcggcgaccccccaagtagttagtgcagcgttggttgtggagcgcgatgagggcaatcctcattccgcgcacccccaccctgtgctaacttggcccgggagcgagcagggaggagaggccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagggttggccctttgcccgcttgtccgacgacgccaggagcccccgacccccaggacggccccgaggccactgcgggaaggccgcccctgtcgtcctccgaccccgaggtcatcggcacagaagacgagtgcgccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttggtccgtctcgactttcgagcgaccaataatatggcagagtacgagggactccttgccggactcagagtggcagctggactggggatccgccgtctcttggtgttaggcgactcccagctagtcgttaaccaagtctgtaaggagtaccggtgctctgacccgcaaatggacgcttacgtacgccaagtgcggtgtatggagcgccattttgacgggatagagcttcggcatgtgcccagacgggataacatgattaccgacgaactctcacggctcgcgtcctcgcgagcccagaccccaccgggcacctttgaagaaaggcttacccagccgtcggcgcgacccgaccccctaggggagacggatgtgcctgaccggcccccgaggtccgtcggagtccaggcctcgggacccgaagggagcgctgcaagctcccttagattgattgc

SEQ ID NO: 74917 - DNA, 35190 bp, Oryza sativa
aaatccaaaaaagcggtctgtttgacaaaagaaaacaagtagacatgtttatgacacttccattttctagtaatcttgttctccaagaacattttctgataatctcgaaaaaaatctaaggcttgatgacatactgtatatgcacggatagtttaacctgccatatttcattatttgtattccacaaatttctaaagcagaagaagcatatctgcatatctcacctcatatatatttctgaatacacataggtaaaagagaaatgcattcttcagtctaggtgagaaaaaatgaatagttaggaagattagattcatttactatggacttaaccaaaaaaaatagtttattactacacagctttagtaccgctgataccatcgatccattttgtccattctcttcgctgttacagtattgctgcaaattactgaacagttgtgacaagaaaagttgtattttctcttagggatggcagttgaaaattataggaacatgagcatgccattctcaagtagtctatatgtactgatgtttggtcaaatttgttcaatctgaaaacatacatgtaactgaatatggcctaggattttgaaggtaacatgaataaaatagacaccatgccttttggcttggttacaacaaatagcactaaagataagaatacacactacagatggttgacatctagaaatgtagatggctgttgtagaattagcttattaatatatgcgatcaatggaggaacaatattgagagcaacttaccttgcctgtgggcaggattgatggactacgggggccgggtgaggcatcccgctgatcttgatcaatcaattgtgaagctggtgagcagacaaaagatcagtctgcaaatataaattaatatatcaatgatccaatttgtagtaatctgttgcaagcatacaaaaggtagaattttgctatggaataaatttagcacagtatccacctaaatgaaaaccaattcagcgagagcaaaaaaaaaaataccgctgacctcctaaatcagcatgaacacttatagcaaaacaaacttcattcagtttggatattttcacttgtaatttcacgagtctggacactaccataatgatctcatctacaatgtagagaagacatggtcagcacatcggtagtacctttctcccaaaattcaaggcagaaccagaattggacaacgataattaaaattttataccttacttggattgactcgtagcacatataaatagaaaggttaggccatgcaatttaggctactgttgattctataaagcaatgggggaaaatagttgataagggtcagggttgccatggaggtgatgccatggtgagacagcagttaaagtaatcagtaaagcatttttattgtatcgacggctgacatttaagatgcacaacaatccaacggctgctatatttctgatgatgtggcttcacatgatcccagctaatggtgattccgatagtagatggatataattgaatcacactcagtttcagcaaatacattatacacaaaatggcatgtatttccaaggttggccacagtaatcagaggaactttggattcgcaggcagtatagctgtatttgaaggtaagagtacagggtaaaaccaagcatcatgctatcagggttaactgcagctgttgtgccctctctagaacaaataaaacttacatatatcaaaaaatagattgactgtggcagagaacgagagcaagaactccttaccagccagggtcagctgcatgccgccatgcccgcatctgcacacccgtatggtattttgcctccatgccatcgcaatcgcagccacggcagcggaatccgccggtgcgaccacagttgacggggaacactgtcacgatcctaacttcttcccgaggaattgctagctaatcggaatcggagatagatttgaggagagaattggattcgagagagaagagcaaaagggaaagaacgaacagaggaggaagacgatagaagcagcagagagatttgaattgatttctgtttgtgtattacaaaagtacgtaatctctctctctctcgctgccggctttatagcaatgtgccaaaaagcctctctctctatctgtggacccagccaatctctactgagtccactcactcacagggaaacgcttgctgggctgacggagtcaaacgggccgctccttggtgcagcccaagttctcctggtctgaacctcttgcttaggggtggacaggaagctcgtggctcgttagctcgctcggctcgtgacaggctcggctcggctcggctcggctcgtttgagataacgagccagctcgagctggctcgcgagccgctcgcgagccttaacgagccagagcagatgaggcccaggcgcctagcccagcccaacagcccatcacctagcccatcaccttgtgaaaaccctagagtcaatccccttctggcttgtccccatcctcaatccccacccaagccaccgccggcctcatggctgccgctcgcccgtgcctatcctccccggcgccgacgccgccgcccccgcctctcctccccggcgccgacgccgccggccatggacgccgccgcccgcgccgctccttcccgccgccgccgccaccgcccgcgcctctcctccccggcgccgacgcggccggccgtggacgccgccgctcgcgccgctcctccccggcgccgacgccgccgcccccgcctctcctccccggcgctgacgccgccggccatggacgccgccgcccgcgccgctcctccccggcgccgccgcctcggctcctccccttgttcgctttctctcttgtccccaaagctcacgagcctaacgagctggctcgagctttcaaacgagccgagccgagctgggtttctagctcgttaggataacgagccgagccgagctagctcgttatcctaacgagccagaccgagccgagccagctcgacatccacccctactcttgctatccgaggtgttgccgccgccgtgacaaacacgcgggtgacccgacggctgacaggatgggggtgcggcgaggtcggcggatcccgtcgattcggcggcggcgcaggtgggcgcggcgctgtgcggcgaggtcggcggctcccgtcgacttggcggcggcgcagtggagatgctgccgtcggcgggtgagcagggtagggggaagccggaggaatggatgcgggatggaagggccgcgatgggtggggatgctggcggagggagcggtcggcgatagagggatctgcggggcggaggatgctagggtttggagtcggcgcgacgcggggagagggaggggcagaatgcggaggtggacgacggtggactcgatatcatgaaaggacggcgatgatggcggatgcggtttctgtgggatggggaatacggtgattccgcaagaggtgtgagtggtgcgcggtgggaggtgggagagctctggttcgtttgatctgacgcgttggatgatctggaccgttggatttgatgaatgagtaatgtaggtgtaagagtgagttgatgaattatagggtagataggtgtaagagtgagttgatgaattatagggtagatacggctgtccatgcgaagaaggatcatcctgttagccgtccagcagcggtgtttcaattaatgccaatcaaagaaagagcttgcatttgattggcccaccgagttggttcgtgcaaaggaaggacggctgcccgacaaagaaggcatgaaacgccgtcgccaacaatgaccatagttgatgcacggaacatggaagtaattccttcgtttctcttcaatccttttttctatatatagaaagtaaccaaacaaagccgtaagataagagtagaacgagtgctccctgcacctgagccggactcctctggcggtcactgcactctatctggcacgtcgctgtaatctatcaggcactagtttagctctagttgttactagttctgttgtaacaactcctagcttctaccattgacaaacaacctgtaagtacaacactaatgccaatattgaccgatactagcttatgtgggtgctacctttttcactagaaagaaaaatttcaaaaatcacataaatatgagttttggacatattgaagtgggttgggtgtgttcgttttgaaaaatctctttgtgactcgtgcggctaacttttgtcatttaatgtcaatattgaccgatattagcacacacatgggtgcgatgtttttcaccggaacgaaaaagttcaaaaaccaccaaaacatgaattatcattgttgctttcactctttcatggtagagcggtgcttccgtccagcacgtaataccgacgggtgttgaatcaaatccatccgtccatcgtgagggggtaggatcgggaaacgtcacgagcccatcgcgcagggcccaatctccttggcgctttttttctccctcacccaacaatccccatccctcagcgcaggatcaatgatgccatcagcacggcagtccgagtcccttatcccccctcgatggctccagcaagtacctgccctgctgctctccctcccttggtgcatgagcaatggagctgccgtcggcactgcctaggcccctaaccagtttagggtttcctcccaagtggtgctcaagatgtatgtgattttctagcacacaaaatactcagaaatcataccaaatctcatagtagtttgtttgattttagatgatttatgagtattttgtgtgtctttattttgatagatttggtatgggtgatgaaatgtgagacaacttagaagaacaagaggagtacaaaacgatgatttctatcagatgtatgagacttatgaagtgaatttaatttattttcagcaaagtagaagacgatgtatgagacctaagaagtgtttctttgcaccggtggaagttgaatcaggagttctttgcacttgtggaagtagaattttaatgtttgatttccatgtgtgggaagttgtgttgttggacagtcaattatatattgtttgcctctatcagactatgagacttatgagcgtgtgtcctgtagacacttatgctggtgcagtgcttttgtatggtctagttattttggaatgaactactcaatcaaccatgcttcttgtattgaatctgtgaaaagagcacaagcttatgatggacacattttgttgttgaatgggaaaatttgagcttattttggacagagcatgatcttctgtcatctttatgtctgtttgtgtgtttgttctggaaaatttggatatgtgcacctgaacttgtttgaaggttaacaaatttgttttctagcgaacctagaacctatcttgcaaggcttatggtaccacatagtacaatcaggcttggccctgaggagcatgagatgagcagccagcagccgaaatcaacaaacttgtctcctgttgcgatggcaactttatgcatcgagttaaaaatggatattgatattgtaagttggggaatatattgtgagttagcatggctaaatgatatctagaaataagattccaatatgattcaaataatttcatgagaaggagcacaactagaactattgttccaatgacccaattaattctaaaccaatttctaatatcatcagtctcctttttctgcttggacaacttcttctaaaagacggtcgtctttcagccatttcctgctttagcttcgtcctctcttgttccgcctttgttttttcaacataacaggtccactcaatacgtagcctacccaattggcacgttccagcaagtgccaaaactgctcgaacgtcttttatactcttggatgccactctggatctactcaaatcagagtgtcgcattactcatcctcctaaaaaaacaggactgttatattgacatgcatgactaaaataaaagaaaatttacctatactaaattaccactaaaaatgacatatgcttggaatgaaacttcaacgaaaaacttatgtaacaccactgcacatcggcaatctcctcgaccaccggcatcgctgcaacagcaaacggagagtcctacagcttcggaggacaactggagcaccgccactacaccgccatggctgccaagtcgccaacgccccagccacagcattgacgactccaggaccacctcgccgctacagctgccaaagtccccgccgtcgccgccacatcgtcggctccgacgactccacgaccacctcgacaccatgcccagtagcacctcgctccatgaccacctcgtcactgcaaccgccaaagcccctgccgctgccgccatatcgccggctctgacgactccatgaccacctcgacaccacacaccgcagccgccatggtcacccacgcaccagctgccgctgccgccaacaccacctcgtcatcacggtcgctgccacgttcgcccatggaccaaccatcgccgttaccactcatcggacagaggggattcaagtagtacctacaaatatagtattatctttccacccctctcaacactgtcggtaccacctcatgggcaaatatgtatctggcggtaccgcaccttgccaattgtccgattggacagaatgaagggctgagatttggtaccgggctacccgctgaacagaagaaaatgtcttcatggtatgagatacccactgatccagctatcatctgctcttccaccgcggcagatcctgccatggctgaccccaaacctactcccgctttcgcactcatttctaacatcaaaaaccacatcccccctcacactccaactctatacatggtgtaaacttctctttgttcttggccgtttcaatctcaaggcacacatcgatggctcacccaaaccagccaacgctcaattacaaacaaaaggctgtgggtgtcgtagcatgaagaaaaataccacggaagtctttaggaatcagctgctatgttacattaattcatacatggaaccagtaaatttcaacagttccaccttctcctccttagtcagcaggccctttgtaaagggctgctctacttcgtgcagcttcgggccgtccgatatgctcacgacctgcatggatgaaagagcgcgcgatccaccgatggatgacagctccgagcacgacttgagaatcaggcatttgacccgaagatttgtgcctagcggaatggactccatgttgttacaggcacgaaaatgcaggatgtcgagagaggtgaggctctgtaggtaggccgggaaatcaagcttacggcaattcacaatagagagtcgtcggagtgagggtggcaaaaccattccttgcggacacaccaatttgcagcgccatattttcatctcttgtaggtgttcgaatcccacgaaactatcgacatgtattgacagtcctagatggctggatttgttgatctctgtgcactcgatggatggcaagtattccggggacaagcacccatcaagattctgtagctgataacagttgacaagacgtatagtagtgagtcctctaaggcatgcagtgcagttgctgctactgctgcttgtatgcttcgtcttttcaccaccagttgaaccaccaagaattgttactgcttccatccgtaaatttgcttctagcattagccgttcgagagaaggtaacgatgcgatcgatagatttttcaagccatcacacttggaaagctccagactccttaaattcaacaggcattctggtctaaaccaactaggagaaaagctatcacccccaaaaccttggactttaaggcgtacaattcttggtggaggacgcaaggcttcgaccactccattctcactgctcttccctatctctttgccatgccctcgccagagtagaactagttcctggaggtattgtttttcaacaaggctagcctcagcggcttctttatcattcttaacattacaaataaactgatagttagcgttccactgagctgattcatgcccctcagctcaccaatttttcgcccatccccttttccaactctaaaatgttttaagttccatagacgagacaaatttccaagcctacttatctctgataactttggagagcaactcactggcaatgctagacgacgcaagttgattagctttatgacatccagactaattgctttcagactagaacgacttgcatcaacaacctgtaggctgtaaaggctacagaatttcttcggcaattcttgtacaccgctacgagaaatatcaagataacggagactgttcaactcgcctatgctctcaggtagcttgaccagcttacaaccctttaggctcaaatataggatgttggagagctgattgaaccaggtaatctcaacattgagtttgattccaaacctaagtgaatgcaatttgttcaaatcctgaatgcctctcattccgttcttcagggattcatcagccaccttcacggacatatggcgaactacatgtagcattctcctctcattccgagacctcaaatcttgcatcaagaggcattcatccacataaacggattgtgccatatcatggatcaagtcatgcattacatatctagtttgatcagggtacatgggatcggtttgaaaaagaaacctgctcctcaaatcatccaaatacctaattcccatatcttcaagacgcatgattcctcctgacgcaacaaagccctcggccacccaaatgtcaacgatctcatctcgttcaaagctataatcttttggaaacatggagcaaaatgcaaagcatctcttaagttcttgtgggagatataagtagctcagctggagggccggtaatatctcattgtctcgatgtggcagctcccacaattcactgttctgaacagtctcccaatgttgcacagtcagcttcatattcaacaaacgtccagtagttttggcaactaaaggagacccacataacctagaggcaatgctccgaccaatatcttgtaattgaggatatgattctggacactcttctccgaatgcacacttgctaaagaactcccaaaatatatctctatccaagccttcgagttggataggcttacaattgttggtggcaacacgatcaacaacagttgtaaatcttgtagttactaagatcatactgcctttaggtccgttcttgaatggtgtataaaatgactcccactcgtcaatagcttcttgccaaatgtcatccaacaccaaaaggaacttttgcctctccagctgctccatcaattccacctgaagagcatctaaaccgcaaagtggcttatactcttccctattgaaagactcaatgatctcgtttgttactcttttcttgtcaaagaggtctgaaacacagacccataccctcctattgccaaagtgagcttgcacccttggatcattgtagatgaactgagccagggtagtcttccccaccccaccaatgccaaaaatcggcaagacgggaacattgtcgatgcatttggcctcagcaagtctgggtcttgccctagtatctcttttcagttgcttcgctctggatgatgctgatgtgttgccaatgaccggggctgctgctctctttcctttagcccgtgctcgtgcaacaccacttctggtgatcagtggcacacccagtaactcaatcacatgatctcgttgactgtcacatccaatcatcgaacacacacccagcttctcaatcactagatctcgttctttgtcacggccaaacacctgagacacacatatgactgaacttgtctctggcatgtgttgaactgcctcgatactaacacccactgaattaagcactccttctaaatcagccacagccttgtcgagcttctctcgggcctcctttatttttgttttgctaccacggatcaaaatttttgcaagatttagaatggaagaatagcgtttaccgaaccagttccggtcagcatcctccatcttttgccgcagcgcctgatcatcggactcgcggagaagatcctcggcgtcgtaggtggtgtccttgagctgtgacagaaggagcgccatgtccttgttcttgaacctgccccactcgccgcgattgatgaggaagcgagccttgggcaaggtggcctggaggcgggacagttcattgctcagctgggtcgcttcatggatgttgatcccggttgagatgatcgtttccacggcgtccatcgctgctgccgtagtcctcgattacttctccggatttgatcttgccctcgctacttcgatgagatcgaacgagcgtatcgattgagatcacaaggagattatggggtggagaagtaggagcaactaggtcaagtcaatggacctcctcggttatggacttcctgtagaatccaccaactccacaaggtgacgtggccaccttgacagccacgagctctccctaacaccccgaattaattaatcaatcaattaataaatatacttaacactaacacagctaacgaccccactaatctctccctctccctctcgtcgaaattccaattccactcgcctcgcctcgcctcccccaccttccgattcgctcgcgtattatattgcgccgtctcgagacttctagatccttccagtggaacccgccgccgcttctggatccttctcctgcccctcattttaagcgccacctcccccgcccccccacgccaccgaccgagctgccggcggaggtgcgaagccatcgaggtgagtggaagcttctggaaccttaccctcctttttcctttctatctcgctgcggttggcttaatttgcctctgcgggcgcgtcgcggttttgcttctagaaccttctagttcttgtggtggtatgaagtttctccgtgagtgtcaaatgtggatccgccattagagatggatttgagttcgctgtgctttgtgacgataggcttgtttcggtggagatttcatggataggtcgacgacgagttcatagaaggaggggctttatatgcattagatgaacggcttccaacagtttccgtagcaagaagcttctatggtttaatctaattctaggagggcggtaggggtgatgtttgtgtgccgaagtcttgctaacctggatcaatggaatgcgcttgttgtgcaatgcagttggaaactgtggagtagcccgtgtgacagtgtgagttaattacttggttgcttatttgaggattaggatacacacaggaggtcatgagatgttgtttggttaaactgaacatttaatttgtagtctattaggctgaaaggaaaataaagaaccattcagcctagttgcaagactagtttttctttgtaacgttggtgaattgtactgtgtttaagccaaactaagttgttaaaggtttagactgacgtccccttatgtgatgtttatctttgttgttgttgtcatattttgaaaattgtgcattcaccatctctaaaatagctcatagggcattaacgagtgatttcaatcgaggtgccttgtttacaactattgctttgcatattctgatcattgcaatgttttcaaccagttattgcatatggtggcaccaagcatgaggttacaactgcattacttgcaagggaatcacaagtcacaagaaacacatgttattacaatggatgtaagatttttttattcccagtttattttcccatgattttgcgacagtgaatagttttattttttttaaataaaatgaacttacatgatcattgatgttgtctttaacaacaactcaccaatgaacaaccatacattgtcatatgtgaactctggttaaagagtatctttttgtaacttaagataaatgggcatctgtcctgcaaatggagatggaaagtttgcatagaagtaacagtgatatgctattctgcttataatcacctttccagatatatgttgtgctgtactagcagtctaatacatactatatgatgtctgttgttaatattcagaaaatgaccctgttttttgccaccataagtttccaacttttcaggctatcatatttcagtatgctgtgatagataagtgaacctctttgtgtgtaaatgtttcatggtctgatggataaacaagataattgtgtacagaacccagcttgcagcatatctgcattaagcagatgtagttttgctgcaagcaaagcatggcttattgctataccattgcctttgtgagtggaatggtatatcttctaaattaaggaaaagatgactttctccttttctggagctatgttggggttggctctgttcaagatcagagggagtatattcctcctctcaagagctcaaaacttttcttgtgaataagtttccatgttaaggactgcatagagccccttttccattgataggtacacccaaggcagcgggcagtctcattatataaaattatgttggtatggtcaaagcgcaccatcagcaggttgaaccttcctacttagttcttcaattccttgtgtcaaaggtggtcctatggcagaagattgattgcttcaatctaaatggaattaaaacaaagttgcagatattaatgaagcacatgctaaggtgaccttcatctgagatgtgactattgacatcacatacgctcattttgagttggttctctaaattccagagatctcttgcatttaggccagcaagctcctgtccatatttatcaataaacacaggacggagttgatttaacattctgagaaaaattgtcacaatttgatttcttatacatgtattctttctcactaacttactaatattatggaagagaagctgcttcactttccattgcagaatatttcatttacatataaaacgattcattcctgacctgaacgtatttatctttacacttttgtttcatacagttcttacatgattttgctattgcctgaaaaaatataattgacttgaaaaagcattagcttcgttattgacctgtgatttaactctttgcagaatcaatgggtcatcatactatgactttcttgcaagttgtgcagttgttgcctcaagcttgctgcctccgtctgtcagaactgcaactaagctaggaagttcaatcagttttttttttttttatcttgaacagtaaattcaatgttgacaattaatgtagtaatgatttcttaaggaatgaatactaattttgtgttcatggggatcgatagtcttttttaaacatcatgtttaaacacgatcattactggtgctttgagtagagcctaatactgcattactatttattgcttgctgttatagtttgttacgtaccatgtccattccttaaggaagctaacaatagatctatcttttgtattttcctcttcgtgacacctttttcaattggatacgtgcagtataaaactatcgaattcacattaagagtgcgatatattttgggatcttcattctccttatttgaatcatgatcttgttcacagtatatattctatgtaatatgagtatgactacatggaacacctactatgtcctcgataaattataagtagcttttgatcctcctaagatttttatcttatgaacacatgactaccattgactgttttcttgggaaaaaaattaacatgacccgcttgtttcaggtcagcttgtgacctgtattgtacgttagtattattgttttatggtgtaattgctagtagttatcaacccatgcacctgtacgggctagaaatttaaaacatgtttgcctagtgccgaataatttaggatttactaaatactaccacatcgtctggcagatgtactatttccactactatgccaaattttcacaagaattcgaactttcttattctcaaagccatgtgtgtgctaactgtcgaaacagaaccaagcgtagcatgcctatgaacatttaacttaggcatttaaatattatgctagatgttctggctggactgatcccccgatgatggtgttctgtgttttgtttgatcatggctgtgtgcaactgtgcatacatccacaactggttatgcacttttgatcgtcagcgtacggtggaagatgatgagacaggactggcaagtgaagtggtgaccaaatgatgtgaacgtcatttggcacctcagaggtacatcagaggtacatgtatgaatcttagtgttaattgttcaaacataggttttctcttcctccaagaggaattggtttattttgggatgaagggttttttttggccgcctcctcttcttcttcttttttttttttgagatgtctgtcatttggatcagtaatgttgaaacatgtgttatgtgaaaactctgtaaatagttttttgttgcacgcgtctattacttggtacagtaaatggtaatggatacattcggcccaaatatgtgtacattggtccaaaggtgcgcataagctggcccgattcggtctaatttctcgagtgggcttcgtgcggttcattcaaaattagttgtgggccaaatttccttgcagctactattgactgtaggccaaaatttggctcatatttgaccatctgttggcacgtggactaaaataggaatgagtctatttgcctgactaaaattggcatgataggaagggtgttaggtgcctccctcatctcttaactgcttattgaatcgtctccctcaatttcaaaaccgcgtataatgccttctcctcttcaaaaaccagagcggagagcagtttctgtggacgtagtaggttgatcacagttgacttgttaagtcagtaggtgcctaggtgggacatacatgccaatgactttctccttatatcatccttttgctcacctctccctgttctctctttcctctcttccctcttcctctctctcaccttccatcaacagtagacgtcgggagggtggtgacaatggtgagccagacctaaggaaggcggtggtagaggcgagccggagccgtgcgttgttaggggtttgtatcgggctaggcaactggctgcgtcgcatgataggaagggtgttaggtggctactggcaaaggacttgcagtgagtgttgctcggtggtcaagcgtgaaggtgagcggctgtccgcaccctcctcacttgtgcaggaagccgaggaggcacgagggcatgctgcaatttggttttctgtagacacgccaaatggatgatgtggcggcggaggagcttggaggtggcgacgcaatagacaatggtgacgacgtccgaccacgccacgatccccagcaacacgtccatcgaaatctgaatctaatccgtggacgcatggtggtgcttccatggtggcatcttcatatcaccttgctatcatccatgtcatgcctgctcgacctcgacctattgtcgtgcaattaggacagtggcgactacgcgctgcaccacgtcgcggacacgctgcaccgattcgcctccgacgagcatgaccaaagatgagtggactcaatgggaggaggcaacccattggaaagctcaactgcttcgggggaccgtcttcctcgtctttggctcaccaccactgctgccctccccagatctagctcgccaccgccgttgccctcctaggctctaccccttctggaaggtgaaagagaggaagagggagtcaatttgcacaggcttccgaagatggagaagcgttatatctggttttttggttgagaattgtgattcaattaggatcaatagaatgagagaggcaaaatagacttgttccatgaaaatatcattccatcttaaatgtttagatggcctattttctggctaagatcaagcagttgtgggcttaatctcacgctgttacaaataattgtgggctttaatttcttaattcctccccagcgtacatatgagaatttattaattatttgtagttattttgatggtcgctttagtagcaagtggagattacgggtgaggctcaaaggcacctgcatgcgctggatattctttctggttggtcgtttatctctgtatacgatgagaaaatccttttttaaagcaaattgtatgggcgttacatgaacttactatatggatgcaatcatgtacataaatttgcaaagcatgaatttgatagtgcgtatgacccaaaaccaaaattgcacatcataactaattttgataggtttgacacagattagaagaacacaacataggcccgttcttgtgtacgatgaactaactcaaagaacatactctatctaaattcattaacatcaatataaatatgggaaatgctagaatgacttacattgtgaaacggaggaagtaacatttttccctcttcaaaaaccccccacaaagtcacaatgtttttggctgcctctgattctctcctttttctggaggtctggacaaatacaacaatgacaaactagggattctcttgagctgaacaaaagcaagagtcgtgttacttgtgtaatcctgtaacaacacccatcttgtaagttgtaaatttagatgcgcattagcacgagggaatcccaggtattttggccttataggattgatgaaattttagaaactatgagtttttgttatactacgaaatcccgatgagtaaattctttatttttgcccccaataccaacttgttttaggtacttcaaaaacatggcaaaacacggataaattatgttctttgttttatttggtacacgcagcccttgcaactagtttttttccacctcatgattgcttagtctttctaaaccaaaaagaggggaaaaaaagaaaatttgctgtagcatgtgatttatctcccatatcctgtgccacaaggatatttgccacccatccttcttaaaaagtctaaaacttgtaaccgtctaacagtgcagtcctagttctatttcttcaaaaacctcatacccataccccttttctttagcttacatgatatagattatcgcagaaacacactttccaagctcctaaattgtacgattcttttagaaaaacttatcctttggcatttcttagagaacttttttaaatcagcattttaacttgctttctaatatttaattctctccttaaataattatcataaactcggtttcatccatcatctatcaacaaagaaaaaacaaaaagagaccatactactcccatatcagcaatcaactcaaggccatggtccatactactaccaagcagtccaaaaggattgcaatctgctgcaagttgcagctagctagctaactagctaggaacgatatgaacaatcagcaggttttttcttcttttaaaaggaaggtaacagcttctcgtatattgatagagtaggaatcatcagggttggtgagccggcagcacacagacgacgacccggccatttcttcaacgcaaattgtactcactcgctactactcgtagcgaaatagcgatgcagtggccgctttcacgacagctcaagccgtgtgctgctagctttggacctcggctcgttcagggcacgcacacatctgcgtcaaccttacctccttttatctgcttgctgaaaaggcaggagttattttctctgcttgttactgcttctattccaaaatataaaagtctaaaatcatataagacattttatagaaaatacatattcagatttatagtaatagaaaatatttcatccgattctaagtctttatattttcggacggaaggagtattaatattccatccgtttcatattataagtcattttgatttttttctagtcaattttctttatatttgactaagattttatctataacactaaattagtaacattgaatatattattgtgatatgtttggcttttttattgaaagtgctactatatttttctataaatttaatcaactttaaaagtttgattagaaaaaaatcacaacaacttaatataaaatagagcgactatatgcacttgtcgccttctgcatacgttgtctgaaaacgagcaaggagaggtgaaatactgaaaatgcatatagtccttttctgcttcctgccatgatgggagcatatatgatgctttaatatgttccctatttggttattaggatttaggagtagttttttgaatttaatttgaagtaactactgtgtatcttaattttgcacttatccacattgcaaacaggacatatatatatagtgtattgctataatctagcatatgtttcctaatctgaatttaagaaatctctagatatacgtcatcgattagtatattaagttcggctctaatctctagctacctgctcttgtaattgtatttttttggctatggaccaaaccatgcatgataactttgaatggtggtacctaccttatcttgacaagatgagtgatgagttggaactaaaaacagattctaccggctttctcactgaccaattgtatgctgccagccactcttctactgagatacggtggttcatataattttctgcaaccgaagccgtttaaatatcagaattgtttttaaacatctagattttatgaataaaaaatcatattagtagttccccatataactttatcgggggtatttttacattctgaatgtaacggaaggtatcatattgtttttaagtaaaacttggtaactccaagtattaggtatttcaagataagaaaatttttagaataaaatttatatatattgaggtactttctcaagtacaataaactttttttttgtttgccggggtttgcaactattttactaccgaaattaacggtcaaatttgcaagtcgaagaccgtgtcaacatataaaatgacatgttgcagtggccacattgccaggggcgtctttctttcagcgtaattgaagctgtcacttttgctttagcttctgggcaagttgcaatcagatcattaccatctcttccttttggaaccttggatcataatcatctgacatctctgactgatgtatatatgctgaaagaacagtaagtgctaagctagcgcttcactcgctgccttcaccaaaagtgagcatgaaacttcctagcttccgttcacaactttacatagatgttcctaataatgtcacacagagttagaatataggactgtctcgaatcttcctcaagtaccaatttagaaatgcagagacatttgctggctacctgctctaggagataagaaccatatattcttagtagcacacttattcggtttttacaaaccttttcatctccaaaatggtggagtacacctatgtcggtctcgaaacggttgcgtgcatcacatgatgtagaggctgggatatataaatattttgttgtctagaaaaagtgccggtcgcgaaacgttgaatttgatcttgctcttgacttctggcagtaacattttctgcagctaaagattttgacattcatgtcaacaacttcattttccattttttttctttttctcccggaatcatctcaacaacttcaatagttcatatgccacactctgacatcatatcacacaaatgcaggtgcacttacagaaaaggcaggcaggcactgaaacctgaggctgacctcacaacaaattcgtaggagtcggcaggtataaatctactgtttggtcccattacccaaatcaacatatgtttttccttgcaatcagagcattttacaagctccttgctaaggtactataaatcatttggtactgaatatttagaggatgatttgtaggttgggattgttcttggtagggttgtttcactttgatgtaattagctgagttcaataaatctttcattatagaagagagagagcgcgcatatgattcttatgataacttcacagtactttgaatattacattcattcttctttttttcgacaatgaaaatcaatccagcctctacataaagtgataaagatgtatctggtatctttggcatttgacactatacaaatcttgtttggttgagaagtatgaagtcaaaaccataggtccatagctaccgacatactcgacgttcaggccatgagcagattgctgttctacctgtctcaactctgaagaaggtgtcaacatccattaacagccaaagtcttctgaataaataactgcaattgtcgccttccaattacgcaagcctgaaaacaggcaacgagacagcgttttcttccttgaatgattgagtcatgttgtcttgtatctcaacaattctccaatgcatgtaggacgaacaaaaccttgtttatggttacccaatttcatttaaaaacatattcaggcactgcactctgaaaaaaataagtctatagaccactgcatctctgaatgattgttctctttttgtttgtttcttttttgacacagatggataacagcagcaatgtagcatccttggttatctacagttgcaaactactgacatcgatgctggtttgagtagtcccatagaattcttcagcaatctcagtcagttcctgtaatactactctagcagagaagcatgtaccaggaataattccttgactgacaaagatacagtgatactagattactactagtattagattacatcaaaatcacacattttctagtgcggttaaccttaagggaggcaattagactccatgatgcaaatcacgcaggacctcaaataatgcactgggaaaagaggggaaaagcagacactgaaactgaaacaaaaactgaaactgactgcacaacaacgattctgaatcagcaggcaggtagctaccgcttggtgccactgccagacacccaaaaaatcagcacaaactttttttcaaccaacttatttttattttcttgaatcgaatgtgcagatcaaaaatcttcagaacactttttatgatctgctgagctttattaggtgtgagagaggtttaagcgtcagcatttgagtgactttttttttggtgtgcttttgttgtgttcatgcgtctcctaatcgagttgattctggaacactcaaaggggagaggcaacgacggtgaaaccgacgctgcagccgccatggatacatgcttgcagattgcagctatcctctaccttaagacatgcgactttaagtcactggtacttacattgcagattagcatcaatatgaacgtggaaaatgctagaatgacttgcattgtgaaacggaaggagtatgtgggttcatagcaaagagaacatatatgtgtgtcatatgatttactctcaacgtaccaaaatataagagatttgggctgaatgggacatatcctaatactacaaatctggacaggttcttagtccacattcataatattagaatgtgtcacatccgactaaaatactttatattttggaacagagggtattttggatcagagggagtaagttagagaatctcaatttggaaatgggcagtggatcgttcaaacaaaaaaagagagatgggcagtggagtttgatgctgaatcgtcactgtctcggtatcttttctctggtggttgtatcctaccgttttgtcagcaggcatcctgtccgaggatcttatagttcagctagcatcgtgtttgtgcgttgcaactttcggatattgtttagacaaaatgtactgcaggatctaaataaatgcactataggatctcaatttggagtgcaaataattattcttagataaaaaatgtgcaatgatgtatgcaaggttgttaaaatcgcagattctaaatcggatcggaaagcttacgataggatcttaactattgaatcgtaaaatcatgtagattctattgactagaatcatagaaacaatcctacatggctacaatcgagttggatcgtaaaatcatagtcacacaataaaatcaagattttgacaaccataaatgcacgagattcttaccactgatagtgagtactcccctgtcccaaaaaaagacaaaccctgggttttcgtgtcaacgtttgactgtccgtattatatgaaatttttttataataagtattttcattgttgttagatgataaaacatgattaatactttatgcgtgacttatctttttaatttttttataattttttcaaataagacggacggtcaaacgttggacacggaaaccagggtttatcttttttttttgggacggagggagtaaaactgactttgacatttattggtcacacactttgtttaactcaactaaaggctgagtttggttgtttactttcccaactcatttctctcattttccgtgtatacgttttttcaaactgtaaacgatgtatttttttaaaaaaaatatcatattaatcttttgaaaaaatagctaatacttatttaattaggtgctaataagtcactccgttttacttaccggaaattagttttcaacccataaaaaaacagagactaaggcgggtcaagagatacccacagagtaacacatgcccgttactaaattatcagtaatttagtgatatacaaaaccatggattgacacggctaaaaaaattgcttccgactgcatggtcaggcgactccttaccgtcagcagtaaaaaaatgatcgatagatcaggtgtattccccaaatatttttatcaacttatgaaaaggtagatgtataaaaacggccaaaagcctaaaaggtgctgtgtcatagttattagacgacggtcaatagattatgtggatcatggatgaaattaaactggagaactacacaatggtagctaggacaagagctagcagctaagaacgccgtcagctaagcctatagctaactatacacatatccgtcagatagagcaactacaaattttagtaaattaacaatgatatgtgttgattgcatcttgcttaggatgcaaatctcaggcaaacgcgctagctaggcggctatagagacctctacaaaaagcttatttagcttagttatcttagaaactaaaggttagcttttaattatttgcattggcttcttctgctctaccgatgtcatcaaggaagaccatctaatcatgcaatcaagcccgttttggattatgcgttcaactcgctttaggtgactagtttttaataaaaggaataacaaaggaatccaatatagcaaacttttgttgaatttctctctgacattgactctcaacccgaaataatgtacgattacaagccgattgattaacaattagaacaaaatttccgccttctcgaaaaaaaattagaacatttgaaatcctcggtggatcccgggaggatgttctataccatccaaaaaaaaaaaagaatgttttttcattttaacaaaaaaaattcaaatttatcaaaatttgtccaaaacttgaaaaatattagtagatttctgaatccccccctctccctaaaatttccgaaatttcgacgatgtattctgaaataatcctggatatattcaatgcatcacaaatccacagccacgcacagggctatgcatatatgctcgccaataaaatggacatattatatatcaattccaccatttgtgaataaattacatgcttaaaactgacaaaacgccatcatcacgcaaccctgtgctaccaactctcatgccacaaacccaattacggccaagatacaagccgccacgagacacaaatgataaggacaggcagagacatcataataataagagaacaacgagctagtcatgagagagtagcaagtttttccgtgtcatcttaatttggagaaagaaaaatgctttttttcatgtcgtaattttccaattaaattctgcttgaagagagctcatgtgtccatatataatgtgaaagggaggaaaaaaaagagatagatgaaaaagacggaaaagaatttcaaagaaaatgaaaatgccatccatataatgttattcacaaaaagtcagatcgaattgacagcaaattaatttccagaaaacttgaatatcaaatcatttatgggcttgtttggtttagtgccgtaccaaaacattggtaatgctaaaacctacgtatgttttggtactaccaataatttagtagggtagaatttttattgatgtgtttggattgataccaattgatagccaaattttatgttatggataaattaagcataggcattaccattcatttggcttcaaaccaaacaatcatatttactatttaaactaccaaaatattaacatggcacattttggcatcaatccaaagtggccctatctgtccttttacataaagcaagacaactcaaatagcgctacagtacttttttttaaataaagagattacctccagcttttatagcatttattcagtacacatgccatttagttttcttgtaggtgtgtggttgtttaccgttttggttggaaagtacttgcgttgtgttcttgcgagaatgcaattgtaaagatgatggcaattatatcgtgcattttatggtcatagctggtacaaattgagagtactactaattaattgttgaaaaaaaatgacaaacggggtataatagagacaaagatggtggaatataacaaatactaatttatttgatgggaataagaggagcaggaggcaagacggccagcctatattcattcaaactcaagtggcataataacagcaaaaccaaattccagcacacaacaaatgtgggacaaaatagggcaggagaaggtacatgcatcatgcatggcaaacaaaacttaaatttgcttttaagaatggagaattaatttacacctccggactttgtacatatagccagaaaacaataataaaaaaaagtatatgatggatgatcacaagtactcctaggaaacaaagctaactatctaataaatcggtgaacatcttaatcctaggggtggggggagctcatttagctggctcagtggaacagtttaaaattgccctgattgatttggataaaaattattcaattttgaatgaaagtagtttttacaatggctctccttagctcgttaagaataaatatatgctgaactgataaggtaaaatataataaattatataaaagtaatttgaagaaagctcgataaaaaagccgaccaagcttttttcccccactgatcatgacagtcattgagaaaaacaaacaacacatgctagctcataacccatataagaaaaaaaaaaccctctaataagcgatcggactatatgcttctctaactataaatacatgacaattatcaatcttaacaaattcaatacatgtattttttttcagagaatgcgagaagattaccttataaattgacgtatctttaaaccaacgttaagaaaagaacaaattccattttaaaaatccgggtcaagcattttattatgtccctcagaacaactcaccagacacgtcaatccacattacagctgggtggtgaaaggttggaaggcaataaaaaagtttcattttcaaagggaccaaatatattactaggtgatgtgtaggtgtgtacacccccaaaccaatcacccaccggttgatcaccacaccagcagcaaacccagcattccataaccaaagtgtgtggccagatatcagatgccaccacccttggctacaaactgcaaccggccacgaaacgacaacgaccagcaatcaccaaaccccccacagcgacacccatgctgcatacgtggacgacccagcacgaatctccgcgctaaatattgttttaaaataattgtcttgattttttttaataatgatgaaaactgattcatatctgtggtatataaaagacacagccgataagttataaaaatttagggggaggggggggattaatgtcatgggataaattcacccatcccttcaaatgatagccagctgaaatataaaaaaaatgatcatatagtaaattctataatgaaagtctgaaagtattatgccatccaaaatagaataaattatttccaacaactgattccaaaattgtgcgacgtagtatcttactccttttgtgaaaacattaaacaccaaaggtggatcaaactagtagaagatgtgaagatgacatgtatttggctggacaatttttcgttttcaccactaaaaatttcttacatggttgtattacgataaacaaaggttcaagcttttataatttgagaataatattgttttgaatatttgaaaaccttgtttagaaaaataagtggcatcagtctaaaaaatacgagtggctaaaatctaaagataaatagtttcacttattatttatttcagtaaaagaaagtttcccttatataaaaagggatgtgaagtatttgagtttttttttgcgccaaaaagtatagcaccacttcgcaatacttttatatatttaagatgcaatataatttggtaatatgcttgtctaaaatatttgaaaatatttttttttataaaaatccgactggttaaaattttgaagagggatagtttcacctattctccagctaaaagaaatactccctccgtttcaggttacaagacgttttgattttggtcaaatttaaactaatctaagtttgactaattttgtaaaaaaaatagtaatatttttaacccaagacaaatatattatgaaaatttattcaattatagatttaatgaaactatgctagtgttataaatattactaattttttctacaaagttagttaaatttagagtagtttgactttggtcaaagttaaaacatcttccaatctaaaagggattgagtagtatatatatatcacttatatttagaaacggagttaggagtatttctttgagtatttttctaccttttgaggggcatccctatcgcagaagtcaaaccgggcggggcccattcgcgaaaaaaagcccaaacccgcgcccgtaaatataccaaatccacccccctcatcctcgccgccgcgactcccaaacctttcgatcatctcttcgacttcgtcggagtcggagtccgagtccaccgcctcgccggagatggagcacgcctcctcgccgcgcgcccatggcgtggtggtgatcgcggtcgccccggaccacgacgacgacagcggcaagaaggggtggcgtctcgccgccgccgccgcccccgccttcggggacgaggcggggttcggggtggaggaagaggaggaggagggggaggaggaggaggaggaggtgaggtggagggagcggcgggtggcgtcgctgtggcgcgtggccggggcgctgctggtggtcgcggcgctcgcggtggcggggcactactgcctgtaccacgacccggcggcgttctcgcgggaggaggggaggtcgtcgttcttgctgccgctgtacccgaagtccagcgggggcggcgcggcgggggagtcggccggtagcgtcaagccggacggcgccggcgcggaggcgagggagaattcgtcggcgctgctcccgatcagaggcaatgtgttccccgacgggtgcgtgcagccggtgcaagaactcgattccatttcgtatgaaacagtagagttttgatcctttctctcttccgaagaacaaattactggagttctttttcgcgatcggatgctggttggtcatgattcctttttattgggcggggttattcatctattcttgctttaggtagaatttcggattcttttgagtttgatttgaggtggatttttttttggtttaacctgcttgggctttggaaaaggtagaactacggtgactcgagtttcttggaaaaagttgatggtttgatttattacctgttcttttacaacaatgatttcacatgaaacagttgaaatttttaaataaatttggaaacattcctgctttcctacatctctgtcctgtcactttgattgggatgttttgactgtcatatcaaattgcatataagtcttgactatacaaattgtctgtttatactagtatttatttgtgattagtttaagttgaagtaggaaggcttctaatgtgctggctcatgggtcaacgtttgatgttcatattcttctttctctttgtatgatatgtttaatctttggcagttcatgttcattgatgttacctaccagaatgcagtgaattgcaaatactaacatggaattggtgcccttctgggtattctgcttttaatctgcaggcaatattacacttctatgtacattgggaatcctccaagaccttattttcttgatgttgataccggaagcgacttgacatggatacagtgtgatgcaccctgcacaaactgtgcaaaggtatgctccaaattcaatcactttctttttttttgtcctgtttttaatttggctttttagctttattagaatgagtttaagttagcatggatatcttatttcaccatcttattatgagtctaaatttcccaatttcattgtgtgtttgtgtaatgatcatccaacgttgttgcagggacctcatcctctgtataagcctgagaaaccaaatgtggttcctccgagagattcatattgtcaagaactgcagggcaaccagaactatggtgacactagcaagcaatgtgactatgagatcacttatgccgatcggagctcctctatgggaatccttgcaagggacaacatgcaactgatcactgcagacggtgaaagggaaaatttggacttcgtatttgggtatgacttgatttccgataactaattctctgaaatttgtgaagatgggatgctcttttctgaatggtaaccatctgccatctgtgtaccatctgcaggtgtggatatgatcagcaaggaaatcttttgtcgtcgccagcaaacactgatgggatcctgggcttgagcaatgcagcaataagccttcctacccagctagccagccaagggataatttccaatgtttttggccattgcatcgcggcagatcccagcaatggtggatatatgtttcttggtgacgattacgttcctagatggggaatgacatggatgcctatcagaaatggtccagagtaagtcccatccttttgtttgtgaaagtttcattacttttcccttggatactatgcatcatttttactagatataatatgctctgtctgcaaaagatcttgagaaatcctaaccaactcttgtcaccctcaagactgaaagtacaggggaaattttgcccaactgctctttgatataatatttttaactttttgcagttttgcactgatgctagatatagatttattttttttacactagtaatagtaatcgcattgatgattcgatcatacttccaagaaatgtcatgaaacttatcacaaaaaaaaaaaagaaatgtcatgaaactggcaaaatgctctgcatattatcactcttataattcacctaatctttttgctgtaaaagatggggcgagcctatatgttcagatgtcagaaaattagcataagttccagcaaaaataaagaaatgatgccatacgaggctggtatttccttttagcattgatatgatctatgtaactgaaacttgtcccttttcattctgtcaggaacctatacagcacagaagtccagaaagtgaactatggagatcagcagcttaatgtgcgacgaaaggcagggaagttaactcaagtgatatttgacagtgggagctcatatacgtatttaccacacgacgactacacaaacctgattgcttcagtgagtgcctctattaattcccttacatatggagccagttcaatctcatcttactcatgtttacttgcaatttttaacagcttaaaagtctctctccaagccttttacaagatgagtcggatcgaacactaccgttctgcatgaaacccaattttccagtgaggtaacgtgttgaaactatacgtccaaaataaaataagtgttgaaactactcatgtgctaaagagggcaaatttccaatgtccagttccagataaataaacacacagttcttaaacaatcctctgcatttttcaggtctatggatgatgtgaaacacctgttcaaacccttgagtctggtattcaaaaaaagattgttcatcttgccaaggacattcgttatcccccctgaggactacttaatcatcagtgtaagtttccatgatcaactttcatatttatcaaacgtccaattaaattttggacatctacagcaatattccctcgaaaattttcaacaaggagagcaaagccataccataagtcattcatcatgtttttctctggaatctttttacaggataagaacaatatctgcctaggagtgttggatggaacagagattggtcatgactcagcgatagtaatcggaggtatccatctgacattttcctttggtacatttctgttgccgaattcactcactgtagtttctaaacttgcatttgcttgctgtttattttttcagatgtttcccttcgaggaaagctagttgtatataacaatgatgagaagcagataggatgggttcagtcagactgtgccaagccacagaaacaaagtggatttcctttcctctttaaaagagtgctgcaaaatcaacttttgtaaatgtcacatagaaattgaaatttaccaccagctcgactgaccatgctttacttttggacgtgcaaattctacgttcaaagctgccataatcaatatcagtgaaagtaattaaacaggacatagggtaaaaagaagatgtaagtagagatagccagtaagtatgttgtacttagtaatttgtctcttctgtatacacaaagaagcagaattatgtatatgtattttgtagaatatatctcaaccacctgtaaagagtatatctcatccacttgtaagactaagtggtgaagcatatatcagtgaagccatggcatttctcgttcataactcctgtttatattgtgattgctatctgatggaatatagtgagaatggtacatagggagcataaaaaacacacaacaatatattgcaggcaacagcaaaacttagcaaagggcaatagagcaatcaataagtgaaaaaaaagatctcaactttgggcgaagtacaacaaaaggatgaagaggacttgtgaacacactataacttcctcagtggagtaggtcaagaaacactgtaccaaatgtacttgagcggcccatgcatctatagccaggagcaacaaattattagcaggttgattaaacacattagtagtacaatggccatttttaccatgatggatcactttagtggtagcaaactggagctccattcaaaaataaagctcgcaatattctcattgcatatacacaagtgtagaatttatacacatttcgtggttcgtaattcttaaacaaaactgtattgaaaaaaaaaaaagaataacaaggtttcagatgaaactagtagggtcatttgcgatgttaactcttgattccgacgaatttgcatattttatggagaaagccgccatcactagtactaactgcaacaggctcctgcacaggctctttgaagttagccttatcactcaactcttgaaatgcattaacaacgttctgtagtcgggcaacaaactcgattagaagggaggcaaatgtggccaaggacagagcacttgcactttcatatgtttttgtttcctcgtcttcaagtggcagatttggatggaatgatcttcgagcaggccaagacagtaacttgaaatctacagttgatgatgaatcatgtctgctcagaaatgaattaacagcaaagctttttgaatgatgcgctgtagtttgttcaacaattgtaggctccttcacttcgatcttgttttcctttcccataatgccagtgccattcagaacttctttgataccttcggcttgcttgctagtgtcccatctttcagtattcacaagaaggtacgacttctcatcaatccttttttgcaactgttcagcagccaagtggacttctgctagaatatctgaagagctcaatttggtcattgtcttgactttgtctccaagctcgcgcaacacttttgcaccttctataccaactctctgaatttctgcactaaaaacctttctgctttctggtggtgcctaagatcaaaatccgatatatatttttgtttataaaaataataaaagcagaagtctaaagtgtgctatagaaattttatgagaaaacctgaatttcggaaagaatacagccatgcaatgccatgactgcaaaggagcaatgcctcaatgccccaccaactttggtgaaattcctccaggggtacttcatcattttgtaagcgccatggggtggctcccatatagcaaaacccaactgcaaacagataagaatgtgatcaattgaccactcaagaaatctaagtagaactcttaaatttagagcaagatcaaaccagagtttcctcttgtgctgatgcctcaactgctgccctatagccactatatagaggatcatcagatgcttgatatacaagtattttcgaaggaatcctttcatactccatgcatttcaaatatccatcaacgcaacctagaatgaacagccaaaaacggtatcaagcatacaatacttgatatcataatttggcaagaaatgcataaacatcagatgtatctatgctctatagcaattgcagtgctagcacaaagccacaaacaatattcttttaccacgcatttcaacataaagtcaaataacgcaacatggaaaaaaaatactatagatggttggtttgcggggttggagtttcataccttccaaggattttgcaacaccaatgaagttttttgcaaccaaattgtgcaaatcttgtccagcccatattgggtaaatacctacattgattcctagactgacagcagcaccaatagcaattaatataaatctactcacagccgtatcagtgaacttccctgtgttgtacccagaaaccatgacatagcagaatgtcaacaagaatacgcggaacccatactcataggccttcatttttggatgcagtttcgtcaaggttgtgaaaaaagctaacaatgaaaaacatcaaagcaacatactacaagttagatatactcacaagtcaacactacagccagcaccaggaaatgatagacaacagccacaggcaacagatgcaatactcaccaacaataaatatgctaattataagaattacttcctccagctttcccaggtgtttggacaattcggcgactgctagcgcaagccctccagcggtaagggtacccaatcccctattaaaacctttgctaaatgttgcacctgtattaacacgaaccacattattcaagggtgacaatttatttttgagtaaattgcactttgagccatgttttagcgccagagtttcagtttggaccaccccttaattcatgttttcgctttggactaaataattcccttccattgcatattggactacccccactgtttatctcttccatcccttcttgctcctccctgaactccggccagccaatacccaaagacgctgcacgcgctcgagctctgccagccctgagtggcttgagctcagcatccatgtgagcacgaagtgtgcacggaggaacgtacaaattatgatacaaacacaaagaaaaaactatgatgcaagctcaagcctctgattgggtgcttgccaaagaatgcatgccaatccaaagaaaatcatgcaaataacccatcacaatcagacctcaagagtcatataatcgaggctaagacgctactcaatgaaacagctcaatctcaaagcaactatcttgccaaaccatcaccctctcagaaaggcactccttccttagcgtgttgcaaagcgtactggtgctcggcaattgactcgagcgcagcgcaacgccggtggagcttgagcatcagaggtgccaacggatggagctcgtgccaccctagctgtgggtggagcttgagctcaagctaggccacagtgcagcatgggaggagcttaaagcgtggcagtgtgcgcaaggttcctccggaatttgagcttgagccactcaacaccagcagagccgagcgcattgcagctcttctggatcctagcagctagccatagtttaggaggagatgaaagagatgaatagtggaggtggttcaagatgaaaccaaatgaaatattatcaagtccaaagtgaaaacatagcataatgggtggcccaaattaaaaccttggtaagaaactgtagcccaacgtgcaatttactctttattttttttcagttttacacacaaaggaatatatcattttataattataaaatgtttattatgtgaattgtagatacgaaaatactccctctaatcagaaaagacatgcgctacagtaaaatcaagttaattttgggcaaaactattgcttacaatgtatggtttggatatatgaaaatgatgcaaacattatttttataagaataataatgttattattataaagttttatgaatatgcagtaatagagtgtggtccaaatagcgtcctgttgactcaaaaaggaataaaatgcaaacttgcaagccaacagtagaattatgagcaaagcattattaattgtatttaatatttcggcattaaaacaatattacagaaaatagaagttgtctccagtgcaggcgttcagcagcaactgtggtcaatgctatattttttgtcctactcaaacaacatccacttctttagtcaatgtgtcccctatttcatttaattctacagttggttgtagaacaaagtgggtccaaacaacatatactatctagcaacaaaatttagtggtactttccagcactaatggataaatttaggacgtttcagagaggccacaggcacacgttctaagacgtggtggaccataaccactttaaaacggggtaaacatcccagcacatgaatacttaatcgtagttagtatctgcaagtgaacaagcaggaactctttaatcatcaaatcttattctatcacaggttttctataattctccttgttcggttgcacgttctacttacaagaataataacagaaggtcaacagatgaaccaaaatggaagacaggttcccccatttcccttggaaatagaatatctcatcctcaatgctcttgctctacacactagtactacacagacaaattagtttgggtgacacgatttgtgagtcttgatttgcagatgcaacttctgatctgt

SEQ ID NO: 74918 - DNA, 100744 bp, Oryza sativa
tttataatagaccggtgtgtataacaccataagaaacattacaatatcatgtgtcaatgacttgacagaacatagagcatcaattaacatcaaaagtagcccaccggaagttcccaacatatgttccatctaaaagctctaatatctaaatattacttatactactaacacagcgtacttcaaatttcaactgtcacaaaatatttactccactattggcaatggcagtacgccaatgtgaaacctccaagcactttcttcaaactaattgttgatgctatactatatgcctgcattaatgtttcgtaaagttaaatctgaaaccatgtgcaaagattataggtaatgtttcatcagtgatgaggaattgatatggtagcaatagataatttatataacctcaaacatatacctgacaaacgagtctaattgctgcccacaaccgaatttgcagttgaagcttgagttgggacaaggataatagaattagtatcatcctcctagtatgcaacaaacaagtaaacacagattattagattgtgtatctctattaattggttagaaacatgaaaatataagaacttactaaatatgtgcttttgtggtggcctcctctaatccaactagatgtacacaccaaagcttgtgctgttgatgggagtaaagagctgtgataatcactaatcacttgaccccctgtgctgaaagctgattcagatgagactgaggtgatgggaatagtaagaatatccttggccaactttgccacaattggatactttaattcattcatcctccaccactgaagtagattgaaactttttgcaggaatatcctcaacaggatcatctaagtacctctttaaatctgacttaggaagactagcagcattctttgatttcatatactcatgaaattggctagcagcaaagaaatgactactagtagtgcccagagatgtactagtagattgagtggtggcatcattttcctttgatgtgctctggagttcactttcatatgatgcatgcaaagatttcaatgtggattccacatttgcaagtttcttaggaagtacagtttcttcatacaaagcagggaatgtgtagttaatcatacccatcttaaaccttgggtctagaaccaaagcaactgcaaacaaagtattgcattctgggccccagtacttctcaaatttttcaagcattgcatttgccatttctttaagaattgggtctttggacttcatgtcacgccccgagctagtcccgactggaattagcccgtgacgctccaaattaacctgttaatcgataccagtcccaggaaaacagtgctggtatcacagggagacagaatatcacagcaacagaggtctctttattatagagtagaggtacagtcatgttgggctgcggacagatcccgagctcacaactgcattacaaaagggaaacggaagccagggcttggaccaaacatcataggcgcgacttgggaattaggccgaaaccctaaaactcatcgaagccggcttgctcctggaagaactcttcatcagcaggatccgcttcatcttcttcagcaactgggggggttatttatatagagcaaaggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacggccacccgggccaacaacttttcaaacggccacccgggccaaccactttcaaacggccacccgggcctagctgatcccgtcagctacagatttttcaaacatcaaaccccttttcacaacagcaatttcacaagcagtagtcaaacaaaactacgctaagaatcacctcacatccgcccatgaccgtgggcacggctgttcgaacagttagttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggctaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttagaaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattaggtagatctcgagatttggggaattttggaagttgaacggagtcaatcggatttacggttgggaagatattgaatttctaagattattggatttttggtctgaaggaaaaaggatttaggcccgggtggccgtttgaaaagttgttggcccgggtggctgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacctttgctctatataaataacccccccagttgctgaagaagatgaagcggatcctgctgatgaagagttcttccaggagcaagccggcttcgatgagttttagggtttcgacctagttcccaagtcgcgcctatgatgtttggtccaagccctggcttccgtttcccttttgtaatgcagttgtgagctcgggatctgtccgcagcccaacatgactgtacttctactctataataaagagacctctgttgctgtgatattctgtctctctatgataccagcactgttttcctgggactggtatcgattaacaggttaatttggagcgtcacgggctaattccagtcaggactagctcggggcgtgacacttcaacaactgacctagtactctcttaatatcgacaatgtgagaataaaaaaggttagatgttgggtaggttgaacctgagaactcctcagtggctgcatgaatgacagaaagggcatcattgacttcacaatatagattccattcctctggtgttggcagccacctatagtttgcatctcctgcagcatatacatccaaggcagacctataaaaaaatgcagattgcagcattttgaaggttgagccccaccttgtgcaggaatcaatagccaaacccatgtcacttttaaggttgagagaatcaatatcagcactgaacttgtatgctcgattgtttgatttcttgatgtacttgatagtgtccctaactttgtcaattatatgcttaatcacagccagaccatcttggacaattaagttcagaatgtgagcacaacatcggatatgaaggaattttccataaaaccaaagtgaaccacgttttgtaaacttggcaagcaacaggttagcagcactatcattacttgaggcattgtcaaatgtgatgctagctatcttgtcctcaattctccatgaagcaagacaatcagaaatggcattagcaataactacaccagtatgtggaggctccaactcaagaaagttaataacacgacaatgcattgaccaatcagcatctatgtagtgggcaacaaggctcatgtagcaaattgtttggttagaggtccaaagatcacatgtgaggcttatctttctaacatctttgaaagtcctcttcagtttttctttttcagattcataaagcctcatacaatcacttctaatggtatttctagagacctttttgtaagaagggtttagcctctttagcaaaacattaaaccatgtatactccacaaggtaaaatggcaactcatggacaatgatcattttgcaaataagctcacgtatctttgtaggatcataataaccagggacagaaacacaaggagcatcaagatcaacatcaccttcatcaaggctagggaaattgatattctgttgttttatggatttttgttgaagcttgtgataatcacactgctctaaatgcctccgccaatgtgttgtagtgccactactattcttggtgagcagagtttcacatgccttacatttgaccttattttccatttctcctttcttcttctttgatggcacagtgcattcttcaaagaaatcccacaatggagatttctttttcctggtggctttagttgggtttccctcttggccctcttctccccttacttcacctggtactagctgctgattcggttgtgcttctgttgctgctatgccatccctattgctcggtgactcgatctctatagatagctgtctttgcaggtttacagacatctacaaaaaataaaaataccaactgctatcaatatatattctgcacaaggtaaggaatcaaacaagtacaacaagaaaagcattgccatcaatttaccttggcaaatggcaaacacacggtgttctgcaaccttcagtctttcttcagaagaggaggacagcaagataagtactactctatgtctccacctagtccataaaattcaatgtaaatcaataacatccatcaagcaactaaacactacacaattaatacatgtagggccctagatacatgtgggtgcaaaagaaataaaaatgtaaaacaaagaaagaagaggaaacttactcagatccgagtcgtcggttcgtcactcacggcggaggcggtgggctgctgctgtcctccatggggttcttcctggacaggagaggcgaaggatggacggtgcttggctagatccacagcagtggtcagtggagcactagagcagcctaggattgtagatctagaagagaaatgtttcgaggaagagagcaaatgagctagggtttggatacgggatggggatataagggaaataaatggttaggtgatggactgctgttggtggtaggattttggaattggagtgcgggagaaattgggataggtagcgggagtgaaaatttcaagcttctgccgaatagctcgagctcggctcggtagagctcgcgagcttcgagacaagctcgagctcggctcgaatccttgccgagtcgaactcgagctgagcttgcgacgagccgagctcgagctgctcgcgagctccgagcttttttgacagccctaaccgtcgtcgatgaatcgccgccacaaccatcttcgagctcccgacggttggccgatttgggcctgccgctgatgacctccacccatccctgatctagccgccatcgagtcgctgatccaggattcgctacatgcccctcctcccgccgccatctagggttctttctctcgcttcagcccagcgcttcctcctctctcgcgaaacagcgaagaaacagatgccgcgtgcgtgaagccgtgaatcggtatacaacgcgaaagtacaaaactaccctccataccacggtaccgcgtcaatgggaggtgcggtaccatgaggtaccgacgccttttggaccgttggatgatctcgaatcaacagtcacgatttggtactgcagttgctcaaggacagtaaaaactcggcttcagatgttcatttccagacttccagtgaactatccttactgcttacagttaaaacgcagttaaagcatatgtatctgactaaaaaatgataacgggcaagaacaagcattcattgtagcagatttgatagcacaaaaatagggcatacacataatgtcttacaagccaagtttcagaattagcccccacaaaggtgccttttactcctttcgtgcatccttgacagtatgttttcttttccacgtagcagagacagcactaggctattcttttccctctaggatttttatgatattgaatgtgagggaatccaagttcgctctagttgatcacttgctcgtgagatactgagatctagagacgaagattggagagagggccggcttggctgcagaagcaagcaagaatcctacgtgccacttggagtacgctagatcttccagtcctactaacagtagctcctcaacagtctgcaggccctagctgcaccaaccaaaaacttcaagaattcaggatgcatatatccatccatccatctgtgcgttcgtgtgtatgacggttagcagcgaccactctgtgctagctagctccatggaggagagggacttagctctcattgatgcgcacacacctccgtgcgcatggagtagtatagtagtaccacactgctccataatacacatgcccgatcgatcgtcggcagcggcagcagggcctcgatcgcgagctagctgttggtatttattacacacctcggcctttttgggacagggatactggagaaagtaaacgattacattcaactcacggggatgtgtacaacccgatctattgatctagatattatgttcgatcttgtacgttctagcttgccgaaaaaccaaaccaaaacttgcatcaggtctctctctaccgggtataagcgtgtggtaaaggtaaaaagaacattgtcttcttccacgcctcagttgcaccatgcatgcattatgcgtaaatccagcctctaattaagccattggtgaacccatggagccatcgagcccgtacgactagcgttattctgagcctcttcttacggaaaacctcctcctccagagcgcacacgaacgacgccgcgcactgtgcacgcaagtgcgaaacggatggtcgttaaactgcccgcggcgcgcgctctgttcaggggcgtgggattcaccagacagccaccagtggcgccggtgcgtaagctagaccacccaatcaacagcgactccgtagtcaatcgtacaggctacttgcccccttcgcgcgcgcggtgcgcggaacagtcatagccacagcggttaccatcgcccgaatttaccgtcgagtcgctttgacccgtgcaacttaaccggtttaccattggtgagaacaactgagagaaggataagatcgtagagcaaaggttgctattgctactacaccattcagtagtgccgcgagttttgggtggattagccggtcgccttttgagtgccagtgggagaccggtccaaactccaaaggcgaggaaattctagccggggatgggacggctatggcgtgaaccatggtgcagaaggactgcatgccgtggcttagcttacctggaagggttctcttcgactcacgaaagtcttgcgtgctagtgaccccatcgcgcagcaaaagtgaaggggaaaaaaagaaaagagagcgctaaaaacacttgtggtacttttcagcgattctttcctgagctgccactctccccgtaaaaagaaaagaggtgaacgaatgcttcttgtacgaattccacttttttgctaagataatttaggtgcggcttaacagcggcaagaaaagtacaagcagagagcgcgagaaggagggagggagatcacctgcctcgtctaaaaaaagcgcaagggtaagcgccacctgatcgcagccgtccaaccatgatccatcacgtgtcgccacgtgagacagcaaatgagcaaaccccactgccttcgtccaggcgcgccccgcgctacggccacacggacacggggggacagcacaaggtcgggccaacgtatcaataccttgtcccgtcctgctgctcggtgtggaccaaccgattacgccgggagatccgcctcgggatgcgtgcccacacagcttccacaggggagagaagtacgatggccagactcattaaccgagaattaacccctgattaactgcgttaattgtcgtgctaatcccaccctgggtcagtaacgcccacaccgcgcaaagtcagtggccactgacacgccgatgcaatccaggtgggcccagcgaggagaaaagaacggtgccacgtggacgcgagacgtgggccatgcttataactacctgcccaccaaacgaggagagcagctcctgcaaaatcgagctccagttttgctgccgaaaccacacaaactgtccatcgagatccaactaattctcccaagcatttttaaacaactaaaagttctacatttttttttctcagtgctgcatgcttagtttaggaacagcaattctgttgcattagacagacgatttgttaggatccagcgcatatgtttgcgccggacaagtggggcccatcgcacagtgagaggaatgaacggagcagcagccaagcaagagacggacaaaatggactaggcaaagtacgaggctttcttttctgctttgctcctagcgtgagaagggaaggggggacgccgtcacggcggcatatgcagcagccaaaccgggcaggcaggtggtcgtggtggtgggcagtggaagcagggaggagagaaagcaggagcagaatgccgctgttgctgcaccctgcatgtggatgcaaccatgaacacactagggactactaggctgatcctgcattggtactgccattttgttgcttttcttttctactacactgcttactatctcgcctattgtttggccaaatcccgtaccatggacaattggaacaagaacagctggagactgcaacagaaagcaacagttcagctataatttttctcctgtggctctctctgtttttcggtggaatattttcatgctagattatgatcaagaagtaagcaagatgctaagctctgctagttgccccaatgtacactgttcgggtagcttgaaacaaacaaaaagacagaacagaatggaggacagcatcaagcaatttttgtagctgaatgaacaaaacaactgagaaaaaaaaaactaccaaagcaaagatgtctcctttttatgatattttctttaccttttcggctgcctggttaagcagctctttctctcgaatccatagctctaaccatcttctttggaatcaaccgaaaggagagagagcactgaacagccagtatgctcgctctctcatgctctgcttgctttcaagaacctggcttcgaggagaggaaaggatctgaaacggcggagagctccacgtcgtcgaacggcgccgggaggttcagatcaatgaagccgttgcttttaatcatggctggaatatcgtcgcccgatgcggccgccgccgcggctgagcacagctgggaccgcttgtggccgcccagagcttggccggacgcgaacacgcggaagcagtaggggcactcgtgcggatgcggcttcgcgccctcctcctcgccgccgtcgcactccggcaatggctggagaggcgtagcgggagaaggaggagggttaggcggaggcgcgcagcagccgcccctgccgccgcgcatgtggctagcgcgatggccgccgagggcctggtacgatcggaacaccttcttgcatgcggggcactggaaccgcgtccgcttctgcgcggccgctgcggccggagccggaggtgcgtcgccaccgtcgctcccgtcgtcgtagcctgcgccgcggagacggtagggcggcggcggcggcggcgtggctggccaggtgtcgcgggagagcatcatgagggacagcgctacgtcctcctccgacgtggcgtcggacaccgagctcacctgctcgacatcgcccgatccggtgttcgcgcgcttgccgtgaggcggcgaggagtagtactccgtctcgctctcgcgatccgagaagtcggactcggcgaggcggaccctccgcttgggcttctcccgcagcacgtatccctggatgggcctcttggcatcaccgccgccgtcgtcgtcgccgaccgcgacggatgtggacgcggaggacgtcgaggagatctgcgacctcgaggcggcgactgagtgggagcgcatgtggccggcgagggcgcgggggttgccgaagcggcggtagcagagcttgcatgtgttcttggccatggcgagagcttggatagagcttgatgaggcacagagcttaggagagctaaaaatacgagctttcagaggaaacggagagagatgaaagcgctgcttccgtggggagttagaatagagcggaactgccagcttcctctcgtttattgttttccttttatttcccccctttttttctgggtgactcattgtattcttgactggttgtatttgcagcatttcttttactgctcgtgtagaaccaagcccaaccgtatggaagatttcggactgatgcttgtagttaattgttagtacggatgaaaggaatgagcctattgttcttttcgatgaaatgagtctaatgttttgccatgtaccatcatgtggtccagtgcgtagtttttagcagtagcggttgtattgctgagatggtggctattttggtgatcagattagtcctaattaaaaatctttatttgctaccatacagaaatggcttttgcatacgtgccatatggctttctatgcgagggaatgtactgtgggatgctgctgtactcaatgcaatagctctgaaaattacccgccttggaagatgccactacacttcatggctgtcaaattgcccttttgatggatctccttaatatagctttgccttgttaaaccaccatttttatatcctgatcatccaaaggccacaccttggtgcagctcaggcgttcagtaagttgggtgagatatgtctgaatagagggctcagaatgagatgggaacaaagagtaggtgacaagaaggttgggaagatgggtagaccagtgagaacaaagcgaacacagggtggagtgtggcttggggaatcagtgatagtaataagtggcagattaatcagccggggtctaaatcacaagagtcacttacaatgcaccactgtttttatacctttctcattaaattaagatctgggtatggtgggaacaaaagatctcgatacggtttaggcaacgattaatcccttattagcagcacgttagttgcttacccacaaagcctgaccgagtgcccggccagcatgcatgcatctcatcagcggatctctcagaattatgcccatccaaatccagcctcatcttgttcttaatctccctggaattactcctggcctccccttcacattatcttcctgccaattttaaccaccaggcatgcatatgcaccagctgctgcatgctcgttgagagcttagcacttagcaggcaagcaagcaaagcatctgcgagagctagcctttccaactaaccgctttagggatctctctggttatgatgggtacgcattaggtgcgcccccgatttatgtacatgatggccattcaccccgaataaacacctaccagctagcgagctagccactcaggatcatatttagtactaccatcaagtagcgaccaagtatccagcatcattgttgatcaagcatttgttatgcttgctacggctgtcatgttagtagcatgctactgtgctgccgatgcatggtgttcattgtgtttgtgtgtttctgtgtgtttctgtgtgtgtgcgtgtttggacttcggtaggtaatttccaaatttccatttcactttgtagctggtactgtcagtactgtactagtacagcgtacagatacggtacaagtcaagggggatcggctggctggcttcaattccgttctgaacactaggcagcgtggcaggcgatgagatcataggcgtgtgttggtttcttgcttcgctcctcctctcgtatactctactggagtgtgaagtttttccccctatctgtcaccttcttttttcttttctgtcatcttggtgctgtccttgttctgctcttgatccctatctccaacctttgggagtattcattggaatcatcatcccgaattcatgatatgatatcgaagtgattagctctgaatacttacaaaacatgcagtgttctccttttcctttccttgggcctgcaggtgaagcagatttgtattctcctgtaaaatgcagtggcttggcaatcagtggaagcaaagggttagtgtcttcctatgttactattccacaatggtgtgtgccacgatgtctttttttctttcatggagaaaacgaaaatcgaaggaacgagtacaaatccgcgattcggtccagtactccggtcattgtcctaccctgtgaacttcacttgcagtcgcgtcgaggatccagaggaccaaagctttccgtgcaacggaactgtttagatggtactccagtccaggaacaagacgcgcgatgcgatggcgatgaaaaccacacgttgctctccggcgcgcatggccgtcttgtcctctcgcgctttcaaaacgagcgtgcgttcgtgcgtgcagcggagcggagcggggtaaagaacggaagccgcgagggctacgagagggctagcgtgcagtaatgtccactcgcacaactccttggattcagcaaggctggatggacgggagcgcgtcaggcgaggacgaacgggattgggtcagaaaggattacggaagaagtcagcgtcgcgtcccggtggctgcctgcctcgcgctcgaattggagtggagcgatccgagtcaagcgccgaacgaagcgaagcccccgtcgtttccgccgtcgtcgtctcgctcggcagcctcgcatcgcatgcgccggcgctcgccagctgacgagagccgcgtgcgccatcaagcttaattgtgagcagctagctggctgttcgacacgtaaaccgatgaacgaagcgaagaagaagctaccgaatgctgatgcatttgctgtagacctgtagtgcatcgtgtagaaaacgaaaaaggatcaaacatataggccgtgtttagttgtaatttttttttcaaaattccaactttttcatcacatcaaaactttcctacacacacaaaattccaatttttccgtcacatcattccaatttcaaccaaacttttagttttggtgtgaaaacacagccatagctttgttgtcccctttaatgccgggttggttcggaaagtttcgttaaagagggtttatgatattcctacatgtttacttggtctttttgagacggatttgctacatttatgtcgccataaattttcgttgattacagtcggtatacatgcctattggtcacacagccgcacaggcttcccactgcatgtgcttccatgagagagaagattattttcacacatatatcgcgtgatgatagacgattacatactaattacactataattacatactattttatgacttacatatacaattttgaaacttacattgtaaatacactaaaattacatatgtaattttgggacttacatatgtaattttgagacttacattataaatacactaaaattacatatgtaatttaagaacttacgatgtaaatacatatcgactattttttggtgaaaaatatggcgtcataaatatagctactgatataagaacggtaaatatattcggtagtttgacgtgagggaaagtaaaactaggtgatgtgaaagacctttttacacatcgacggataaattcgttgtagtctagctggttaggatactcggctctcacccgagagacccgggttcgagtcccggcaacggaaatttttgattttctattttctggtcatgcaggcatacagcttcaaaaattcatatcttaaataacgatttcagggtgcagcatccaggctgccattggcccacgtggcactctacaaaattttccagggctactctgaaattatgccacgtgtcctcccgtatacataattaaactgcattcttctgtccacttaactctcaggaaaagtcaggagtcaataaatcaccttgcctaacccttgtgaagaagttggatatgtaacccttccgaagtctctagaaaaattaagatagaagttggatatgtaacccttccgaagtctctagaaaaattaaaatataacatggttcttcacgtgtatttatacgcacaaactatgtcagtactcacatagtcacatattgatttccaagacctttgatgctttaactttttaagactggttttaacttttaatacaaagagtaatcttttaatacaaagactggctttggatattaagctgacaattagagtcattagcctaaaaaattatgccttacataaatttcgtaattttcctataggttaacaaattctgtaaattatactaattcaaaagacacatcttccaaagtatttgtccaaaggtacttatagacgcttaaacaagttaatctttcattagcaaaacttttttcaagttgaattataatatacagcagagaagtacggctatctaaatgtggtagagaagaattaattagccatgcatacactaattaaccatattactctatttgttgataatattgctctaactatgttcgattgtacctatgattagcttgtattatttttaagatggagggagtatcgtatatgagactacagagaggagtaggtgacactggtatgttagcagaagaaatttctcttagagagacttgtcaaaaaatatatcctttagttttcggtccactaatgatctaatcttaccaattaataataggtgttaattactctgtctaatggaagagaaaaacaaaggtttgaaagcaaataggcaagtactatacataatttttatacataattttgctttatgtattaattcttttacaacgcttaaatctttacataaatatggttattactataagttaatcgttcctcagtcttttcaaaattcattaaataggttcttgtaaatctactgcatttgaaactctagacaacaacaacaataatttttctaaatgagtaaatatatccagctataagttggtgtgccgatggtgcgccaattttctaggatatggaagcagggaattgggaaaggatagggaggtgagatttgtatatttgtttctaatttttagggtatttagtgtaatgttggactattctataaatttgaaaaacataagaactaaagtaagaaatatgagggcccggcatgaaaaatcaagaatatctctagagttactttgcattataggataaacaaatttgagatatgctaactcatcctacgtgatactttgaggagggtcttgcactacgaacgccctaagagaggtggtatagctatagttttccgaattatacatatgaggctacgaattgtgacatctaaatggtgtactactcgcaatagaagatatggaggcgtgtccctctccattcacatgtggctcttcaaatagtgtgtgaactatgtggtcctctcgtagtcatgagtcatgactattttcgactactgagaagataagcaaatatttggaaaaaacagagagcgcggtagagatacaaatgataagatttttaaccatcgaggatttaataatgtaaaagtaaaataaataaagagaatttagaatgttatacttaggctgaaagaaaataaaaatatgggaagaagaaaaagaaaaaatcatttcccttttttttcataaccagttaaaaaaacaattccaactgttagtgctattataagaaacctctagttattatgagtaaattccctgtgtacccctgaaaactcactcaatccctttcatacccctgaaatttacccaatcccttctatacccctgaaaattcaatttgatcccttccatgcccctaccgttacattttccatcatttcactgttacgtttggttgcaaatatcctttttgccctagatgctttaggtttaaatataagcttaaaaaacaattgaaaaaattttgtttgggtgcacagtatgtgcattttataagactaatgaaactaaataattagtgcagaaaattttgacataaattttgaaaataaaataaatgtaataaattaaaatttttatttcaaattttaataggacaatggatttttttatcgggagcattcataaaaaaaatgttgtgaacattggtagtcctatctttatatgaatgctcctcatttttatgactttttttaaaaaaataaatacgtgttttttatttcatgatctaaaaatatttttgggataaataatgcatcgcacaacaaactcataactataatagtctcatgcgagaagcttttatatttttaataatgtaattcatgaatttctttgttcatccaagggtaaaatggtcatttttatggaaaatagacggtcaactaacggtcaactgatgggaggggtatgcaagggatcaaaatcaaattttgggggtatacaaggaagtaagcaaaattcaggggtatagaagagattaggtaaaatttcaggggtatataagggattttctcaattagtatagtcccaaacaattttcatataaggcttcaccttttagccttatcttattaataataattaaatcgaccatcaaccaacatatatttgacatcattttttcctctgtaatttaaatatttacaaatataatgtttactcagacttgtaggcataaaattaaaaactgctaaaatatctctttaaaattttacgcttttacaaataacaataaacagtatatgtagtattaatatggtttgctatatggatggtgtgctaacggcgcaccaattttctagtatttacctcttttgtgaaaaaaatactcaatacttgcttctcttgagaagaaacaagagaagcacctatttctttaaaattttctggtcatacaacttaacagattaaattcatatattacctcttttgtgaaaaatactcaatacttgcttctctcgagaagaaacaagagaaacaactataactttaaaattttctggtcatacaacttaacagattaatacattatcttgtgtgaaaaaacaagagaagcaactatttctttaaaaattttctggtcatacaacttaacagattaatacattacctaaattttctggtcatacaacttaacagattaatgcattacctcttgtgaaaaaacaagagaagcaactattttttaaaaaaatttctggtcacgcagcttgacagattaatacattacctcttgtgaaaaaatactcactacttgcttctcttcagaagaaaaaaaaatcctacaagtctactgcctcttcccaaattcatatgttacctctttgtaaaacatactcactatcttgagaagaaaaaaaaacctacaagtctaaaagaaaagaaaaagtcacaaaaaagaaggcaaatacttatatgctcatgcgaacaacatatatgcaattgcaaacgcatggaaataatgtaacagtatatatgtatgtactgatcaattcgcagatcaatcactccttgtcgttatcatcagcacccccgcgagacgaggagccaatgccgacttgcagccacggtgtcgtctcccctgccatgctcacgtccttgagatcgctaagcctcgctctcttgacggtggtgctgtccgcctcgtcctctgctgcggcggtgcttaacccgaccgcgtcgttggcgttctggctgccggttgtcgcggtagccttgttccgttggctgggtatcgccggcgacgatgggatgtataccggtggtggcgcgtcgagatgaaacgagctgccgccgaccttcggacggactgttgcggccgaggccagcagtggcgggttcgccgcgatgctgaggtcgagagcgggctccggtgcgtccaacattggccggaacgagagcgggacaaggtcgtcggctaggggtgggactgaggcggtgtgatccgccgaacttgacgtcagccagtggcaccgtttgtggcctccaagcgcctgcccggaggtgaacagtcgatggcagaccgagcattcgtgcatcttgcccttcttcttcaacggtgcagcggcgagcgcggcgaccggcggttctatgggcacgatggccatcgacagttctgccgcggcatcgctcgtgccggcgtttccatcaccgtcgatgcttgcgtgcacgttcctcctggcatcagaagtggccttggcgggattgtcctcgctccgatcagcgacctctgcatggtgtgatggctcagccacctctgcggcgttgctctccagcttggcagcgaagcagcccttcaccttcttgtggctggcacggtgcccgccgagagcttggtgagaagagaaaaccttcttgcacgccttgcactcgaacatgcctcgaggcacggtcgagacatactgtggcgccggcgccggcgggggaagcgccatcactgtatccagtacatacgtcgtcggctccatgaacgtgatcagtctcttatgttccttactcgcggaagaagatgaccgttgttctgcttcagtgacgcctgcctgatctaccttggacgacgagagcatgaccaggcaattggccaggtcctcctcctcgccggcagcgcacgctgagggtgtcggtgacaaatcgactcctgtgcccttgcagcgacgcgagcgcttccctttcaaccaaccggcggccggtgcagaatcctcttcgccgtcggcctcgggcgaaggcgaccacggttgcagcgagtgatccacgtcgtcctcgtcgtcgtcgtcctcgccggagctgcacttgccgtgctcgaggaaatgctcccacgacgtgaactccttcccgcagttcttgcacacctggcggctcctcgtgacccggttaggattggtgcggagctcgtagacgtgtgtcgctgcccctgacgacgacgggccgcccgcgttccaaggatcatctgccccgccgcgcgcacgccgcacggcctcatcgccgagcgaatcgtcgtcgtcgtcgtcgtcatcatcggcacccaacccatcgccgtcgccgacgccgtgggccctcatgtgcccgcctagggcgcttccgcacgtgaaccccttgttgcagactctgcagaagtgcttgtaccccgacgcctgcgccgccgtcggcggcggtgcccgaggtgatgacggcgacggctgcatctggccatgatgctcaagaagatgcaatcgttgtatggaaaatcacaatgtcaacatgtctcgacgaaaaatcaaatcaactttcggtgcgagacatatatatatgtgataatcgactaagtaccaaagacggtgaagattcacacatgcatgcgcttggttcgccgcggcggaatcgaattcgacctggagatgggagcgccgatcaagtgcgcgcctccgtccggtgtcacgaactcacgatcgcagcaatgccgcgagttctcctgaacctgaaggtccaaaacagccatccaaatttaaaaacttcgtcactactgcacgtccatagacatatatagttctcataggcgtgtttcgcggtgcatcggccgctttagctagtgacgtttgacaacgcctaggagtgacacgtgccggtgataataagctacatatctctgaatctgaaagtcaagggaccagcccacgaatcatgttcgtccaacggatgccatttgacatatatgtaggattggagttgttagttttttaacaacagcgcacgtgcactagtgtaccttggggctccttcggattgcagaatctaaaattaattttgttaaatttaacattgaatgtattttgataatattaatcaaatgacttataatatggaaaggagggagtagcaaattttggtcgtaattttaaaaatgataatcatgtaagtatcattcgcgtatgcacatctgaatagcaaatccgtctgaatatgcgacggctgctatactctagatcgcacatttttttagatgagattgtacactcttgtttcggaagtttccagagagcgccgtatgttggattgcaataagtggcagcgatccaaattcttacgattaccaccctccccttgtttggcgattctaaaataaggccttcccggggaattttcggctcctttcgccatcctgcgtcaacctgctgatcaatcgaccgggcaagtaacgcaccgccaggtccgtcaacacgagttgggctgtaactggatccccacacacgtgcccaactacatgggccggaacgggattcccatctgccgcaattagttgggccgggactgtattcacacgaacgcgcaacatgaattacagaggaataagttcactttgagtccctcagtcgccgagtccaaaattagtcccttgagcgcaaaactgagtagaacgcatccccaacatataaaaccaatacaaacgagatccctcggtggtattgtcctcagttttaactgacgtgacacatacgtggctcctttgacaaggtctttatcccacgtaacattgacgtggcgcttatgtggcaatttgattctgtaaaaattaaaagacgtgggacccacatgtcagctacacacaagataataaaaaaaaagttgaggcccatgtgaccccacgtgttatcgtcactcctccctcttctccctatcccctctctccttcccctacactgcaaggagaagggcatagcggtagtgggtggcgcagaggagctgaagatgaccaccgttggcaacgcccacaaagcctcatccatatttccgcggcgtgcactgtgctcgggaacagctctgactagtacacatgcgccaacttcatttccaccaactccgactcctcctgtggctcctaggccagccgcgtgagccgccacaccttcttccctccaaaaccgcgtcgcacctcaacttccaccatgccatgagcacatgccccaccaccgccacaattaccacgatcaccaccacggagtccgcggacaacgacaactcaaccgcctcccctctcctctcacccttctcccctcctcctcctctcgtctcctccctgccacatagatctcaccgccccacccaacctcttgcacccaccagatccgcgcgccaatacatccactccccctcactatagccaacctgtcgaaatctagggctcccaaattttcccctctctcctcttctctttcctacccatgttttgtttggtctttggaagtaacagagagacaacaaatgaagaagaaaaccggcggaatccacttctagtctacgcacttgggggtcataatgcggaagagcaccacgagcaccaggagcgtggtggccttggaggcacggtcgaagagggaaggcaccggtgaggtcgccgcccaccatcggttagctccgtccgccacctgcctcgcttgcctgctccgccattctcctcgctgcccacccccacccccacccccgtccgccaccttggaagagatgatgaagagaggggagatggaagaagggaggagtgaggatgagtaagaatagagagaggagagagaggggagagggcaaaagggtggaccggaggagcgcggatgacatttggggcccacatgggccccatcatttttaattgttttgtggtgtaactaacatgtgggctcatgcttttttttattacccatattaaattgtcacgtaagcatcatgccaacgtcacgtgagacgtagtagtcaaatgaaccatgtaggcgtcacgtcagtcgaagccggggatagtatcactgagggatctcgtttgtactggttttgtaagttggatgatgcattgtacctgattttatggtcaagggacgaattttgaaaattaagggaccaacttattccaatcacagattcacagccgacgtgcctccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagccatggtccatggaccaggggcatccgcgttgccagaaatcagatcctgcacctgcacagaaccctttcccgtaccgtatgggccgccgcgtacgtacgctgccgtgggggcggccgagttgctgcagcttgcaagctgtgctgcgtcgagtaattcattaaaaataactcttattatccgaaaagtttttaatgtgcaccgacaacgcattcgcatatcgcaacagagaaaattttgcgtgctatgttcgcccattggcatggaccatgagttaaggtaaagtgttaattggtagtcatatttggtccctactggagttgatttgatgtaatctcgctaccttgtcgctatcgattccgttagcgttttaaagacttgatttgccggaaagcaaagttgatcggtcgtgacaacatgaaagaaaatcaattttacttgtccccgcatcagttcttttaccaatcgaggtagagaggaacaattgcattgcacaattcttactcctatcctaagtacacgagcaaaccataactatttacatccttgatctttctgggcactcgagtggcagctgccggcgatcaaatcgtgcggctgctgtgccggccgcctgtggcgggcaactggcagatcacgcgcgaatggcggctccggagctgacgtctactgggctgccgccgacgccgcttgcctctgctgcgcctgcgcctcgccggagcagacgagggccttcttgaggcacctctccacctggtacccgccgccgtagctcacctccctctccaggtgccggcagtagctctggaacacgctgacgctcacgttgagcctgaactgcatcaggaagaggaagtccagctccagcgagctcagttccgcggcggtcagcccgcccaccgcggcgaagtacgagttcttgtagttccggtcctcgacgaacttggaggcgacgaggatggctgtggtgagcagccgctgggcgttggccgacacgacgcgcacgccgtcgccgcggcgaagccggtccaggtacgcgtacgccacgacgtacacctgcggcgagacgttcgcgtaccgggagaaccgctccaggaacgcgtgaaggctcatgtccagcaccgtgccgctgtcgaaggcgcgcgccctcctcgcggcctcgccgtccgccgccgccgcctggtccctctcgttccgggcgatgtgccgctccagcagcgacgcgaggaccgacacgaccaccggcgtcgacagcgccgtcgtgccgtcgtcgccgcacgggagcgcgtacacatccgacgctaactcagtggacgccatctcctgaagaattcaatggcaaaagcttggttcttcacaaaacctatgctacacaagtacacagagaactcttgcaaatgcagacactttatacaccagagggaggcaagcgtgggggcaaaaagaagctattaacaatggcggaactgaacagctgaaggcgacacgaggaaggagcaaagaaacaaaagatatcggcataaaaaaactcagcacgtacacgcaaactggagctaaaacaaatcgagacacggagatgaagccttcaggcaccttccattgaggcccctgacccgatcacccgagcttatttatgatcaagcggacgacaaatgcatccaggggcagatctgattgatggctggtactgcactactgcggttgggggcggcatccgtgatcgacgaggctggatttatgagggaaaaacaagcgcgagtggcgaattatcgcgtcggtgcccggcgaacccgtacacatttaactatgcgagacttttcccgcgtacgtgctacctgctgttcaggtacggcgtcttgtgtcacggcgagacgcgtggcttgtgggcaagtgaagaacagatgcctctgatctttttagtcttgccttgccggttgataagctagtttatgatggtaatgggaacttctgttaagacgtcgaagcgaccgatggatgcaggagacgacaatggccgcggcgttgtaacaaccggttcttggagttgctggagaggagtggccctttctgccgacagatttgcactattttagtaggttggatgatcagtgggaatactgttcttgggtactcataggacagcggcatcgaggtgttgacatgaagatccagagaggatataaaaatggatctgctgatagtttttcttcatcatcagtactacttgcagaatgatgaggttaggttgcaataagctgcttcatcgaaaataattaaagttgccaaaggttaatttatttcatttgtgaggatcattttttggaaagagatgtctggttggtatatgcacgcacataaagcttgcaggaataaagcagaactttgctttgctttctgataataatgatcaaagttatcatgcccctgatcttagattttttttttgaactcctgatcttgattggatattggtatttctctcccactggacaagtagcttttgtttattattgtcaggcgtgataatgtacagcatgatctttgccaagagattccactctgggacatcgaatcaatcggccatggcttgcgacagtgctcatgcgagcggatggtaaacaaattgaggcatgtgtttactagagaatttttaaaaataaatttcatgaaactataggtgttttaactaaactatccaaaattataaatttaaggcaccatatcacaaaaccacatatttaaagtacataaaaagctatagatttaatattaaagttaacataaaattatatattttatagttgaactataaatgttatagttttgtgattaatatgatgctaaacttgtagttttaggataattttgttgctaaatctgtattttttgatacttttggtttgggataactttagtgataaatctaaagttttgtaattcaacgtcttaaaattacatttttttcgatagtttggttaatgtataccaatatatagttttgcgagatttattatttttttcattgaagcatgttttacattctgctcttcacttgcttacggtgaccaggacaaagatcatctgaacgggacagagtaatgttagagagcagagtgacagcctgggggggggggggggggggttgtcataatacgtagcagaaaccacatatataattgaaacctcaaaactaccgttagattaaaaatggacgcctaagatttgttcacgcgcacgtggacgaatcttatgtccattttattttaatccaacgataattttcaggttttcagtatataagtgatttacactatttttgcaaatagaatacgtatttatcaagtacttccttcgtccaaaaatataacaacttttagtctttagaatttgtcctaaaatataataatttcttcattaacattctcctttcaaccaatcacaacctccactattcaattttctcacatatctccacttattctccagtcagagcactcccccatttaattctaccaactttcttaataaccgtgtccaactctaaaaatgcttatattttggaatgaagggataagctagtttcaagcaagtgcatgtttggtgaatgaaattgtctggtacacaataaaaaggtttattcaccaaaacaaacaacttgtctagacgtatcagacccaaaacaaacgtattataagttaatacactaacttaagtccgtataccggtaatgcatatttactcttttacattcctcaaaaagttcatgaacgatcacatcatataaaggactaagcataataacaaaagctatggttcaacgaagatatgtaacatccatggtgtcatggtgtcatggttatggataccacatatctaatagtagttgactaaactcggcaggacccaccacatatcatgtcttatacggaaacaaacctcgtatataaaaagagttccggataaggaagaataaatagagttctatatgaaaacgggaaggactactcggattgtatccatatttatctccttaatcttacttggacaagggggcacttatgggtataaatacaagcccccctaggagaaaaggggacacgccacaaagccacaagacataacatacacataagccaagacgatggcagctatataggttatcccaaatattgtatttgtgtgatccagataaataaagagcaacactggtttcggctaacaggatgtagggttattacctgtcagataagaggcccgaacctgtataaaaattcatgtctccatctcttttatcttaatctcgcacataccctgataccaacgatccccataccatccaaataccctagtcgtgactatcaaacgtcgacacatggggatgccatctcaagcgtggagctgcaatgatgtacgattgagctgggccggagcacggaaggcacagaggtggagccgtggagggattggacgactggggccacaacggcggcgcggctgccattggagacagaaggggcggagggacggggtgctgatgtgttgggctttttctcaacttgggtcttctgggctcaagtaatagcgctgtttcggaatggagaaggcttcgtattagaatagaggaacaagtccatttgtcatccctcaactttgcaccgagtttgtatgatatccctaaccctcaataccagatatcttgatcctagtcttcaaaaccgtgcaaagttggtcccatgacggtatagatcattttcccccttttttgttgacatggcatatggaggtcccacttgtcagggtgtcgttggtgtcactgggagatgagggaaagagagaggagcacctgctgcagtcgattgaggagcccccgcggaggggctcaccggtagtctccctttccttttccaccttcaccttccttgcaccaatgccgagcaagctcaagctcagtggggctcgtcggccacgtcgccccttttccgcctccagtcccctcacatggaagctgagctgacaacctccccctctctgtctcaccgcatgtagctcatgacccgccaccttctcaacctgtcggacaacctcctccccagcgagctattccagccgccagccctcgacgggcacaaccatcgtctcaagtggtcttagtgtgcagacttgggagagggggagatgtggatgatgtgcactctccttcggcgagtggagaccgcggcggcggtcgaaggccctcgaagaaatcgtccctgatccgcctcgacctccaccccacttttctcgctgccgtggctacagcagcggctgccaccaccacatcacgcctcttccgccattcatcatcatctctgttgccgcgccgctcacctcaccatttgtccgtccctcatctccgagccgctcacctcgccatctccgtcgctgcgtcgctcagctagcctcacctggtttgggaggagaggccgagaacaaggggaagagaggaggaaggagggagagaggcagccgaacaaccccggcagctcgccggagggccagttgtccaccagtgccagctcctgcagcctcgtgctcgccggaaactggtctttgctgttgatttgtcaaacaacggcactgacgacacactgacaagtaggccccaccgtatgccacgtcaacaaaaacaatgggaaatatggtctatattttcatggaaccaatttttcacggttttgaaggtttgagggggtcagaaataatttctggtattggagattatgggtgtcatgtagactcggtgtaaacttgagggatggaaaatggacttattcttagaatgactagcgcgtgggccttccccgacttggatcgcaactactggtgtcgttgcccttatttgtggccaacgagaggtatatgtagtatccggttcggcggttgccatctcggcaaagtcagatcacggcgtatagattgacgtaagctgattcggcagagaacagaagacgtatcatgtatatatatggacgttggaaaataagaaatcgcttactgcatacgattatgccggtagctaaaacagagcaagaatagaggccgtcacacggccgggctcgtcaaaaccgagctacggttgccggttggggcaggcccgggatgtctccaaccatgtcaacgcaattatacaagtgcaaatcgcaacgcagaattcggttaagttataaccaagcaagagacgtcactagaagcagctctgcaaacggccacggagggagaacacacatcacgaacacttaacactaacagatcgaactcctcttttaccgcggctgcgcacgattcccggacgcgcacacaccgaactcacttcgacgaggcgagcttctgcctcgcgatggatctatcgcggcgacgttaacaaacacgcgcgtacgtagtcgcgcacgacgccgccgcattaggcggcgtagttcacggtggatcggtaggtcaacccggcctgccacccggaggggatgacgttgttggcgacgagcaccttgccggagcccgaggtgagccggatcgagaacggcgggctcagcggcttcccggtgttggagttgaggcgccaggtggcgccccacgactgctgcatcgccttccacccgccgccgccgcgggcctccatgatgtgcaccgcggcgaggtcgccgtcgccgttcgcgtactggaccaggatggcgaggtagtacgggttggagcccgcgtccaccttgaaggccacgttcatggcaaacctgcacggcaccctgcaggcaaaagtaaaaattcagtaaaaatctgcacttgtacattgcagagtggaccagaactccagaaataattttgcaaattcaatggcggggcacctcttatactggatcttgaggactccggcggagcggaggcggtcgcccatgccacggttggccatggcgccgaaggcggtgccgctcatgtcgaagtgcgccgcctcgttcaggcatacccctccagggcaggagtcggtgatcacgacggtcactgggcggccggagcacgcccggttgccggtgcacttaatctgtacatctaatttagttaggaatgctccacgtcccatgcatttgactggtaaaacatacaaatacactactgacttggtagcatgagccgcagcctttgccattcttgaagagggagggcccgccggcggcgatcatcgacgagaacgggcgctgcccgacggcgctctggtaaccgcacgcgccgcctgcatttggattaattaaccaacatggcaacgtgagtacttgaggtcaaatacgcacatgcatgcagttcatactaccacttgacaacgacttaattaccttcgctgccgtcgccttgcgggccgccgtaccacgtcgcgccgccggaggaccagccgtagcctctgcccagcgacatggtgctccgtctgccggcagtgtagttctgctcgtagccagagacggggagtgacagtatcggtagcgccactaggacggcaaaaacgaaagtgccccggctaaccattgctattttcttgttgggcaatcggttaggtagctgggattgttaagcggagattgctcggtgatttttaagatgatttgatttggttggtatttatagggaagattagcggtcacaaacgtggtagcaaattatgtgtacccaagcattattgaggtgaacgtggcaacttgaatttgtacatgtgttgatgtgtatgtcaactatgtgtgtgtgggatcgaagagtatacttgtggactttacggaggtccttgcatgaaggaggtgatcacgcagccgcaagggtttggataaactattctcacaaggtagttgtgttggttagaaacgctttgaaaattcgcaatttgatattcgtcttgtgtcatccgtacgtttgtcaaatggctactccataatgtgtacgacttgagcgtgagctgtacgtgcgcaacgtgcctagcaaagtagcgagtatcatgcccggccactcgaatgtttgtacatatggtacatatatagttcctttttcttttggagaaatatatatagttcttttagaggagaatgttgtatagtaacacttagtggcagcaattcaatcgaactagctgggtagcccgcgcaattagcacccatacaaaattatctattttaatatgatttattcaaaatttgttaaatagctatctcattatcttaagactttgaaagaccaaaccatatcattctcgtgtttttaattatatagtttttaaaagtcacaccaattactaccccttatgtcatcttcttctttatttgcttgctcgatctatcactatttctattcatacttcttggaacctttaaaaaatagattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaattgaacatgattatcattgttttttttactttttagaagttccgaacctttaaaaattagacttgtagtttcattttttataattttgagaagtcccatcaaacaatgccactatgcccctctacaacccgtccgccgcctactctttattgtcctcgtgattctaaaagtcgaacataactatcgttggaattcattttttattttctagaagtcccgtcgacggctctgcaactatactcttatacaccccacccgctgcttctcctttttattgtcattgagattttaaaaatcgaatatgattatcaatggggtttgtttttttactttctagaagtcccggcaaccgccttactcatttgcttcgcggcctacctgacgttcctcctttgcggcaattgtgttttattaacaatttttatatgtcgtatcaaccgccaccactctactcctttacaggcctgttacttaacttatctcgtcatgtgttttagatggtcttttctttcaataatctttatttttatcaaaaaattgagttacttatatgcaccccgcgcaccgcttctcatttttattgccattgagattttaaaaatcgaatattactatcaatggtttttttttactttctagaagtcccggcaaccgccttatttgtttgcttcacggtctgcttgacgtctctcaatttaatcgtcattaggattctatttgatattttattaacaatttttatatgtcgtatcaactatcaaccgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttttaaaaaaattagttaataccgtgttgtgttcttttaatgtttttatttttaattttcaatttcagttgtttcaacattgtattcctacttgaactctcttttaatttttctaattttggatattattttattttttatttaaaattttaattaatctcatattgggttcttatatggattcttctttcaatattgcttatttttaattccgaatttcagctaattttaaattgtattcctacttgaactcttcttttattttcttttgctaactttggatttatttttattctaaattttaattaatttcgtattgggttcttatatggactcttcttttaatattccttatttttgacttcgaatttcagctatttttaaattgtatttctacttggactctcctttccttttctaattttgtattttcttttacttttatttcgaattttgattaatctcgtattgggttcttatatggaatcttctttcaatattgctttttttaattctgaatttcagctatttttaaattgtattcctacttggactctcatttccttttctaattttagattgtattttatttttatttcaaattttggttaatctcgtattgggttcttatatggaaacttctttcaatattgcttatttttatttccgaatttcagctatttttagattatacttctacttagactctccttttctttgttttctttttctccgattaatgtgggaatttttagcccctacagcgaacgtggtgccttcttttcgagctgtcttaataatataactagctgggtggcccgcacaattgcgcggctagcacccaaacaaaatcatatatttttttaagtatgattttacttaaaatttattaaatatctatctcattgtcttaagaatttgaaagaccaaaccttatcatcatcgtgtttctaataatatagtttttaaaagtcacactagttgctaccccttatgtctcagcttcttctttatttgattgctcgatctaccactatttctattcattcttattggaacctttaaaaattggattttatagtttttagagtttattgtcacgttgggtttcatttttataatttctagatgtcccgtcaaacgttgctattatactcctctacgacacgtctactgtcttatctctttattgtcattgagaatttaaaaatcgaacgtaattatcgttttaagttcatttttactttttaaaagtcccgccaaaccgttagcggctttgccattgtaatcctctacggctcgcccgctgcctcccttctttatttcattttgattttaaaatcgaacatgattatcattggtttttttacttttcagaagttccgaacctttaaaaattgaacttgtagttttatttttaataatttttagaagtgccaccaaacgatgtcactgtgtccctgatctacagcccgtctgtcacctactctttattgtcattgtgattctaaaaattatttttttttactttctagaagtcccggcaaccgtcttattcgtttgcttcacggcctccctgacgtctctccttttaatcgtcattagaactctatttggtgttttattaacaatttttatatgtcatatcaaccgccaccactctactcctttatagtcatgttacttaatatatctcgtcatatattttagatggtcttttattttaataatctttatttttatcaaaaaatttagttatttataaattgtattcctaattgaaatcttatttttcttgttctaattttagaattttttttaaaaaaaattatttaataccgtattgtgttattttaatgtttttattttttattttcattttcagttgtttcaaaattgtattgctacttgaactctcttttattgttttctaactttggatattattttttttattctaaattttattgcttcacggcctccctgacgtctctccttttaatcgtcattaggattctatttggtgttttattaacaatttttatatgtcatatcaaccgccaccactctactcctttataggcatgttacttaatatatctcgtcatgtgctttagatggtcttttattttaataatctttatttttatcaaaaaatttagttatttataaattgtattcctaattgaaatcttatttttatttttctaattttagaaaaaaatttaaaaaaaatgtttaatactgtattgtgttattttaatgtttttattttttattttcaatttcagttgtttcaaaattgtattgctacttgaactctcttttattgttttctaactttggatattattttattttttattctaaattttaattaatctcatattgggttcttatatggattcttttttcagtatgcttatttttaattccgaatttcagctaattttaaattgtattcctacttgaactcttcttttattttctttttctaattttatatttatttatttttattccgaattttaattaacctcgtattgggtttttatatggacttttcttttaatatttcttatttttaattccgaatttcagctatttttaaattgtattcctacttggactcttatttgcttttctaattttggattttattttatttttattttgaattttgattaatctcgtattaggttcttatatggaaacttctttcaatattgcttatttttaatttcgaatttcagctatttttaaattttatttctatttggactctcctttccttttctaattttggattttattttatttttatttcgaattttgattaatcacatattgggttcctatatggactcctctttccatattgcatatttttaattctgaatttcagctatttttaattgtatttctactttgactcttcttttctttttctccgattaatgtaggattttctagcccccacagcgaacgtggtgtcttcgtttcgagctgtcttaataataatagatagatagatagatagatagatagataatagatagatgatgagggctgtatgatagtataagttattttccgacaaggaaatgggccgtttaccgcgagaagttggtgtgggcccggctgcaggcccaatccccccgaatctcgcgccgcgtagtgagctgagagcgttgctgttcccctcgacacagaccgtcacgccggcacgcacgtaatcctcctctacaccaaccgaatcgttgccgcgcacccacgcacgcacgcacgcaatcggcaatccccacgagaaattccccggagcgatcgctaaacgtgcggtgcacataggcagggagggtgacgaaacgggcgtgtggtctcatcttaacgtattggatattttgggtcgcggaatcgctggaatctcccgtgcaacgcgccgttgatagcgaagctcctgctccaaccgcgcgggcgggcaggcggacgtgggaggcaacgctgttcgcctgttcgggccgaggagatcatcatgcagtgatcagacgacggctgatcgcgcaggggggcgcacgtcgtcccgtgaaaacaacagccgcgcccgcgcgtctctatctgggcatatcacatcgtcttccaccgatgggctcttcttctcctacgccgccgatcatgtagtcgacgccacggtgggggtggtgtgtgtgtggtggtggtggttgggggggtggggggtggacaaaggcaaatcatgtttgttggcagcgttgccgtcggcgagattagcggaaagttgttgtgatagcaggccggttgacgtagatagagagcggcctaggcccaacacaaatttgctgcgctttgggaggagcgaattgggctctcgtcctatacgggctggaatcaactatcccagcccaccttggataatccgaattgttggaagcttcggcctaaggaataagttcatctaaggtcccttaatttacaccgaatccaattttcatcctttaaccccaaaaccagatataatttgtccatgactgtcaaaaccggtgcaaataagctccctcggcggtttggaaagcggtttttgctgacatggtgcctacgtggctggtttgactaggtcttcatcccacgtggcgctgacgtggcaattatatcttaaaaaaaataaaaaaacggtgggcccacatgtcagctacacacaaaaaaataactacaaaatggtggggcccacgtagaccccacatgtcatcctcacttctcccttcttcctctcccctctcatttcttcctctgcgccggctgcatcagggacgcgttcgacgctgccatgaacaggacgaacaggccgctctgcgagctccgcaagaacgtcatgctctactacgactgcttccagctcctgttctccgacgtggactttgtctccgggtacggcaacaagccggagtagccgctgaacaacaccaacgtggtggacaccttcatcgccggcaggttccgggagcacgtcgcggtgctgttgaacgctaccgtgcacgatggtgtacgctttggtgcagtgcacccgcgacatgaattttattttatttttttcaaatgttcaccatatcctgattaatttgtttctcttgcttggttgctgcatgattttggtcgtggtgcagaacaatcgggttctgatgtcccctccggcgttgtcctccacctcggcgtcgccctccgctctcggctccaggaggccgttggtgatggggaagcgacgacgccggctttggtgaagcaacaggacaacacgagctcgtggctcgccacggctttagctccttcgttcctcttcccctttcctatacgcgcgtgccccggggggagtcaggcgcggggacggcggcggctccgggacacggagcagaggggcgccgcggcgggcgagcggagtcgtcaacgcccgcctcccccgcagcagcgtccggcgccggccgaacctgtccctcctggccgaccgttgcacgaccccgcgtgagctcgccgtcgtccacgccgccatgctcgtctccggccgcctcgccgacgacgccttcgcggcgacccgccttctcgccgcctacgccgtgctctccccttccgacgccgtgctccgcctcttcgccacgagccacgagcggcggccggaattccatgcgaagcgccgtcgcaacaagctctgccgcctcgtgctggctgttgcgtcggtgtagaggcggcgcaggggaaggaggatggaggcggtggtccggcgagggaggagcctggcaactgaggcggcggcggcggcggcggcggcgaggttgccgaggtcgccgcctcgcagcctcgctcgcctacgggaagaagatgaagaaaagggagagggaagaaagggggtgtgaggatgacatgtgggcccacggattttattatttttctgagatataattgccacgtctacgtcgcgtcagcgccatgtcaatgtcacgtgagacggagacctagtcaaaccatccacgtaggcgccatgtcagccaaaaccgccttctaaaccaccgagggacctcgtttaccccggttttaacagttcagggaccgtttgtatttggttttggggtttaaggacgaaaatcggattcggtgtaaaattaagggaccttagatgaacttattcctcggcttaaacccaaaactgcccccatactttccaaagcctgggcaccgaatggtatgggaccattttaggtacactctaccaaactggtgtctagtggggatgtccactcgctgtttgcatgtcattcaaataattataaaaaattaaaaagattataaagatatattaacatgtgttatatgatatatcactctataaacatgcaagtttaaattcaacctacacatctcgtaacaaaaaaataaatttaactttgaatatgcgttactagttgtagtttaatttatttttttttgttgcgagatgtataagttgaatttgaacttgcatatttgtgaagtgatataacacatgttaatatatctttttattttttaatttttttcataatcatttaagtgacatgtaaataaggagggataaaatagtttcatggtgcatgccgagagacatgtatgcacagtcaagacacaacaacacaatgcgaatatgttcatatatagcacgtttataagcactggtcggctctgttctgatacaaataatacacacagtaaacacgtataacgataatcattgacacgtactgcggcgaggaggggagaactagtaaatcatctgcgcctccgcctctgcatctcgccgttattaatttcacacttacgacaaacctgtagccctgtagcacacatcgttgttgcaccaacgaataaccgatctaacatatgcctgcagactgcagacacatgcatgcagcaagcatgcaagttgagatattgcttgcgatcgttagaagttcaccgtcgatatgtacgacatgccgggcttccacccggaagggatgacgttgctggcgacgagcgtcttgccggagctggacgtgaggcggatggagaacggcgcctgcagtgccgagccggcgttcagcttccagacggcgccccacgactgctgcatctgcgtccaggcggcgccggcgccggtctgcatgagctccacgccggagaggtcaccgtctccgttctcgtacttgacgagcacggcgaagtagttggggttcgagccgacgtccacgacgaaggtgagcttcactccgccccagttgcacggcacgctgtacacacatcacgtgcgttcgatcggatcgtttgaaagaaaccaacacgagaagaagaattgaaggacagttgcatgcatggaggttatagctgaagcagtgcatgtgccccggtggccggtggtccatgcgtggtgataagaaaagatgagtgaagccgtgataactgcaagtgttctgctgcttggccgacttttggccattgctgctgcagcaatttttgcacggaagtgaaagatgctcgcttaccggttgtactggatttggaggacgccggccgcgcgcagctggtcggcctggccggggttcgccatggcaccgaacgccgtgccgctcaggtcgaagtggaccggctcgctgaggcacgggcctccggggcactcgtcggtgaggacgacagtcaccgggttgcccgagcaagcgctatttccagtgcatttcacctgaaaaattatattgttgatttccaatgttagatgcaatacaggcatatactccctccttccctaaatacgccgttgacttttttaaatatgtttgaccgttcgtcttattcaaaaacttttgtgaaatgtgtaaaactatatgtatacgtaaaagtatacttaacaataaatcaaatgataggaaaagaattaataattacttaaattttttgaataagacgaacggtcaaatattttttaaaaagtcaacagcgtcaaacatcttgggacggagggagtacatgtatgtgcacagacttaattatactagatatatattctgatctgtcggtatatatgtacctggtagcaagagccgcagcccaagccagacttgtagatggaaggactgccggcggcgatcatagacgagaacggtgcctggaagacggcaccctggtacccacatgcaccacctgtacacacagatattgcactgttaagacatgacatacataggcatgaattttcttttcgaagaaactctcatctgatgacaacgtatttaccatcacttccggcgccatttgcagcgccataccacgtagctccgccattggaccagctggagagcttgcggtggaactcgatggaagcgcaagggcgtggaagcatggtgacagcggcaatgacaacgaaggtcgacaaaatcagctggaacctggaagccatggctgctatacctgcttagctaaacttgctaggattgttgttgctttgcaaggatttggaagatgcaagcaaatgagtcgatgagaggtggtgtgggctgtgtgtgaggtagctagggaaaggaggtgatctatttataggcagcagacgatgggtttgtgtgggcatatccctccgtgcatgcatgcgtatgcagacaaatcgctctgcttgcttgctctgttggatagttccatatccatgctaatgcacatggctagggtcaacatgtttaagtacagtcgaaaagtaattagctatttacgtagtagtaggccggtccttttgtgtgtagttcacttgtccaatcctcaattcgatcggtatcgggaccatggcagttttaccggtattattactagctttcagtttctgcctgcctggctagatctggcaagctagtgaatgaagccataccatttggctggagcccatctttggttaacaaactcgtgaatgtagcatacatgctatgtgtcattgcaccctgaacctccagggcggcatgcatgagagaaaggtgctaatacaattaatgtgcatagcttgtgttaatctgcaacagagggtaactgtacatgattataatttgtgcataacattgtcaataacttgctggacgacgacgcttacgtttgcgaatcctgcctactactattggcaaaatggaaagtcaaaagtgcacaggagattggccgttatttcggttgatcactgcacgcccgcacgcccgcgcgcgtgatgcgatggtgaccgcttaagcttgcgcatcccgagacgtctcccctagcctcgctctcaccacaccagcttcattcttcctcctcccgggtcaaccgatcgaccgtttcatccccggccgcatccccaaatccgccaatctcgtccccgtcaactctcctgacgagcgagcgcaccgtcggctcccgcgagcaaacaccgggattcggggcagctttgccgggccatggcctcccgggctacggctctctacatcagcgagaattaggcggtcgtacgtacgccatcggcggccaacatgtgcgcttggccggcgggagggcgggcgagctccgggtgccacgcgtgaatgtaggtaggctgcacacagtcgatcggttggtggcaacgacttggcgttggcgatcgatgtgcaatgcatatgcatgaaagtgtgtgggatgacgaaaggcacggttgcatgtaacttgcacgagtcgtcgtgcagtgttaactgcgggggatagctgttttgagtactgtggtcgcgtcaaaaatcgatggagtgcccgggtggctaattttgtccgccttgatttctgccattaacccgaggatcccgccatcccggtgaatctgcacggcacgtatggcatgacgtaatcacaggtgtgaaccggcctgctctgaagggccttccattctagcccattaacatttaacctccccaggccgaaacaggagctttggggcctaagcctaccaggggtttttccgtactggcttcactgcgtttccagcatatccattggctggaggtaattttggttttacttccagctggtaaatgtagcaaacgcagcacagtagagttcacagacatgctgcctcactctcaaaataaaccaatctaaaattgaaaaattgaatgtgacataaactcatataaatgttatatctagataggactttattcagatttatttcgtcaaatcataccctagattcgcttatttcggaattaagggagatcacaacatgaaccaacgcagcatgaattccatgtgaaattagtcctcattttgaaaacatagtatctttaccgcaacagtctgcaagaggtcctcgttttaaaaacagagcagctttgcccgcaacagtcttagagagtaaaccgtgacggtcgttccaaaatagcattaaacacaatacggatacacattctcccggaactccttggtacaatatcctaagtgaatgtctaattaaagacaaacaaaaaacttacaaacattctaggggtctatcacaaccatcacacatagcagatcactcgtgatcacaaaaatgagtgtcaatgcttgttactcttcgttcccgctctcttccttcgtaagtttgatcatgtcatcaatcctcaggatagtaatggccgcctcagtggcaaactgcaagggaaaaaaaaaggaaatggcgtaagggcctcagatttcagtcaaacatcatgataagacctatgctaagtataccaacctgaataatctttactttactcattgctggctcaatgacaccatattcaaggttgttgcgaatgataccttttgaaaggtcaagacccatgctgcagcaaacagaagtgaatttactggttactctattgataaattacacacattcaggaacacattaacttcttccttttaatagatggctgactaacattaactatatgtttaatgccaagtatcgcgaaaactacagatttaataataaaattatcacaaaacaacagattttggggttcaaatcattagcactaatggtatgtttgagttatcaacgtccaagttttgtgattaaattgacattaaacctgtagttttggggtaattttattattaaatctgtagttttgcaatacttggcatcagacatatagttttgtgataaatttattgttaaatatatagttttgtgatacatcacctaaatctgtagttttgcgataatttgctcaagtatttgtagctttgtgaaatttactctataacataatatctctagaattgtcccaaaagttcatcaaaaaagaatttggagagcttttcaaagatctagaacatactatatgtacaagataaaagaaccacatcttattcagataacaacgaagacatgttctgtaattaccttgaaaagtgttgcttatcagcctttgtttgagcagtatgatgatatgccctaagctttgctacaagctcagttgcatcttttgcagcattgacagaaagaacctgacatcacaaggtcacacttcacattaatattttatgtcatccagtatgtaaacacatagaacacaagtgatcaaacctttggaatgattaacaaagattccgcgaattcagcaatggccaactgttccctggacccaagggttgtagcaagattctccaagtatacagacaatgcagcttcaactgcaccaccaccagcaacaacctgcatgatacatacatgtttaaagcgccaccaaagttacaatgccagaactacattcacggctaatatgaagtatacactgccaacattgttctgtggatggaatgcaggcataaatgactgaaacaagtgacaacacagatagaattgcaccaagtggctcagttgtgaaaattttaactgctttggttgatttggtttgcaaaagcatggaagctatcctctgaagaaatgtaatggcaaacatggtcatttggcattgtacagcataagcaattgacaaaagaataatgatggggcactaaatacaactaatcaacatgttagtgtctaatcaaaggtctcacgtggtaacaggacaacagtagtgctcaaatgaaaaaaaaagacatttttttcttactctcccaaaaatcttaatataacagtgaactttatatattcaactgcagggaaccaacatgttaaggaacagaagcaaaaggttataccatattggattccagagttctcttcacaatgcacaatgcatcatgcaatgatctgtcaatctcatctagcatgaagtcatttgcgcctctaagtataattgagacctgcataaaagaaatgcaggcgtgattcccctaaactcttgctggttttgttatacaaaatataagatttgcattggaattgaaaagtacatacagcgctggtgttctttgttcctttcaccaaaattacatcatcatcagcaattctttcctcaacaacttcatcagcatgtccaaggaacgatgaatcgaatgtctcttcaccttccatatcagcaaatgtagatacctgcaatttactaccaaattaggacagcaccaaacagtttgtgtagcattaatattaggactagaagcaacaaacttaagactaaaattacagtggtatcgcaagggaagttgcttcatcatttattaattctattagtcatctgcacaattatgtattccaatgttgttacaactcgataaacaaaaggtgaggcataccatagttgcaccagtagccttggcaacatggcgcaaatcctccttacgcacacgccttacagcaattgctccagcctcaacgaagtactgaaatgatattccattgaacagtcataaagcagatttaaagacagtagccaggaatcatcaacatcatacatatacaaagattaacacacaaacaccacatgaaccaagtagctctttcaaaataatcaaaaccaattcaataatgaaacagctctcttcagagtaaaaagaagtctaactaaaattatgaaacagaagctcagtttggacgaccaaaaagattcaatgatgaaagaagtttcctgaggaaattgataatgaataccccacaaacacccacgctcaatcaacatcaacacaataccgtccatgtactagtattcaatcaataacagagctcttaccagtccaaccgaagtcaatagattatatttaggtaataaaagaatgtttctacttgaataaaacataccttcagtgacatatcatcaattcccttagtggtcagtacaacattagcaccagccttcagaattttctcaattcgctcctttgttatgtcagattctctgccatgaaaagtaagattatgttttacaattggagaccataaattataatagaattatgtgtggatccaaccacattccacaaaacaatagaaataaaaaaacacaataaaaatataaaaaaaataaaatgtgcaaatcagataaaagagaacaccccaattgttgactcattaagtatacaaaacaaatgaatcagaatgcgttggaaaaagtaaatgcacatacctctgacgaattttctcaagttcccttggatcagttacaaggacttgaacacccaattgcatttttgtcttctgaaggttaaaatcaagacatgcaattcttgccggggttactctagtaggcattccttgagctgcacggcctgtgtttagtgcatacccattcagcaggtaactgtccttggcacttttaccatgggctttcaaaatattaatgctctgcagatcagatgagctatagttaccagcaaatttctgtcgattttgttaatataaaaatcaaaaaatggttattgcgaagtacttttagagaaataacttgaatgccatgtccatacatgaatggttattggttaacaagaaagtcaatgacataacagcatataattaaggtagaagttaaactttattagctctcaaggtgtccaatatgttatacataaccaggagaaaagaacaaaggtcacatgtagcaaagctcacaaacaagtgtaatactctacaatttccaaacaataatagaggctacagaaagagaacaatcagtgaagcacaagtgcacaattcaatatatctcattcagtgtattgcaattgcacacaacaaagttttgctttgatgtataacaagaatcacaagcatgtaactcaccttgataggatacttcacttctcccttagcgtttgtggtcttcacagcttggactgcatcgacaacctattaaacaacagccatgttaattatacagcacagtttgaaggaaagcttacagaaagtgaattaaagcactagcatttggctacggatatgcctaactgtcagatagagacttaacagtgaagcattatagcatgctacgacattggaaagaaataaattggactgcctatatatacagatatagagtatcaactaaatatttatttaaatttaaaaagtatcactaaaatcaaacttacagctgaaaatacaaatgtatatatatggcaataggaacttaccagatttgcgaagaaatcactgtcactattaatcagcttcgaggacatgcttgtcttcgcacagtttataagagaatcctttccaagtttatcaacctgaaaatgttgatagatactagtgtcaggtgtcaagaagtaatctgctgctattcattaagcagatagtattctcttaccttgacagccaacttttcttcaacatatttgcaagcttcacgcatagcaagctggtagtaaatgatggtaaaacatgttaagcaatgtgggtttgcagctggaacattcgttttaaatctgaaattgtactgcagctgaattatgaagtgcaaaactcaccctgtagccactgataatagatgtcggatggattttgtttctcacaagatcattgccccgctggtaaaaagaaaaaaagagtgtcataaatgcatatttagaatggtaggcaaatacatagggaagaaaagactgacacgaaagctccatttcattacctttagcaattctgcggctattatcacaacagatgtcgttccatctcccacctctctgtcttgaagctcagccaactcaacaagaacctaacaataacaggaccaaaaaacaactaagcacaaaacaacaaccaggggaaaaaggagatggcacctttaagctgcctgacatcaccttggctgctggatgctcgacttccaacatcctcaaaatggttgctccatcatttgttatggtaacatcaccaatatcatccacaagcatctacaagaaggatatgctcaattagctcattccagccaaccttttggaattatcagggattggtgtggtgcagaactgatctaagtctaacttcattaatcctgattaggtttagtgatactgatgcacatactgttgtaatttcatgatttcataaaaagtttagtgatactgacagttatttcgagcacataacaacattagccgcacacatattacaccgttgaatcagtaagcgactgaactacatctggatcacaatgagcagctcataaaggagaaaatacgtcattctaagtagcggatcacacaattttgaaacctacaagttcgcatccttcacacacagtaacaatttatgcgcaaccaagtagatcaaatcgcaaggtacaaaccttgtcgagccccacgggcccaagcgaggacttaacgatgttggccaccgcctggcacgccaccactgcaatcagagaaggaaatcaaatccccgcgtccggacggcgagtcgtgccactagatcttacaaaaacccgccgcgactccacggaatctggcggcggggaagggcttgcaggagggggagagacgagttaccgttttgcgtgcggacgtcctggccggactggcgctcgccgaggatgtcgggggtctgggcggtgatcgccatggcgacgacgacggcggcggcggcgaggcgaaaactgtggaggcagcactggagagttcgaggcgggggtcggcgtctgcaatggggggttttgctggaggagccgcgggggttagggttcgatgcggttgtgaaatggaccttggacttgatgggccttgatgagcccagcccattataccggcccaaactcctcacgaaggcaacgcgagctcgcctccccttccccccgtcaccgccaccacccaaaccaaatcctcgcccatggcgccactagtctcccacgcgaaaattctcgcgccgattccgaggggcaaccgccgcctcgcccccgcgccccctgccgccggcggcttcctccgcgccctcttcccctcacggcgctcccgccctccgccagagaaggacgagctcctccgcctcatcgccgaccaacgccgcggcctcgacacccagtccgacccctcccgcctcgccgacatcgtctcctgcatcgacgccctcgccgccgctgctcccggatccgataccgtttccgatgccgacaagctttccggtacgtggcggctcctctggaccaccgagcatgagcagctcttcatcgtgcgcaacgcccccttcttccgcaccgccgccggtgatgtgttccaggtaatcgacgtccccggtggcgccctcaacaacgtgatcaccttcccgccctctggcgcgttcgtcgtgaacggctccatcgagatccagccgccccagcgagtcaattttaggcaggcttcctccagctttttgtttaggcttaacataatcatctgttctttccaaaaagaagacatcatcgtctgttgtttcatcagcttgtggtaattagagcaactgctgattgttttattttatgtttgcttgttgcaggtttacacgcgctatgttgagagggagcaattgggaggtcccgtttccgccctttgggaaaggatggtgagtggaagatattcttcaattggtagtatcatgcacttcactcgaataatcttacaagttgagttccaatgaaatagcaaaaacaaaggagacagaaaaaaatgtggaagcatagcacgagatattgtgcattgtttgcaacaattttcaaggaatgaaatcgtatctagcattcatggattgatattgtgttcacgtaatcgtaaaccatttcattaaatcaaatacattactctcgcagtcataattattttaggtaagataagaattggtcaaacttttaaaattttgaccataaattattggtcaaatgcttagtttaaaagccaaaaaaggggtatacttagatttgactcaaaaatatatatatcataaatttattctaatctaaaattaatcatccgagttttaaaagtttaaccgaatcttgtcctaagtgtcaaatatgtatgaccagaaatagtttttggaactgtgctgcataatcaacaatttataagtctaacaaacttttcatttttgttactagatgaccaaatcatcatctacaagggctttcctttcccacctccatttttagggatggtgtatatgttttcttcacctgatcagtagagagtgaatgtaaataaagctggactggaaacacatttttaccagttaggtctttgacatttgttcagtttatcagttctgtttcgttttatcagtttctggtttgacaccatctatttggaaatttggcttgtatgtgttaggtcttttgacatttacataatatatgcctctactttcaggtttgacactgtctatttggatgatgacatccgcgtagcaaaggacatacgaggggactatttagttgttgaacgcgctccatattcatggaatggatagttgttaaaattcaaagttgattgaatgcatagccagtcttgtgatgtgccttgtgaatataagaagcagattgtcagagccttgtgctttctcagcaaagtgttaaccatcgtgctatgacatttcttttcctagacaatactatgttctcccggaattagatggtaagtttgattagtaatgcatgtgcagcaaggttcttcttccaaggaattgtctaggttaaataatacctaggtatcccctatgtgagagaacacaaacttgccaagtatttgatgtgcttttggacatatgaaaaagatgctgcccattacggtgaactacgttagcgaacttgacagcatattgttatggcccacgatatcaagagccatgatggaattgttgactgtttcagtaccttttgttagtattgttttgcctgttgcttccagctttaagtagtagtttttcacattgaagcaagttctcagcaaatcaggtcaatgaatgccatcatctgattaagatagtaaactatgtatggtcttgctttatctgtatcagggttccttttccttttatactcatgaggagtcaatgagatcaaatccaactttgctttgggaaaagtagcattgtagtgtcgcaagcttaatgatatgaaacattagattcagtttctgtaaccacttacccatgatttctaattctaggggtttcagatacagtgttatgtttcattccatctatcaattgaccactgaagatcagatcaactttttgcagggatcggactctatccttctactgcccccttggaatgctggcaggatttgtagtgcaatgagaagagaattcaatttgccatgtctgaattttcctggttatttttgtttgctcgtttctttatctaggaaaaattctgctcaatacctggtttaatttttgctgcatcgtcaatgctccctgtcatttaagaaaagtaagtgaaaaggtatctatgtgatagattgattgaacatcactacttctccatgatattccaggcctgaacagaagcactgaagcaaaatacttttgaaatgctttcgttggtcctactgttgaactgaatagcaagttctcctttcaacagcttgtttcaagtgtctagtctgataattgcttccttgtactagactactgcaggttctagtcgcagtcgaacaacatatggtgaggctttaggaggacaggttggaccatggccctgggccagactacattgtgtgatgttgggcagtttgtgtacgctacgtgtgaactcatcagctcatcacgaaccagcatagaattatttttcttagtttgcttttgtttgtttggataccatttccttcaccttgagatatttggttaaggtggattgaacttagtaatgaagcaattcttttgtaatagcaggccctccctgaccaagtactggagccacttcaaaggatagaaggcaaaggctccccatgtgaaaaaggacgctccatgaccctgccatgtgtggtcatctgcgatttggtgtcccatggacagtgatgcactgattccacccttcgagtcttaaaagcaatccaaggttagtttacataccttttgcagcttagaaatactgaggataaaacgaagatagtatatcgtacacactgctggtctatagatgatctgctggtggccacaaacctttgcgtgacacttaatttggtggagtagtattttgatcttactggtatccttatatatatttctgaataaactagtatacaatggacaaagtcagttgatgtttccaaagaaaagcttgtgccgacatcaattaatcattttaaagttgcaaaaggagctataatgcttgagcatatctggaaaagtatgattaaagtatgcatccatacaaatcaaccacaatatattcaagattgaggatatttgaacaacatttgtagcttgtgcatgtttaacgggagcagaattattagtttctcttttttttaaaaaaaaccgaaggtagccatttgaatatattaaagagaaaagctaaaaaacaaagtgcatgcccaagcaccacacgctaaccacacaagcataaaccactgagagtttagagcctaacaccaaaacgatccccactaaacgtgaccaacaacaccaaaacaagaccggcttcactccacctcctcatgccgaggtggttttcgccgagctctttggcctcgcagccaccttcccatcttgccgctagcttaccatcggcatgctccagcggcggcgaggtggaagaggggtggagatgtggcggcacgggtggctagaatttcgccccgagccgcccacgcgaggacgacacaggggagggagtagtagattgctagcagcaaccattttttcttttttatattagttctttaggaatgtgagcaggattattagtttttctgtttttagatgaggatcattactcgtttttcaggaacgtgttcacagcttttctttcttttctttttctttattttttttgcatgcaatacggatatgttcgtcagagcgaatggtgtcatcctataatccgtgctgcaaattcaatgatccagttactctagagacggaaggcacgcgtcatagtatcatactccgtactttgtttacactgtctctatactctgatagacgaaaggcacacagcacactggcatatcgttatcctctgtcagtatagtacagtaaagcaacagccgttcggcactgcaaatctactactatcgtaggagtatactgtatgtggattggatagatgtacataatgagatggaacggctttgcgttttgcagccgcccggatggtagccagcagtccagcaccaagagctccaagacacggcggaccgagccagccggagggaggggatgattgagacagcggcctctgcggcgacgacagtggatcgtgagcagatttatcctgccacgagataagtacattgtactgctgactccgtttcaaaatatagctatttttagcataatactttgttctaaaataaagctatttcttcatctacgttctcaatcaatcacaaccattcttttgcatctaccttttcttttcaatcaatcgcacactttctctaatcattatccctaattttttaatacccgtactaacttaaaaatatttatattttaggatagaggaaatagtagcagataggtgcggctgctgcatgctatgctgtgcacccctacgcaaatgcgtctctccaatgatccatctatccgcatccgtctccatccgcggcggcgactgggggagcatggcgtggcacggcaagggggccggccgaccggcgtggctgtcgtaccccccaagaaagggaaataaaatccaaactggcagcggcagcagcagcggcaggatcggatcggagcggccatccatctatcgtcgccacgctcgctgagtcaggtccgtgatgatatgatatgatcgggcccccggcccggggtctctccgccctttttctttccttccttttctctatgctgtttattgtgggaactggccagcggcagccgcagtggtggtcctggtacttgcgcacgtacagccactagctttccctgcagcagccacccactgcacctgctgctctctctctcttcccctctccctgcccatgtccatcccgctttgggctaccatctccccgcttttccatcgccacaatcatgaccgcacgtagccacctaattacgccttggatcacctccaaattaatcgcccttaatgtgctctctttttcaatgacttagggggtctgttcactttgatgttaaaaaaaaccttaccaaatattagcatagttgccacagaattttttatatagttattaaaatttggcagcaaactaaatgtagccacttttttagcaactttaccaaaacttgttaaggttgaaaatagcatcaaagtgaacaggacttttgatactctgatacgctacggctggtggctctcgtaagctggatggccccagctttaattagatcgagacgagtaaaccggttagagtatgttcttatcaggttatctgctaaacaggtttcaattctgaagtatcgtacgagaagttggagatctctaattagctagctactactccttccataaaaaaacaaatttgaagggatataacataacttaatagtgcaatgaacatctagattggttttttagataaaagagtagctaagaacctaattaatctgaaacaggagtagctccccgtttttaggcacacgggaccatgatatcctcccctgtctaggacgtcgacgtggttcaagacgaggatcgatcaatagtacacccgtcaataatgtcatgtacgtacggcttatgcctactccctctgtccaaaaaaagaaaaatcctaggtttccgtgcacaacgtttgaccatacgtcttatttgaaaaaattataaaaaaaattaaaaagacaagtcacgcataaagtattaatcatgttttatcatctaacaacaatggaaatactaattataaaaaagtttcatataagacgaacagtcaaacgtacggaaatcaagggtttgtcttttttttggatggagggagtacgttaagtaagcactcacgcaggccggcaagtacctactccctctatccttaaaaaaaaccaacctcgtacttggatgggactcgtctaaaaaatctagtacgatgttggcttttttggacgaagagagtacgtataacataacagtgactcgcccatacttgttttgtcatagtacatgagatatacctcgtttatttacacattatttaaatattttttaaaaagaaaatgtattgatatgtaacattaccatacatgttacaatttaacttctatatgtaaaaataaatagattgtagctaattaacgcatattcagtcaaatttgtttttttattacaacatgtagaaattaaatttaatcttacatatttgtggagtgatttatcacactaatttatcttattagaaaataaaataaatttgtaactgctccatccgtctcaaaataaatcaacttatggaatttaaactttatcccaaaataaattaacttctaccttcttatttactttggttcacaatgaaataagagaatttcttccatacccctgaaattttagccgatcccttctattttcctgaattttcttcactcccttgtatacctctgaattttgatttggatccctttcatacccttgttgtcagttgaccgtttaataagtatcaaaaagtcagttttacccttcaatacgtgaggaatatgtagaaatttgtaaactatattgttgcaagtatagaaatttgttgtgtgattataatatttgtaagtttgttgtacatagaaattttaataaatattaaaaaagtatgtgtaccattttctttaaatgataaacatagttttggaaaacattcctatatattatataggacatgaaaaaacacgttgaactaccataaaaaaaggatacatatactcttttaataagtaaataaatattaggtttttatgtcattatcttaaattaaactttgccattaataagttgcatattactccctctatccataaacttacacctatttcatatttgagtttttccaaataagttgtttctatttgtagtctttatgcattcaagacttaaatgaagatataaataaaatgctttattagaacccaatgagtcatctaaatactcattagttgcatacttacattcacttcttgattttgtaacatccaaggtgatttaatttctccttggtcttggtgtcaaaagtaatatgtgtaacttttgtggatggagggagtatgatagtttgttcaatgataaacctactagtaacatcaattttatctgattgatctttttagggcccctttcaatcaaatgaattatgaaggaatttcatagaattgaaaccctatagaaaattttcctatgtaacctttgattcaaaggattaaagttttctaaaacgtacaaaatttctatggaatggcttatttcatatagtttttggagaaaacttagcaagaggtccaacctcttggtaagaatcctttgagtctatctcatccgattcttgtgttttttatatggtccaatcaaacgatgattcatgcatgtgtttttcctgtgttttgcaatcatctgttttatatttacattcatgttagaattctatatgttttctatttcttcgtttttttattctcatgattcgaagggacctttaatatttttgatattaaaagttaaaaatgtttgggactgagggagtaaagctaatggagtactcctaccttgtagcaaacggcgttgctgaggccatcaggccaatcgtctggctggccgaccacgatctacactgccctagaagttagccctgtcagtggagtagtactggtagttaggccgcgcgcgtgggtcgccaattcaccctctctatagctacaggtgcgttacaggtgcatcgccggccgtgcagtgcaggctgcatccatgcatcgtacacctcgtggcgttcgcgtggcgtgcatgtgatgagctcgagctgcgctaacgagctttccagagcaaagcgacgcgcgcggccggccggggctgcgcaggaaaaccccgaacctccatcagctgattctctgagcgtaaacctggagctacctggtagtagtagtattacgaatttaattacgatacaccgtcgcacgtcgctcacagccggcgcacacagctaaccagccagtacataccagcggatagatcaggcgaacggcatatactacgtgccttctgtatagtgttcacgctgtgtttagatttaggggtaaaaatttttatcgtgtaatattggatttgaagtattaaacgcactctaataacaaagaaattatagaatccacctataaactatgagatgaatttattaagcataattaatctgccattagtaagtgtttactatagtgctatattgttaaatcatggagtaattaggcttaaaagattcatattacaatttacacataatctgtataattagtttttttttctatatttaatattttatatatgtgtctaaacattcgatgtgatatgtgaaaaaacttatcaagagatctaaacatgcccataccttagtatatgcgcccacagaaaaaggcaaaggggaattaattagtacttgaatacttgatctctagatatatgtatgcatgattctgcgtcgaatcgtggttaccgaaaagatatgatcgagagctaggagttaactccatatagtagttaattatgttagctaagagctaggagtactcgtacctttctgatctccttggaatgtctttttctcgatgaccttacgtgaaagcgtaacgcgatcgagaaccgactcagccgagactcatcgttgcgcacgtacacgcgcgcgggggtggacggccggcgtgcacggttccgctgacacagacctgcacaggcgggcaaacataattagatcgagtagcccatgcatgttgattataccagtaagtttcacgcacgcacaccggtccattgatttctcgccgcgcttaatttgtcctccgatcctctcctggtctcgggtctccggaagttgaaattaaagcttcttcgatcgcgtgcgccgattgattcggattaccaaacttcccagagattttagcgatcgaatccctgctttgagatcgacgtgtactctccctccctggtcactggatttaaggttgtcgcgtgccccctccccctgcgacgactgcgagcctctccttcccttccaccttttttcttcctctcttcgcatgcacgcacgtacacactcacatccccccttttctctctccagatatctctctcatactatttaataaccggactcgtagtccctacctttccatgattccatctcctccattcccatccgcccgcatctccactcctcctctccccacctcctcatcaagctagctaagctagctctcccaaccatggctggcgccggcaccgtctgctccatgtgcggcgacgtcggcttccccgacaagctcttccagtgcgcgcgctgccgctaccgcttccagcactcgtacgtaacgcgcgacccggccggtgtactctctaccactgtaatctcttctctatctagagctagcagcgaacacggggtgtgtgtgcgtgtgtctgtgcggtgtctgtgtatccatgcatgtctgatagacttgtggcgcgcgtgcagatactgcacgaactactacggtgacgcggcgcccgccccggccggcgccgacatgtgcgactggtgcctgagcgacgtcgccgggaaggcgaggtactcgtcggcggccgggaagcagcagggcgccggaagccaggagtcatccacgacgacgtcgagctcctccgccggaaggggtggcggcggcaagcccggcgccggcgagcaggagagcgggcggcgggggaccaaggcggccggccgaaggtacaagctgctcaaggacgtcttgtgttagtttgtttgtttaggtcacccatgccgtcacccagtactagtcgtcatcgcttaggctatatagactcgttagctagccgctagtttgatgatcgatgtgcatatactacgtgcgtactccatattgtatctagttgtgtgtgttagggtcttttaagggggcctgttacctgaaatgttgcactcttggcttgtgtttctcttgcgttatgcttgcatgcttttctagtatcttggataatttactgcatatatatctcttgttatcttcccgggttctttctaacagcgatttgctagtagctcatatcacatgcatgcatgtaggtaatccctacatcttttgatcacaccttgtgtgtggtggaatatttcagatgagctattaatttctcctgaacttgttagaaacaacaggatgcatgcatgcattttctttatctttatacttcatgtagttttggggccggggaactgaggagcaactggccatcacgcacgttgcatgctgccaagccgagccatgtcgatgtaggggtcaacgaatcgtacccaaagacccaaagtggccgacaaagacatgctcctacacaaacctcaagctctgcacggcctcctctctacgagtagctagcttgtggccaagatccatttagcccctgcttttgcctcgattggatggcaatgcaaatccttctgctacctatagcaacaaactgcatgcgcacaacagcccagtatcagcaacattgctgctccagaatgccatcactgatcatgttctcccatttgtcctttcgttgatactcctaaatactctgaatctctgatcaatgagcctgttgatacagcactgtccgttattcaaatattttagtcagtcttgccgtacctgatcacttggcgattatttaattcctagctagtactctatatattgattcagatctctactgggatgaactgtagccataagacaaaactttaattatgaggggaagtttagttaagtggaattaatagtagatgacggcaggaccaaattagctgtgtgtggtagctagctctagctcgcccacagtaccagcggtgcagctgaccctactcttgtgcatatgtacaccatctggtcctttttaggtgtcatgtagctaaacagaccagacatcgcgggatcgtagctaggtttctttctccctcgtcttctacactgtatgtggagttatctttcttctccctagcctagctagctacctatcttgcacgtactactaccaaacaagcgttgttccttaatcataaccgaagtttaattatttcttttgacactgtttgctagctagctcatagcatctacttcctccgtcccaaaaatatgtccagatttatctctagagttctagaggagtactaaaaggactactcttttcattccaatttgatcatcacatatgatttttgagttatccctaaaatgatcgtactcctatataataagtgcctcttcatttatttgtgaaaagagtaaatggacatcactgaatgtgttggtatgcatgtaactagttaagattaatttctattggttcaactccatgcaacatttatagtgtgatgcaagctgtgggacacaaagcgatggaacacattgattagtgataattaattttagagccatcgaggttttattgtctttggactcgatgctctttgctttggtgataatcaaattggaattgagagagtattatataagattgtagttgcaagtatagctttaaagattgtaaacatactgcaagcagctaaacactacaaataaaaggggtctattgtgccggttgtgaaccctcgtctattctgggttcccaaccagcacaacaatcgatgcaatgatggcctctcgacctcattgtcgatgtagagaataggcactaatgggattgacgagctaaaaaaaggttgagccagcttgaattgagatgacgcggtccaaatcacatatcatgtatcgatgcccagatcagcaattgaaaaaaaaatcaatttagacagattgatgcatgaatcaacaaaattgtgaaacacagatcctaacaaataagaaaattagaaaaaaaaatagaagattgtgcatccatctttttgttgatatttggatttcgttttcaaataaagtcatcttctagttttaaatcacctttagaatcattagcctctgtccctacactgactcacttatccgggatcgatcctcactacggtcctttatttcgaaacgaggatagggctctcgcggaacgaggtgtagattgagacgaaagatgagcgtatggtccatactcactcgggttcaaacttattcttcttttttttttccattcattcaaccttatatatttgatccccttctcccaggtgcgagtctattattgaggaactgtgagctccttttctagagcttccttcccatttaggcggggtgttcaaaggggttccaccgtcaacttaagttaaggaaccccaactaagaagaaaaataaaaaaaaagaaaaatatgtgaatcacagatcctaacatgcatcatccatgtcccaacaaaagaaattgctcgagttctcaaatggatagcatgccaaggtcggcgaagccgttgtttctcgctgaaggtcaaggacgccacagctctcactgcttgccgaggctaaggctgctgctcctatgattgtggagatcgagagagaatggagacaccaagagggaagagagtgtggttgtggggatgtatatgtagaagataaggtagagagagagagagagtggatgtgcaggagataagggagatatcaactcgagtaaaaaaccattagctcggttggctcaagtaccagttttacttaaagaccccacactaatgagtaatgactaatcatcagtgacgatttataatagaaaatgacactcataagtagactacttatctatgtcggttcttagctatattgggcacagattgggtgggtggatgcgaaactccttatcagtgccaggttttcttcatccaatagtaaaaggactgtacgaataagttgttctgtagtagtgtaagtagctaatcatatccatcttgtatacgttgtcatacaataaaactagacaaggactctagccagacattccactcgtaggtatcgcctacacgggtggcacatgggtgaaacctagctactaatcgttgtcaatctccaacccgaccctcatagtctcagctagccatgggcggcatcccttttgttgggggtgtgttgaaatcctcggtcgtgggagtttgtcaggcctcctttatcatccgtgggcggacatcgatggaaagatagtccagtgtacctaagtagcagtggatgcggagtgcgttttttggatcttgtagcccaaacctagatgtttgttgtcttctattactctctccattattgaataattgacattttgaccatagcatataaaacaagacaacaaaatttatggccaatttgcccttggcaattgttagaagatgacgctaaaaatgaataaagttgaggtagggaaaggaattgagggaaaagacaactatctagatgcttactctatggtggaagatttatttaggcccaaaagtgtagatataggatagtaggggcaaaattgggattttagtaataaaagtgtggtggtgacaactattttgaaacaaatggtttgatcaaaactatcaattattcaaaaatagaggtataggatagtaggggcaaaattgggattttagtaataaaagtgtggtggtgaaaacaattttgaaacaaatggtttgatcaaaactatcaattattcaaaaatagagggaatagctattcttcagcagcaaaccggtagcatcactggaattgactggaagctatgctaggtctacaacaagcaggcgcccaggcaacgaatccatcatcttgctgacgcgggtcgatggagttcaagtgcgcttagtaattggcgtcagtggggattgtattctggactcttaagaggatatccccttgtttctcctatgtcatctatatagttatgaaagaaaaactcaatcatgttttttttctttttgcatgttgatcttggatgctcaaaactagttggaaaacgactaaagtgtcgtacattaatacaaaagtagtatttatgggagggttggtgtgggatattaaaggaatcgaactcattgttttgtggacttggaataggtgagaagatggaaataaagttatttttttgtaaaaatgaaagaggctaaaagcatgcttattttggatggatggagtatgcttgtagtaaaaaatcctagtctaactgtccaaacaaactcaacctaaaaattgtttcccgtgttaatggtggtgcagtggatatcttagtatcttattactactagaaaacaactcgttgtggctgtcgcagctggtggatgcgcaattgctaatctctacgaacgcagtttctaaaggaaaataatcctaattaattaagagaccgtgtatttttatgcagttgggatagagacctatctaaagatgtaaatattagggaatgacctaatatcaaataattagaaaatgttaggcttcgagcctaggtcatctagcccactatcctgtggagctgcccaaacaccctagacgtttctcggatagagacctatcttacaatacatgtttgttttgtttctatagatttctccatccatccgtgatttcaattctactgggtggtgagtggccgggattacattaattattttagctagctgccatgacaatttacttatggctcattcaaaatacatgaatttcataggatttttatagggtacacttcattcttttaaaattccgataaaattgctccaaaccaaataagcccttagtactccgtacgtttgtttttttctcaaaatgtgttgttgattacttttgtaatggcgtttaaccatccatttcattaaaatttagtgcaaataaaatgtgaagtcatgcttaaaatacttcgtaaaaaaacaagttacaacaaaataaatagagctcatataataccttaataagatgaataattaaaagtcatatttaaaatgtgtgatcgtgtcaaataattttaatatattatgtgtgtatgtacgcaaacctagcaattaattagtttttttttataaaagagatcaggaatggatcccaagtgtacaatgtgtagtgaactagtgattactacatgtgtcggccggagagagccaaagacaatgagctttaattattaatttgtttctaagcagttaataggaaggatcgattttttgaagcacttgctagagctatcctagcttgctcccttatattagtttgagcagataagaatcgcagctacgccgggcccaacgacgtggacggaagatatttgcatttgtagatacttgaatctatcgtttggatagtgctcccctgcactatgccatgtaccatatctttcatagtgtcaaagcatggggaacgatgtgtccctgtccctgataacttcgatcgagtgccatgctcacattcatgtactacgtgttcattcattgcccgttggagattttttttaagcgttttggcaagctaattaatcaagtccatgttgtgcttgttcttgtggggtcgatgatatgccagtatgcacagcatgcatgatagaacaaatagcatgccaatacccatctctatgcatgcccgttcaccactttgaatgtgataggttgtggtggccaaatggcacatattggttgctttgtaaacagttggtaaggcaaacacaaatggctagtcatccattcaaataacgttgtggagtagcatgagaatgccattagtcacaataatatggtaggacattgtgtcagaaatgatactagatagcatcaaccttccatgacttcgtatcatacactgccggagaaatgctttgtactctcggattgtaatcctctattgttccggttatgcaaccgaaactagagatccgggaataaagatatccatctttagtcccggttaaaataaaccggactaaaaatcattgttagtcccggttggtaggactaagggattttttttctgtttccactgttgttttgttgtttgcatctcgtgcacaatcgcacaaaaatcacacaaatcatacacaaaatcacacacataaatcatccacaaaaatcatttacaaatcatacacaatacatgcccatccacaatccacaaatcatcacaaaatcatccccaaatcaaaaaaaaatctacacatcaattcactgtccatccacaatccacaaatcatcacaaaatcatccccaaatcaacaaaaataaaaacctacacatcaattaaaaaaaataaaaaatgctccacaggtcgccgccggcctcccgccttcagccaccgcccagccacctcccctcccggatccgacggaggggaggccgccgccaccctcgcatcgccccagcgccaccgcagccgccgcctcccctcccggatccggcggaggggaggccgctgctgccgccccgccacttccccggttgcttggctcgccgcccgccggctagctcgctccgccacctcccctcccagatccggcggaggggaggccgccaccgccgccgcccctcccggatccggtggaggggaggccgccgccgccgtcaccgcgccgctgagagagagggagagctgaggagccagctaagagagatttttctaagtgtttgttatatagtaacggggcggggagaacgatgcggagaggctgatccggatttttattttgtcccggttggtataaacaaccgggactaaatattgatctttaccaaccgggactaaagataatgtaagcatgacgccggcctgacgatttgtagaactgggactaaagatcaaaatgtaccctggctttttgaaccgggactaaagttattctttagtcctgtttcttacttagaccgggagtattgtgaattttggtcgaccgggcaaagatggtttctccagtaatgatatctacacatgaactctcgaaaaagcaccctaatttaagagatatcatattacaatgtcatttgtatttgggacttgcatacaaattaaacattgtcaaaataaacgtctgtacgtgctaattaatttttttcttatatgagggcaaaatgttgtatactcctaataaattgcgaatatatagcccagcatggatgcttggtttgagctacgggagcaaagttggaactagctaggttgcctcctatactaattattgatcagccggggggggagggtttgttttttgtttctggaaaagtcaggggggatttgttgcatgtttgccattataatgttattatagatgtatgcaggctcaaaaccatactttaatgccctttttcagttgcacttttaatgaatgaaaaaccgatggtgtgtgtgtgtgcgtacacatcatatggtggttatttaattgggtgttcaattataacatgcatgaataattcttatcttgcaatttaacatagttatgttaatatcacatcaatgcacatatctcaagctaattttagagagtatgtgcaaaacatgcaatagttggagcatctctatcacctctccaaatatccatctggccagcttgccaaatttatctttcattccaataaccttttcatttcactctcaatccaacaatgggtatcacatgtcaccctctctttacttcttcctcccttcttctatctttcccatcccaaccatcttccctctccacccgacgacagtagggggcgacaacgacgaggtggccaacaaggggaagcagggataagggcggggcaggtgaggggagataaggcgtcatggtgttactgctgccgccagcagtgggaatcgacacagggaagagcaagaaggggcggtgacgcacgcaccagcaatggagatgcagacaatggcaatgcggcggaggttggggaaaacggtggcaacgacgggctatggtgatcctctcatcctttgttggtcacctcccttccgagctcccggctcccgcttctgccactctgacacccttcaccgtcgcgtgcaggccaggccaagccaggccactgcctccacgcggcccttgtggtgggagttgtcggtggcgtggggaggtgattgccgagtgaggagtcaagcttagggatgaggaggttaaaggagacattgacgattggccttcttcctttacagcgatgcatcagcgcgagggtgggcgttggcagagaagagaggagacggagaaacggattgaaggtgggactgataatgcgacccttcgtttggtaaatagaggagcctggccacatttggccacccgaggaactcgtttggaagagagttttttcactgtgttggctaaaatttaatttgaagagccatctaatgtggtgacagttgacagaacatactgttgtattccggagggctgacgaacctgctgatctgtgccaagtgtagccggtcttagggtcactggtacaaatagctaggccaggagcatcgatctaagacaaagatgtgttggtcttaggttcctgaaaatatcagccggtgcgccgtgcgcgagctgttaatcatcaaagcaatggccgatgtgggtagcacaaattattcggaaccaactttgggcccgtttagttcctcaaaaatttttcccaaaaacatcacatcgaatctttagacacatgcatgaaacattaaatatagataaaaagaaacactaattgcacagttatggaggaaatcgcgagacgaatcttttaagcctaattagtccgtgattagccataagtgctacagtaacccacatgtgctaatgacggcttaattagtctcaaaagattcgtctcgcggtttccaggcgagttctgaaattagttttttcattcgtgtccgaaaaccccttccaacatccggttaaacgttcgatgtgacacccaaaaatttcctttttcccaactaaacacacccaaaatgttagggacaagagaacagtaaccaaacgtactgtcactgtttggttttactaatcagtgactttgtagtccgacatgacatccaacaaaccccgcctgacattgccgccgatcgagaggatctgggggattcgctctagtaggcactatcgcacagtgaccgcgtctctgtcttctagaacccaatgcgacgacctgataagatcgcattatcacatccatagttttagtatctgtcacaatacacgttttgtcactgaagaaaaccgaacaaatacgtgactatcacgggagaagcgccatgtagttttagtgtctggcgccggaggtagcatcggtcacaattcacacgtcgaactgtgatcatgcggagggctttggggtctgcagcttgggttggaattcccctcaagaggagaacagagaacgacagcatttcgtcgctccccccacgacatcatggcagaaacacgcccgtgaccaccaaataatgtccacccaattggcctctaatccatcagaaaagcagagcgaaaaaatagaacattgctagctagtggcaccaccaccaccactgcaccagtactgctacatcgggatagattgctacgagacgagacactattgtccaacgaactcaagttgattgcacggctgcgcgcggcgtcgggacagagctccagccgtgcgcgcgcgcccaccactgatcgatcgcttcccacgcccagctgacacgggagctagggaccgtggtgcacgcgcggcgacgtcgcggctggcaggtcggacactcagaccacgcgggcgccctccatgggcgacggcgtccacgcgtcggaggtgcagccggcgtcgccgccctccttggggggcctcgctggcacgggccggaacggcgcgccgctgcctcctgccgcggtggtggcctgcatgaggtcgagcgtcacgtgccccgactgattctcgtgctgccctccggcgccgggcggtggcggccgcgcctgcaggtgcgcgtgccagccaccggccgtttcggagcccgggctgcggcccgttggacggccagctggtggcggctgtcggtcggagaagaattgccacgagaggagggccgcgcggttctcggcgatgagctcgtcgagcgccgcgcttgagcgggcggagatgtcgggcgtcggcatcagccatgggccggtggctctagccgatgacagaagagagagagcaccagccgacgacgtcggcaggccgtacggcgggaaaccgtgtcccagcaccggcatacctgcaacaacaacgtcgacacgttattatgcatatcattgtgcctacagaaatgtggccatctgttatagtcatatcaagaaagcataatgcacaccatcagtcctaataacgaagtggttactcaaccgcaatcatttttgcatgcttgccctgatcatttgcaaccaaatttacaaagtttaaaaccaaccaaccatgcatgttcaccgggtacaactaattgatactatactatatatctttacacaaactgatcgctacctgatcttccacaacatcatgtctatgtgttgatcaaataacaggtttcaagtggtcaataatgctgatgggctttgggtcactagcatagtaaaaacgtgcactcgaccttgatgtcaagtttaggtccatggtaatacgtactaatgttattgttaaccaagataggcccattatgctgttgttgattatgttgacacgaaagtttgtggtggttacgattgttaatgtctttattgtttgaggcaactaacttaaatcttgcattccataatatttctctgtaagacagccagaaggacctactccaaatcaaagtccacataaatactggagtacataagttatcacagaatataaggcatgttcatctacaggatctatgtcagtgcagcaggagtaccatgtactgtattttctactgcaggagtaatagtttctcagaacaagagaaaggtagtggtagactaaaaggagtactccctccttcctataaaaataaatctatgaatctggacagatgtatatcaaaattcgtagtattagaataagtcatatctgacactatattgtttttttatgggacaaaaggagtatacatatatacaaggtttctgaactgcagagccgtgcttacctttgaaggtcagtagtacaactatactcatgaaagcatatcaatatcaatcaatacacgcttgaatatcctagaatgccgctatgaaattcgaccgccgtatgtccaagtctttcggccagtcccgctatagcactataccttcgtacagtaactattcgtaattaactgtacagttgtacgcgtatgtatgtacatgcgtactggagtagtagtactagtacgtagtagtatagatttccgtaagcatacaggctcttgataaggagtggaagatggatggatgaaaccactgtttgccgtgttgcgtgcgcagcgaccacccggcgcgcgggttcctgttgatgccatggtgatcatatgcacggtcggcctggccagtggccacgcagccactgccactccaagcaagcaggctggctgggccggccaggcaggcagcgcagtgcacataaagtcgtgcattaaaatctgtgctctcagcgtctcacacatcccgatgagctttttggtgcgcacctgcagctctccccttgtttcccggcatcaaaccaaccagtactcctactactgggagtggtacgctcctgtttgtgcagctaacctgcctctccattggtctccctaactattactgggagtagtacgtacgtactacacgtactagtagtatgatgattaatggaactgttacggccgggacgggaggagtttgttttgtgtataccgtgtgggtgcgcagagcccctggccatggcctcgctggcgttgctcctccgccgcctctcgttgtgcccggccagccgccgccggcagctcttcttggcgtcgtcaaactccgcgagcacgtggaacctgcgcgtacaagtgaaagaccgctatgagcacgcgtgtagcagagctagacatgtgacgtagatcgtggtgattgacgcaccggctgcattgctggcagaagcgctgctcggtgccgtgcacgacgaccctcggggccttggcgtgcacctcgcacaccttgtgccgccggtggtactccttgactccctggagcgtaatgtcgcacccctccacctggcaacggggcaccaccggcaccgccgtcgccgccttctccttcctcttcccctgatccgcggaaccaccaccgcctccgcctccgccgccgccgctcccctgcgccacctggccggcgccgtcgccaccccagaagcacggccgcttcccgagcttgaggcaggtcagcccgccttgctgttgcatctggacgtcgggcctgcatggcgccggcgggaggaacggcggctgcgggctaggcggcgaggtgacgacgggagcccagtgcatcccaacgacaccacgtggtgtcgccccgcttccgccgcagccgtttccttccatggtggcagccgcacacggacggacctatgtgtaaacgtaccgcagctaagctagctagcgtcgttacacagcagcagccacctggtcgcgcgggcttggcttcgctccggccgacggcggcggatcgaaaactagcgccgattgggaaaaaggctgcggcggcggttgtaagtacagcgagtaggtttgccgcactggcgttccatataaagcgaagcagccaggcagcgagggtttgtgaagcgaagcgcacccccggggaggagcagcctactggcgaggaagcacgcgccgtactgacatgtgggatctcccgtcaggattggggtgtgtggtggggtcacgagcgtggctcgtgacatgtggggccaccgccacatggagctgtgtcattgacaggttcaatcgaaggcgggccccccctcgcccgctgccgctgcctctgccgctgctgctgcgccgtgacatgactgccacggcattaaacgccgcgcgctgtgtgacaatacgctcatccgcgcaccgcgcgtcaaccaaccaaccaatagcgcgcgcctcccccgacactgacacgccgggccaacacctctggtgccaccggacgagccccacctgtcggcgagccgtgccccgcgtccgtacggatcacgggagccacttgcgcaaagatcccacccatatccggaaccggacggcacgatagattctcccagccaacgcaccagttgacaaccgcgcagcagcccacctgtcgacgggcccattctatccatggccccacatgtcatagaggcatccacagagctacgcggtggagtacatgggacatggggtacgtacctggtgggcagtgaaaaaaaaaagcctgcgaggcaggtcgtgggtgtgtacatgcatgcagcgcgacgggcgggggtggggcccagtacggcggtggtccagttgtcagtgtcagctacagggcggcccagtgcctattggctggggaatggggggtatgtctgtgctttgggggaaataacatccccgtgctgggcgttggggaggatacggtgcagcacgtacgggtacgcctattttggccgcttcctgcgccattccctgcgacggtgctgctgcctttggctgcctcacctcacgtccttggttactcgcgcccgcgcactgtactactgccgctgacaccagtgttctgtttcctttcttcattttacagtactgtactatacgttttactacccctagatgttctctttacttttacgcatgtgcagcaatgcaggctgcaagaactccgttgcaagttgggtggattcgttgcaagttgcaagcggctgctagctgcctccggtgcctgctgttagggtggcagatgtatgtgtgcccagacgatgatcggaacagctgtgctgtgcactgcatgcgtatgcatcgctttttcagatggcagatcagccttcgtgacgtgtagtaacacgttgtgcagttactagtgggagtaggacaagaggcgtggtgtagaagtgtccaacaggatgagatcgtagcgtataataaagtggatacctcctcccatgcaagcatatcgtacgatcgtagcgccctcctaaagacgctttacaccatctaatgcaaatcctctcacttttgcttggtttcctagcgtctaaatataggcttgtccgtattattgtcattttgaccgtatcaaattttgataagacaataaactaaacgcaacgcaagaatcttcaggaagattgcatggacccctcaaactctaatcacaaatataaaagaggaagcatgagcctagtaaagcaagggcagtaaaattgaaagacactacatagaaaagagttcgatggcttggaagacactatatagaaaagtcttttatgggcatggttccctttcccatgcgggcatgcccactacattgtttcattttaagcttttattcaccatctctattataatatataagacaaatattcttcctttccttaaaaaaaaactaaacatgatatcaccaacttcatcctaccaaaatttggtagttttggaattccctctcacaaaaaaactatcaaaaaattagaaaggtatcaaactaacgcacatcctacgctaccacaatttaataataccaaaacttgagaaatgttggtattgctaaaattcgataatgttgattttaacagcaaagtgaaccagagccctctgcatattctacctgtctgccgtgatgggccaatgctgcaacagcgactaagcgcggtttgccgtctgcggagtgctcaaagcgaacggcccagctcgcgttctagcctaacgttttcggtgtggattgaattaggcccatgtagaatacacttgggccgtcacacgaaacggaatggaaagggcccaaaaagcacatggaccttatcgctggtcctcccgtccccgttaacaccaccggccgcctcgtcctctcgccatggccgcaccatccgcgagctcccgtgcctccgcgatctagcgcggcgcggtggctctcgcacccccggcgtcgacggagcgcggaggaaggcgggcctccgtacagaggcagtcgaggggcacgggatttaggggagaggggttggggggatggggaggaagcctgatccgtcgaagccacactacggtggcggcgcctcgccgagggcagcgaggaggacgcagccgtcgccggttttcctgggaacggcgctgttcgtcctagggtttgtgtccctcttcacgggacacatcgttacggacgccgactggtcccggatccggagccggtggcgatccaagcaggtaattttctgacaacctagaaggtctgtactgtataatttgacgggatttatcggcaccacttagaattcacgtgatattcgagtgcaataggagtaaatggacgtagtttgtctgttttctggggtgggcacgcctataccacagcatcgttggaaactaactgaaagctactgaacggaaaaaagtttaatttttgggatatatatatagttgttgcatacggtttacctggaaatagtatgcaagttgtgggtagtcagaggttttacgagtcactacgtgagcacctgcctgataagtccttaaattattgtttactgttgtcctgtcattatcagcatgttatttgtctcagttcttggtcaatgcttccttacaacgttggcaatgtgcaggttagaaataacgagcccataaatatttggaaatcgaggtattccaacttgtactatggatgcagcaggaggagcgtaaatttcagatgttagtttgcttattaaatcatcctcccttttggacaattataactagatgagtggaagaatatttaacacagtgattccatatgttcatctttcagctgctgtgccggagaacagttctactggttacttgctgattggtactagcgggggactaaatcagcagcgcataggggtacaactgtatttcaactttttattgcgttgctttgtattatccattgtattaccattacgatcttcagtttccagataacagatgctgttgttgtcgcccgaatattgaatgccacacttgttgtacctgagttagatcaccactcattctggaaggatgataggtaagttgagaccttaaaattatacttcctccatttcatattataagactttctagcattgcccacattcacatatatgtcaatgaatctagacatatatgtgtttagattcattgacatctatatgaatgtgggcaatgctagaaagtcttgtaatatgaaacagagggagtaggacaacttctgaagttcatcaacccccttgcacgatggacttaccctgatatggtacgtgctatatgcagcgacttctctgacatttttgacgtggactggttcatctcttacctatcaaaggatgtaactattgtcaaaagaatcccttatgaggtgatgatgtcaatggataaactcccatggaccatgcgtgcgcctaggaaatccatgcctgatttttacattgatgaagttttgcctatccttatgcgaaggcgagtaagtaatacattgcttcatattgatcaatttatcatctgcttgtgattgtttcctcgacacattttaatcatattgtgcatcttggaagaacatttgaattttttttttacttgaacattggaagaatcaattgtttgtgaggtatggatagtttggtagcttcatatgtcaattatgaagttacctcctgattttctgttttcaacactccctccatcccaatataagtacaacctagtgcagatgtgaaatatcctaggactatgatgtctagattcgtagtcctaggatatgtcacatctatactaggttgcacttttattgggacagagggagtatgagtttaggagatgcaataattggaaacatctatatgaaatcattagacacgtatgtggaatgctcgtgatatgtaaaagcaaagaggtttgcctatgcacttaacagtttaattttgcaggctttgcagctaacaaagtttgattatcggctcactaacgagcttgatgaagaattgcagaagttacgctgccgagtaaatttccatgcattaagatttacaaattccatacaaactctaggtgagaaattggtgcgcaagctgaggagcatgagctcacgatacgttgccgttcacttgaggtatgcttttacttgtttcttttgatttagtttctttgaaaatggtactactgagtttttttcccctgaaagtactcatatggagtgttttgaataacctctttacttttgcttgactcctcaggtttgagcctgacatgcttgcattttctggttgttactatggtggtggtgataaagaacggagggagttaggtgaaattaggaaaagatgggatacactacctgtaagactctgaaacttggtgagcttaggatctggatatatttttgtcggtattgcacttcctttttgtggattatttcttttgcactgataaggatgtgttgggtcagatttcccttaaaaactattgagtgataatggctgctgttagttctgagtgtccatgtattcttttgatcaattagtaccgatggatcaatatttgaatgatgaaatgatttagactgattcctagcaggagttgagcgctgaggatgagcgcagtaggggcaaatgtccactgactcctcaagaaattggtttgatgctccgagctcttggttttagcaatgacacgtacctgtatgttgcttctggagaaatatatgggggagaagaaactctccagcctctgagggatctctttccaaactactacaccaaagaaatgcttgctgggaatgatttgaaaccgttccttccgttctcttcaagattggctgcaattgatttcatcgtatgtgacgggagtgatgtttttgttacaaacaataatggaaacatggccaaggttttagctggacgaaggtatgcatctatcttctaatggatttgctaaatgttctaaatgtaaagtatagttgaatgtaaacagataagccttcaggtatgatgcaatccacctgattatactatttttctccctagtgctacgtgtgaccctttttcatgtatttttcgtatgtgtctatcgttggtggttttgtttcatctaatggtcattcatctctgtctacttgtaggcgatacatgggccacaagagaaccattcgcccaaatgctaaaaaactcaacttactatttaagagacggaaacagatgggatgggatatattttcacagaaggtaaagaaagtgcagaggggactaatgggagaaccggatgatatcagaccaggaagagatgatttcaatgaatttccatcatcttgcatctgccaaagaataccagtcaatagatcagtcacagcgcgagctgaaaacttgtgagctctagtgtagtgaggcagacaacttgagaacggagaatgctgggtgattgagcacgtcccttgctgcactggggaaaatacatgtttgttaagcaaagaaaacagggatgtaaacccaatcagacagaagcagacgtggtggataaatactcttaccggctttaactcatggcactctggtagtctggtggttcagacccagcagaactggttagtgtgcagcgatgacagacaaactgctgatttgcagcttcagtttggttccactaattgttaaaactgtggtaaagaatctgccacgataattgtagtcattagctcgatatgctatccctgtaaattgtacggtatacacgatcaattatttggatgtgtgcttcaatcgtcccatcttctgtctggtagaacctcacagcaacgaacttatttgctgaagggaaatgccattgtaccagaaacttggaaattgaaaattgcggtgattacgtgtaatttatttccttttaacgagccagtctggttcttttgaagcaatatgaatgtaacgtctttgttgcatggctgtgcagtactaatcaatgactcagcaaatctaatcaaatcgtcatcaaacataaatttcatgggattgctattcaccagtcaattgatttttattttcttaaatatcagccactggggtagatgacaacaagtgcattccttgttggctgggtatacaacacagatgggggaaatttcgactcacagatgtaagtatgcaacatcgatacacaacataacaaatgctgatgaaatcatgagatgcaccgtgatagcatcaccagctaacaacaccacccatggatcatcgggatcatctactgcgtgacaatgagaaacatcactgacgaaacccttgcaacgatttctttttagtaaacattaaccgaagctctgcttcggacctcggttgcagttcagatcagagaaactcataagcaatggacttctcttccttgagctcggtcgccgaggtttccatcttggagcgtgcaaagtcgtcaatctcaagacctggagtgcgaacaaagcgaacattcttaggctgatctcatcctgcaatgtatctgaatcacaaggattccatgagctcaccctgcacgacagaccactcccccttctcgcaggtcaccggaaacgagaagaagacgccctcggggacgccatagctgccgtcagagtaaacgcccatggacacccacgtaccctgatgaggagaggacgagcaaatgctggaattattagatgtgatcgatcggaattcggaggaaggtatgcaggggaggggatatggacctttggggttccaaggatccagtctctcatgtggtcgcatgccgcgctggcggcggacagcgagctcgactgcttccgcgccttgatcaccgccgcgcctcgctgctgcacgtcggtgacgaactcctccctcagcctgtcgacacatggtggtggagccactatcagaactcgttaccacacatgcatttttacttgacgagttccgtaccatatctcgtcggcgatgagctccctgacgggcctctcgccgcggtcggtcgagacggtggcgtggctggcgtcggggaactgcgtggaggagtggttgccccatatgatggcgttcttgacgtcgccgacgtgcacgttcagcttctcggcgacctggccgagggcgcggttgtggtcgagcctggtgaggcaggtgatgttcttggccgggattgccggggcgaactccttcaggacgagcgcgttggtgttcgcgggattggccacgaccaagacctgcaaactccggcaagatcatgctggtttgactttataatagaaatcctaataggtacttcatacgtttcatacgtttcataatgtaagtcattctaacattttccacatttatattgatattaataaatttaaacatcattttctacattcatattgatgtatatatctagattcattaacatcaatatgaatgtgaaaaatgctagaatgacttatattgtgaaatggatggagtactagttaggaacccaacataaatatcaaaagttttaactggcatccgttaggcagcaccgataataatagtcatcagtaccgattacacaattgaaacctatatcaacatataggtgcctgtttttaagtgagggccatcaacaattacttcgtcgtgataaccagtggacccacaccaagatgctagttgggtgaaataaccggcacctataatttgcgtgaagtatagtttatttgttttttaccgtccaatggccggtacttgtaccgggcggtaccaaattcctagtcgttggatctggcccgatccaacggctggtagagtttgataccaattctgtccctggtacagtaccgacctaagaactaaggtggaagggcaaaaatataattatgtgcaatagatggatgtgagtcgggcagatagggtgatatggttcccaccaacaccactgccgccaagagtgtgtcaacctcgtccacgctgcgccgtgaagaactccgcttcgtccgcccctcaccgccgggaaggactcctcctcctcgccccctcggcgccgggaaagaatcctccttctccgcccgtcggcgccgggaaggactccttctcggcccctcggcgcagggaagaaatcctccttctccgcccaccagcgctgggaacgacgactttaactctgccgccctgattgagcgcatccctgctcattttctctcccgatcctacccatccgggattgaacggtcggatgagttttggtaccgaccaattccagtaccgggcagtacaacttggtggacggtaaacatgtaaacatgctgatagtttataggtgtcgttttctattaccaaccggcattatgtatgaatatgggtgctaatcgtctcaaacagtacctcgtgggtgcacacttgaacggcaaaatcactataaatattggttctagcccgtttcttttttactgttccgtagtagcagtagtgttttagcatagaaattgtgtacttgcgtatacgtgatgcgtcgtcattcaccttgcagtttggggcggcgtgctgatggagcgcagaggcctgggatttgtagattgtcacgttcttgctaatcaaatctttcctctccatcccgtctctcctcggccatccaccgatgacgatggcgacgttgacgcccttgaacgcctcagcctcgtcactcgtcgccaccactcctacacaattgaagcatcatgttttatactcgggcgaccagcgcaacgagggaaacttgaaggtacaaggtcacgcacctctgagcagcggcagcgcagcgtcgatcagttccatcctgacgccgttcagagcattggccgcgaccggcagatccagcaggtggagcaccaccggctggtcggctcctagcatgaggcccctcgcgatcatcgcgacaatggcataccctatttgccctgcaaaaaacagcacaaaatgtcgtcagtgaatttgttttctcgacttctggtcgtatttttggtttagctgcttaagtgtttgattagcttccgagttctgtattacctgcggcgccggtgacaagaaccttgacaggcttcttcggctcatctctcagtaaccacgggcaccattttgccagacgctggaagagggaattggatgacatcatggttttttctctgtgaaatttgtatgtggatgacaaattttaggagcctagctttgatatgggttcagctgaagcaactcatacaaatagcaccaagtaggccatacaccatgataccttactggcttaccttgatgaacttgatgctaaaggctcagattccatgctgatttctgcaagaaatggagcttcctggtgcaaactgcaaagcttggtataatgttgagaaggtgaacggaactaccaaccttggctgatgtgaattcataggaagccatttggcttattttaagcataagcgaaacggcatatttgcaaacaaaagataatttatgaataaaacttttatatatgtgttcttggcgatttaaaagcaaaagctgaaaaataaacttcaatgaaaaaactttaaaattaactttaaattttagctaataagtataagtataagcaaaaagatgagaccgatagtatgaacttgatggtctcaagtgattttgacaataataaattttacaaaattacagatactttgggggtctaattatcacaaaactacagatttaagaatgtttatcacaaaactacagatttaacgtcaaacttttcatggaactacagatttaatgcaccatatcagaaaactatagatttagtgatgaagttatcacagaactacatattctagacttggatcatagtattattatttattaaaagttataaaatctgtagttttatgataaatagtttttaaatgtgtagttttgtgataaaatagttgttaaatctatagttttgtgatataatatcttaaatctgtagttccgtgataaatttaacactaaacctgtaattttgtgaaacacgttcttaaatgtgtagttttgtgatagtttgatcaaattatatgtagtttcgtgaaatttactcttttggcaattaaggaagatgtgcgaaactgcatgcttttcttttctttggtaaacaaagtcttaaccctaatactgaactgatacaagtacacaaaagtttaatctgcactggtacgcgtagaccataacagcaagcaataggatgcctgattcaacaatcaactcagagagaaagacaagggtttaaaggctgtgtttagatccaaagtttggatctaaacttcagtccttttccatcacatcaatctgtcatacacacataacttttcagtcacatcatctccaatttcaaccaaaattcaaactttgcgctgaactaaacacagccaaagatttatggagaccgaagagcatggccttttgtagtattgtaagttcaagtgccttaattgattaatgacaaatctaactatatgagactaatcgtttcatttttatgagcctttctttgactagtctcatttggatacaaaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggagagcttattttatatttttgtttattataagatttctatcttgatttgaaatcatttttcatctcatctctctatattgtttatatcgaattattatctatcaccaaagagagaaaagattgaaagatcttggattaaacaatttgcgtaattgttactttggtgatacatgataaaccgatgtttatgggattaacctctcttttgcataagttgtctactaggttatttcccgataatgagatgcggaagacatgcattcttttgtgatgtaccttaatcatgacaaggatgaaatgcatggagataaaacgatatgtaccacttcttatctcctactttttgataggttcatatatatgatttccatgtaattgatatataagtgtgagactaatgtttactcgaatgttatcttatttagtctcatttacattgagaacatggagatcatgaaggtatatgttttatgttggtctacatcattacttcatatgccttctctatatgtataggataaatccccattggtcattctctaattatgcatacacttgcatctcttgtatatttatttgtatgcatatatttagggggagcaaatcctatacatttattgtgcatgttctagatctatgttgttcacctattatttatatcggatatttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcacaaggcaaaggtataatgtagctaagaatgttttcttagtcttttcccggtcttggtgtttggtgtagaccggatttgctagataggcgccgtactatcaataggggtctatgaagcgagcttgttgatgatcttgtgccatattagttcatatgcatgtaggtgcattttgtgggtttgtctaaacaagtgtgatgagttttctcaagtcctaaaccaagagagaagtaggcatgtccaataggagtgagtgacatcttgtgggtatgtccggtggatatcctttggagtgtgagccctttatccttgactttagttgtttttcttggatggatttttcatgggttggatggtcctttgaataagctttccatagagtccaagaacgccaaattccgagacccgagtcaagagatatcgccgttttactaacggtcggttgagctgaaaagtgacatgcggtctgaccgtgggccttaggccggtctgaccgggtctgttagccggtctgaccggtgtggtaaggccggtctgaccggccccactggtctgttgcactgatctggtttttggtggcgatacagagccgctagagccgcaaccggtcagaccgagccgacggcggtctgaccgagccatggacggtctgaccggccactacactgcggtcagaccggccaggttgagtgggcccaataatttccctgttctagccgttacaaagtggtccggtctgatcggcctcacaacggcggtctgaccggcagagcacaaagttggggatttcggttccaatggctagttttggtggttgggtatatatacctactccccagcagcaagggtaaggttttggcactccattgcattatcttgaaccattgcaagagctctcacacccttgtgcacttagtttatctagtgaggtgttagagagtgagttaagccaatccaagtgcattgcttcattgctagtgtggcacctgatcatcctcggcaagcatcctagatttgttactcttggaggttgccgcctcctagacggcttgtggaggtgttgcccggtgacctctccgaggagattgtggaggaggcccggcgccgtttgtgagtggtttggagttcaccaccttcggagtgaaggaagaactaccctagtgatcgaggcttgggtagtcctctccgtgggccggctcccaccttgcccaccccttgaccaagggggcgtgcggtggcttcgtggttgagcggtggagttgggctcgcctcaacggggattaggaaaccggcgagtttccgaacctcagtgaaaaattccttgtctcttgtctcatttatttgttgcatttacatttgtgcaatttactttcatagagacatatttgagcccatatcacctatgtttgcaaaacttaacttagttgcttagttaaccttgcacctcaccttgcctagcaacataggttagttttgtttaagtgccattaagttttaaaaccgcctattcacccccctctagtcggcctccttgatcctacaagtatatggcaccaaaatcttccgatggaagcaaatgttattgaattttttttcattccctaaaggtatgtccccacgtttgtttgtaagtatgaaatactaatcaaatagttatagaacactttaaaaataaaactattggtcaattagttatttatcatcctgcaaaaaactaatttcaaacttgatttacaaaatgtgaaaaacagaaatacacactgaatactactagtcagatttgtattccaagttgtctagttcgatttaaatttgcatgttggtgtaatgatatctcacacaattatttatgttataattgtttttagaatttttcatagccaggcagtgtatcaggtgaaaaccaagcatcctgtgcaaacttggaaactctcaatcaagtccacaggatgctcatccgatggctagggacagaggtgggctaattttgcacttaaccgcccgcaattagccatagtaatctcgttttttttgcaaatcaccccccgcccaatcccagcgtcgcttcgtgtggccggttggccgccgcgggcgtcatttcgtttggccgccgccctccgcccgcgaatcgctccctcgcgcctggccacgaatgcaggcccgcccagccggctcaactccgtcactagcccgctgaggtgcgccacgcgccatcgtttcgtgaggcccgccgaggtgcgcctcacgaaaccgtgatggagtccagcgtgtgcaacggcatggagtctggcacgcacgacatcctttctacgcacgcacgaacgcccacttcggcattggcagtggcagcccttcatgccgtcgttagtcgtttctcctataatgctttcatcttgactttgatagaaattattttgatccttgctaacgtgcctgcatgcagtggatggtgaacctgtagtcactgttgattctgcctctgttgaggctaccgccatggatcatgccgtcatcaccatcgacgccggagttggagtccaccttgaacatccaagcacaccacagccaaaatcttctctgagtataatagtaagttgcaaagaacatttgaacattaggaagagcaaggagaagaaggctggaagtggaagtaaggatacaaataaacggaagtgtcaaaatgtaagcaagcagtggatcatgatgcacgcaattgcccaaacaatgttgttggctgatatttcaagttcccgtaaccttttaagttcaattgagcaaagtactattataaacactttttttactagtggcatcattcagcttattgctgctaattttcagatcaattgtgctaaattttgagttaatcattcagcttttggattttcagttcactgcgatgttgaaaaagtttgacccaagaaggcaaattgaaaaagtttgtctttcaaaggacaatcttcactgtgactgtaatttgaacacttgaaaatattactgaatttagaccatgcccattcacaagaagttcacagataacaacattcatattcacagagctgctcacaggtaacaacacagatgacacaattcacagaattttgtatctcttgctaggacagataataacacagataacttgctaggacagcagcaacagattcctgtcaacatcttcaatctacagcaacagctcccaaatgccagaaaatgactatgcagtagcacggctggggccggggctgttgcggcggcggcgaatcgcggacgagggagcggtgactcgcgggcggagggtggcgaccagacgaaacgacgcccgcagcggccacacgaagcgacgatgggattggcggagggtgatttgcaaaaaaatgagattactatggctaattgtgggcggttaagtgcaaaattggcccacctctatccctagccatcagatgagcatcctgtggtcttgatcgagagtttccaagtttacacagaatgcctggttttcacctgatacactgcccacataaaaaggatgagtgcacatccccttaagggacaaaatgacattcccaatgtcatggaactggtttactgatgaaacaccaaaccaggtgaaatgttatgacctgtttaggtgcctatctccttctgtaatgttggagatatctaaccatttccaaaaagttatagagattatgtgagcacaaggttgtatggctcagtgcagcttgcattagaatatcagagggcttgattgtatctgcagaaacaggtcaggaaatgaacaaagaaaacatccaccagtctctgaaatgctgggtattctcaatgatatgcctaatgagataagctaaagaaccattaaggcattgtttaagcctaaacaccaaatgaagtttgcataatgaataggggcatgacaaagtatctactctttctctttcttgcaaggacctaatctatgccattattggcttgagctcgtatgaccaccgccagaagtgctaatgacattgattagtaatttggtatgaactaccagaaaccccattcccatttcagaggaaactcgtatgaattcctgattatctgtggtccataaattttttgtttcatatgcccgaagaacaagttttgtatgaaaaaattgtgataataaggagagacttggtatcaaatactactcttttttttagctttgagagagaagaaaatggtgagatagggactcgaacccaggccagggcttgctcctggtagctccctaccagtaccagatgagctatccaccgttctgttttgtatgaaaaagtgaattccaagaaactctgcacaaatgctgactgcacaaataatgagctgagcaactacagaggatagcataaagaagtttgcctggtttggtcgtctaatcatctccttcatgccatgaagtcattaccactcattctagcattatcatattgttgaaacctattatttcaattgccggaccagccacgaactcaattgatttaattgctagccttacctactccagagtgtccattggattcctgtcacaatcccttttccgaccgctctttgaactgaaccttcggtcataaattacatgaatgattggtaacaacaaaattcaggtttgggctaattaattttcgccaggctggcaaagataaccggccaagttttgcattaagaaggagagagttttacagcagcccctaaaccagaaaaggcttaggttacaaaaaaaacttcacaacaataaagacaataaacaagcacagctgctaaaacctcaggaaattaaccgccagcgattgcgctcagtagcccagcagccttccatgtttcccattcgtcgacaattgtggcacaaaggtgaaccgctgaagtagctcgtccatcaaacacacgtgcattcctttccttccagactatccatgttaccaagataaccccaacatcaaaggtcctccgatctcttgtgaactgatttgcgtgcttcacaccaccaatccaacatgtcgtccgtgggggaaacacaggagagtcccaggcaactcctgattctcgtccaaactgccctcgtgtactcgcaagcgtggaacatatgggcacatgattcagcatccttcccgcaaaggtgacagtatggagccaagtgccatcctcgccgctggaggttgtccgccgttaggcatgctccacgtatggcaaggaacatgaagaacttgcaacgggtcggcgcgcgagacttccaaatcagcttcccaaccgccgagcgtgtcttcccagtgcagaggagtgaataggctgattttactgagaaaccaccatctgtggcaggcttccaagaaaacaaatcaggctgagtagggttcaaggaaacggtggcaacaaggtcccagatttggaggtattcaaacatcgcttacagtgaaagacctcccctgatgtcgccggtccaggcatcatcctgcagcgccgaatgaaccgttctgcctctgtttttaacaaaggaacacaggattggggctcggttcaggatcgaccccccatctgggagccagtcatctgtccagaagaaggaactcttcccgtcacccagcacaatcctgcatccggccgctagacaatgttcggctttcctatcttgcggcaatgtgaaggacacccagtggcgctccggctagacacgccgcagccaaagccaccgcgtccgaagggcaatgcccattctgccaagattgatgatgcccaacccgccattttcgatcggcagacagagcttatcccaagcaactaggttgcatccacccagtgcatcctcatcccccttccacaagaaaccaagaaaccgtggtctcttgttcacatactcttcagtggttgtcttttgtaacttccattgcagggaaaacttctactactattcataatgcaatacctaagtaaagatcaacaaagtatatcacttccaatacaagattgcagaagttcctttacagccaagaaaaactgttgttcaagtaatattcagaaatttgatttctcctacatttaggagtcaaggaagagaagaagataagatattagataatacatcaagaacatgacccaacaacagtttagtcattacaatgctccataatgtttattagccaatagataagataatacatgacccgatagcttctttctaattgtcttgtggtgtatcctaacgtggttcatgtctaaacaatcacaataaacacaaagttcaggcgttcagcagaacagagtggttggtcggccaatataaaccacaaaacacgattagtttttagattatcaatcttgtggttatcatttcacgccacccataatattgtagtgaacatttaggactgtccatcaagtcattacagtcacctgttgtgtgtataaaagggggcctgaagaagggctttacctgcatcagtgtgatcaaccatctcctttgaagtcctagcctaaaagctcttctactcgcataaagaaagatggtgaagcttgcatttggaagctgcggcgactctttcagtgcctcgtccatcaaggcctatgtcgcggagttcattgccacactcctctttgtgttcgccggcgtcggctccgccattgcctacggtgagctccttatttatgtttcaaaaaacttccatcccaactctgcttgtaccacttagcacagtgatcattctatgtttctcatctaaatctttgttgtgcagggcaactgacaaagggcggcgcgctagacccagctggtctggtggcgatcgccatagcccatgccttcgcgctgttcgtcggagtttccatggccgccaacatctccggtggccacttgaaccccgttgtcaccttcggcctcgccgtcggtggccacatcaccatcctcaccggcatcttctactgggtcgctcagctgctcggcgcgtccgtcgcgtgtctgctctgcagttctccacccacggacaggttggtttccatcatgctgccacgttgttgtgctttgtacttcgcacttgagctaagtgaatcgggcttgctaattcgcaggctatcccgacgcacgccatcgccggaattagcgagatcgagggcatggtgatggagattgtgatcacgttcgcgctggtgtacacggtgtacgccacggcggccgacccgaagaagggttccctcggcaccgtcgcgcccatggccatcggcttcatcgtcggtgccaacatcctggcggcggggccctttagcggcagttccatgaaccctgcccgctccttcggcccggccgtcgcggccggcaacttcgccggcaactgggtgtactgggtcggcccactgatcggtggtggcctggccgggctcgtctacgacgacgtgttcatcgcctcctaccagccggtcggccagcaggaatacccatgaagatcatcgaatccgaaccgtcgctgctgttgattccaatttccatccatgtcacgtctcgcttccttttgtatatggtcttcccgtttccttcctttttcgtttttggttttgaacacaaattctcgtgaagaagatgtaagatcaatgtgtgttttaattcttattctgtgatgaacaattggcatctgtgattattggttttgatatttggagattatcgtcgaagttgttttggagataatcaattttcaggtgatgatcggattcactgttattttatgtgaccggtctgaccaggctgtgtatgccggtcagaccagcggtgatcgagcggtcagaccggccggcccgcggtctgaccggccgacgctgtgtcggtttcggtttcgggttgtttctttggatatccgtgattgtttcatggttatggcttctagatggatactatacgtatgtaatactgttgtttgctaacaatgagtcaagttggtgatagcttggtctcggaatatagtttctttatttgtttcatgtgtaggtgactcgatgcctagggagagtatttgcggtgatggaccgggagtcggcttggtggtaagacgatgtccgtggtggtcagatattatgcgggatactaaggctagagttgatgcacgtggttggtgaagattccatatggcatacgatggaggtattgtgtgcgtttgggatgcggagtcgaatttggaaggagtccaaatttggtacaattggttatgtaaagtttgtgtcttgtactagagagtttcctaaggtgtttaggactcttagtatgagtttggttcgtggctttaggctgcctacctcatgtataaatagagggggagcgtgaggcttcccggtatcgcttttgtattgcttttgagagcaattgagttgctagtttagttagggtttcgagtttggtcaaaatttttataaggagtgctgttggtgcactttgtaaacacagagagaatcaataaagttgtcatctattttaagagttcttcgatttgtgtttcaccgggtttcggcggtctaaccggcaactcaccggcggtcagatcgacggcattgcggtggtcagaccggcgggagtacggcagtcagaccggcagcagcgacagcgagcggcaggcgacttcggcggttcgaccaatcgttctacatcggtcagaccggtggcatccactcggtcagaccaacagattaatctcggtcagaccgatctccgtctatttcgagggtaacttttatttccgctaaaagtttttggtttttgggtataccaaccattaacccccctctggttggcttagttcttgtgattcgatcctacaagtggtatcagagctttttttgcttctttggattttaaccgatctagagtttttgccatggctgcttctaataagttttcaactaagcctcatgttttcgatggaacggatttttctcattggtgtagtaggatgcaatcttacattatggctgagaattatgatatttggagaaaagtttctcttccttatgtgattcctgaagttattaatactgctgctgaaaaaattgcttttgaactgaattgcaaagctcgcaatattcttttgagtgggatttcttgttcggattatgatcgtgttgctcatcttcaaactgctcatgagatttgggttgctttgaataattttcatcaaggtacaaataacattaaagaatttcgtcgtgatcttttcaaaaaggagtacattaaatttgagatgaaacctggagaagctttggatgactatctttctaggtttaataaaattttgagtgatcttagatctgttgattcttcttatgatgctaattatccacaatctgagatttctcgtcactttttgaatggtcttgacatgtctatttgggagatgaaagttacttctattcaggagtccgtgaacatgtctactttgactttggattcgctttacacaaaactgaaaactcatgagatgaatattctttctcgtaaaggtgattctaagtctagtgctttggtttcgtcttcaacttctttggatgttggtgcttcttcatcgaagtcttctgttcttgctttatttaatgccatgtccgatgatcaactcgaacagttcgaggaggaggacttggttttgctatctaacaaattttctcgagctatgaaaaatgttagaaacaggaaaagaggagaaccaaatcattgttttgagtgtggtgcacttgatcatcttcgctcgcattgtcctaagcttgggagaggcaagaaggaagatgatggtagagtcaaagaggatgacgtgaacaagaagaagaacatgaaggagaaggagaagaagaagcattgtatcaagtggttaatccaaaaactcataaaagtttttgatgaatcggaagatgaagatgagagcaaaggtaagcaagttgttgatttagtttttattgctcgtaatgcaagttctgatgttgatgaatctgatgatgataatgaagaaaagcttagttatgatcaactagaatatgctgcttacaaatttggtaagaaacttcaaacatgttctattgtgcttgatgagaaggatcatactattgagattcttaatgctgaaattgctagattaaaatttttgattcctaatgatgataattgtcaatcttgtgaagttttattttctgaaattagtgctttgcgatatgtcaattctgttaattgcaagaaattggaatttgaaattgaaaaatctaaaaagttggaatcttcttttgctcttggatttgctttacttgctcgtgttgttgatgagttgattttgacaaagaatgttttgaaaaaaatacaaagtggctttttgtgcaagttctttagtcaatgtttcatgtgcaaataaggcaaaacaaaacgatggtgttttgatttctcaagattgttcaaagatgacggagcgtggggctcctcaccgggagaccgcgcgggcccccctttgctggttcggccgggggcgctaggtgagattctaagccctcgatttgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagagaccctctcactctttctctcctctacgagctccgctcttccttttacgagctctccttcttttcttctccctttcttctctctttttcctccagtcccctctcttggtaggcatggtcctccttttatatctcaaggggataccacatacaccatttctacctacccttcttttgggtggggacccatcctactttgaccaaaacttggctcgtaccttcgcctgacaccgggataaccctgtccttccttcattaatgggcggagatttgcaatggctgctgtccgaatgaccctccgatgggatgggtcataccaacctccactccgccggaagcaggtgcaacgtgggagcacggttatttgctgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgagaccgatgtgctaactccaggagttcccacgccggctccgtctagggacgagtgcctagaggctctcatcattccgacgggacggagcgaggcgtgcgacaggccgcctgttgccacctaacccgcgatctgaccggtctgtgaccggtcacataccgcgactggtcacagaccggataagcatgcgctgcgccgcattgaatgcggcgtgacgcgctcgtctaacccgctataaatgtggttaggtgagggccgctttgctcacctaacccacacacgtggcgccgacgccacagggggtcggggcgccccagccctcggggccgaaacgggagcggccgacccctcggggagacagagggaggggtggccatgtcaccgttgggcccgacccccccgagggggtcgggccacgtgagtgatcgcggctacccaagcctctagtcacgatacccctggccccatgtcaccgacagtagccgccggcgtcacgctagggcgaccgcccccctcgagggaggcgatcgggcgagatgccactccttaggcccggtgacaggtggggccggtccccacaggcgggcagaaacccaacggtcgcaaatcgcgcgcatcggcaagggagaaaccgatcgacaataatgagcgggctcttcaagaccgctacattacttgagtagcgcgcgaatcgggacgaaccggttcgtttcgcctagagatgtgatgatggtgcatcggtcggcgagcgtagttaacgcgcgcacgatatgtcccatctcgactgccacggccgcacatccgcctcgtgcgccgcaaacgggcgaacgggattagtggaggagtgggcgcgagaaacgagggggcgagatagtgggcgcgggaagcgaggagccgggcatagcgttggcaagggtataaagacgccgaggaagagattcgtttccttcctcttcgccattattccccttgccttcgccgcttgcgctctaacttctcgtttcctgtgccctaccctcgccgcactcactcgctctcaaacccctcctccgccggtgtcatggcacggggctccgcaccgctcgacggtagcgtgctgccgccttctcgcatcgtgagcgagaggcaagccgggctgccgcgccgattcatgccggaatctgccaccggccaggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtctgcgatcccaggggctcacgggggccatggtgtacggcgattaccttcgtcgccggatcgcgccgctccagcggcgcgcccggggcgcctgggagtacaccgggtccgaggactacatgaggacccaccagggggtcaaatgggactgggtccctgaagacttcaaggtggtgatccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggagtcgtgcttctgggccccgtgacgggggcccggggggcagccgccctgccgacgcccgggggaagaggaaacaggaggataccccctccccatctcctccccgagggggcggggtggtgcgtgccagcagcaggcgcccggagggtgctgtgccgacgtcgtagcccgagggggagcgaaaaaagaagcggctccgcaagataggggggaccgaaccatgccggggaaagctcatctccccccaaggtggtcgtttagccgacctcctcgcaggttcatccccgcgcccactgcggccgtattcattctcccatctcccaaggcaagttttcactcacccgtttttcgtcttctggtttttcttctgcctcagcgagatcccgtcgcgcccttcccgccattccaagtctggccggtctgaggccgaggagacggcgaccacggaggcccggaggcgggaagctgaccggcgagaagccgcaaaccgcctccgggaagccgaggaagctgcccaggaggctgtccgggctcgccaggctgaggaagccgcttgggaagaggccagactccgacgaggagggcggtgacggtggtgcggacgacagcgatgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcagctctgtttgttgtgtgtatgagatgaggatggtctgtgccgcggtccttctgtgtcttggcttgaacgagggctcgtgcccaggtcccagcctcaaatggcgcgggtcggggctagtgcctggggagatccgtgtgtcgagactggccaggccgggaacgtggtgaccgaggattatggatgacccgattgtgggcctttgccgattcccccccggagttcaccacgccccggggcacggctcggttctgggccccgtttggcgattttagccggcccgggccaccgagggcaggatcgagcacgagcgtgctaattcaagccaagattcttcgaaaggaaacaatggcacagacacagtccttaggaaatcgaaaatgcttttattgaaatacggaagagaaaaaagataaggatatgcatgtggtagcccccggccaactctgcacgcctgggagggcgcggggttggcccgagcccgagacctgacacctgacccctactaggggtagaagcgacgaaggtgttcgatgttccacggattaggcagctctgtgccgtcggccgtggccagccgaacggagcccggccgggggacgccgatcactcgatacggaccctcccacattggtgagagtttgctcagtccagcacgcgtttggacgcggcgtagtacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcaaagctgatcttgatcggcctcgcagtacatggtggcccgaggggacctcagggtgagctcgaatgggagaactgcctccgcgccgtagacgaggaagaaaggcgtttccccggttgctcggcttggcgtggttcggttcgcccagagcaccgctggtaactcctcgatccacgagtcgccgtgcttcttgaggatattgaaggttttggttttgaggcccttgaggatttctgcgttggcgcgctccacttggccattgcttctggggtgggcgggagaggcgaagcagagcttgatgcccatatcttcgcagtagtcaccgaagagttcactagtgaactgggtgccgttatccgtaatgatacgattaggcaccccaaaccgagcagtaatgcccctgatgaatttaagcgcggtgtgcttatcgatcttgatgaccgggtaagcctcgggccacttagtgaacttgtcgacagcgacatacagatactcgaaaccgcccggggcccgcctaaacggacccaggatatcgagcccccagacagcaaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccagccaaggtgcgtgaggcggagtgggctccgcactcgccttcatggatatcggcaagaagctcgacgccttgttcctgaggaatgcacttcaggaggactccgttagccgcgcgccgatagagggtcccttccaccagcacgtagcgcttggagatgcgctggacgcgttcactcccttcgcggtcctcgggtagagtcttatctgtgaggtacgcctagatctcagtgatccaagcaatcaatctaagggagctgggagcgctcccctcgggtcccgaggcctggactccgacgggcctcgggggccgttcaggcgcgtccgtctcctctagggggtcgggccgcgccgatggctgggcaagcctttcttcaaaggcgcccggtggggtctgggctcgcgaggaagcgagcctcgagagttcgtcggcgaccgcgttatcccgtctgggcacgtgccgaagctctattccgtcaaattggcgctccatacgccgcacttggcgcacgtaagcgtctatctgcgggtcagagcaccggtactccttacagacctggttaacgaccagctgggagtcgcctaacaccaggaggcggcggatccccagtccagctgccaccctgagtcccgcaaggagtccctcgtactccgccatattattggtcgcccggaagtcgaggcgaaccaggtatctgaggacgtctccgtttggcgaggttaacgtgacccccgcaccggcgccctgaagagatagggagccgtcgaactgcatcacccagtaggcggtgggaggcagctgcgaggggcccgagctggtctcggggacggagatgggctcaggggccggggtccactctgccacaaagttggcgagggcctggctcttgatcgcgtggcgtggttcaaagtgcaaatcaaactcagagagttcgattgcccatttcaccacccgtccagtaccctctcggttatgcaagatttggccgaggggataagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagtagacgggccgctgcacctttcggcggggccgatcctcttcgctaggggccgcatctccagggcgctcttcgtccgagaggtcgtgcggggcgcactcggcttctgtgccgacgacctcggggtcggagggcgacaggcgcggccttcccgcagtggccccggggccatcctgggggtcgggggcgcctggcaccgtctgacaagcaggcggagggccagctccggccgtcgggggcctcgggccgccgttcggctcgggggcctctcctccctgctctctcccgggtcgagtcgacacagggtggggatgcgcggggtgagggttgtcctcgtcgtgctccacaaccaacgccgcgctgaccacctgcggggttgccgccaggtaaagtagcagcggctcatctggctccggggcgaccaggactgggggagaactgaggtacgccttcaactgagtgaaggcccgctcagcctcctccgtccagataaacggcccggagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgag

SEQ ID NO: 74919 - DNA, 13271 bp, Oryza sativa
ccttcaacactaggatattctgctcagatctctctcacccacgctccgaactcgattaaccaggagaaggcaagttgccttttcgcgggattcaattccgaagaatagatcccaatccttccctggaattttacaaccaagccaagagaattttggggcgaaagggctctgataccagaaattgtcagcgtcaccagatggactcaacacaactaaggaaaatgaaaaggaaaagtggaagaactcgaacaactcaggaagaacagagatgtgtttaggcaatcttttactaggataatcttgctccaacccaacagggttgagccgccgccgccattcgccaccagattgccaaaagtcccttacaatttagaaacctcagttcttatactctctctcgctaccaactcccttccttcccctctcacaagacagatgccagctcatgccagcgatacaggttacatggcccattccggcccaacatatttacgattaggcctaatgactctggccggcctcaagtcttcttctcctccttcctgctcaccatccggcacaggcttcatcttcagcttggcgcttgcactcggctcctcctcgcctgacgccttgacactcacatcgcaaagctaattaggttattgatcaaacgaatgtatcagccaaaaaaatagagaaaaacattcactcctgaattcacgctagaatttcaaaatcaccgtccatgatccatgtgaatttctagcacgttgcacaagctgaattcaaaacaatttggtcctgtttgctgcatatgcaagggttattctgatttcatctgtatgactgtatggggcttcttttagatagtgaaaagaattccggcatttgctttaaagatgctatagccacttattacataattcacagcttataaaaaccaagaaatgactagacaataactaatgataccaacacaagacatttattcaagtctgtttgtaaatcttcattcgaagttggcaaatatctacatgatcgttgtctctaggttccggcacacagtatgtactgtcctcattacacctttatatttgtgctcagaactgaagccagtatgttacctgaatagtatctgcatataagatttcattggggatttgtcaaagaccatatcatttatgcatacaagatacacacagtggtgctcgggagggttatgatgggttagagctgagggagaaggatcccgaggtagtggcgaaggataggctcggggagctgatgcagatggggctgcatgagtataatcagcggcggcatgcagagaatttggaggagaaaaggagaaaggaggagaggtgagattgagataaaggaggaggacgacgatgaggaagcagcgcggttggatagtgctaagaatagggaagagggaagagagaagttttacaaggtgttgtttagtgatgaattagggatggaaatttcggttcacaattttggaaatttgaaccgaaatttcgggaatttcgtcccccatccggcaagcaattattttaagtgaaattttcagttttttttttcaaatatttgtgaatttgatcataatttcttcaaatttagtaaatatgtgctaaaatttcgtttgaaatatccgaaatttcggaatttcattgcccaccaaaattaccttactttttgaaagggaaaaccctagtgatgataaccgctgataagtttgtgtggagttttgtttgtgatccatttcatcttattgaatttattcatttgaagagtattcaacacttttgcacttcataatcaatcaaattgattactgatggatgtgatgggagttgcattgctacaaaggcattaggcatctgtctgcatgggaagatggtcctattgagttcatgacctgcaaatgttcaaggatatttgattcaataactgcttggatgccaccagatagtttggtattggcagattataaccatcaaacctttatgcggatacttctagcataatgactacatgaaattctagtgtgaaaggattgctgcaaagacttgacaaaagaaattagtgatgtaatgcatatgatcaaaataaattctatgagttctacaggtgagatgctgatgcagagttggggtttagtcaccatggcatggagaaaggaattcagaacccatatgaactgttgagaagatgcaattgcaggtctcaaagtaagcacatcaagactgttgatctttcaaccttttgtggtgtttgttatgtttagcagacatcttccgattgagaattggaacatcacagagggtggactaaagtcagagattaactacaaagcaatttacaatgcaacctgtggtgcccaattcacaatcacagaatatgtgttgcctgctgatcttggaacataaatggaactccaaataggatgtgtttcggtacaactagtaaggtttatgaatcttcaagcgaagtatttgacatttggttggggaaaatctatgttaatcccccaaaataaatgaaatgaaatcttttaattctgatatccagtttattttgtattttatgtatacatatttagtagtagctagtactaatcgcatcccctgacgataatggacgcatgctaaagcaaagctcgaaattcatggagtaatgaaatgtatatgaaatttaacagtctgagaaccaaatatctagcaaaggtcatgaatgtgccttttttttcccttgttgaatggcatggcaactttgggaattttgggaaatgatgatagaaagccactgaaaagaaagtgccaatcttcactaacataaaattctttattttccttttttgtagaacttgggaaacattggtaaatgaatattaatagaaagcaattgaagaaaaagtgctcatagttgcacaaagcaaatgttggagctatacatgtcctaaaatcacattctttgctttcgtggtggtttcatgccttgtacacacccaaccatcttgttgctaccttcccatcctgtaaaaatataatgatcaagatcatgattagtcatgaacatctgtctttgtgaacatccacttcttttttcttccctgtttttgtgttctttcagtaagaattgggagggagcaagaagacctttggacatgttgaagccgcgtttttcgagctccttgtattcttggcatagcgcacaactatcgcagaagaagtggacgcagcagtccaagcagggcgactgttgcaagttgtactgtgcccgcattgaggatcgtttggtacaagcatacagccattggcagcctattgtcgccagcaaaacatacaaggtcccgtgcatgcagcacgctggaaacagggagagtcagcatacaagattgatggttttctgtgcttgaaccaaagcgcgaagtgataagttaatatgcctacatgttgagcctttgtccacaatctcagcaatgcgaccgaacgtaatgcaggggcaccagcaagtcaagcagcctgtgtagttacaaaagaaatgaaatcatacatgaagaattggaaacccatgtataagaggtgcaagaacaactgagaaacagctttgcatacaggttccgctatctccaaagcagtcgaagagcttaactgaccactccccagacatgctgttagtattgctgattgagaatctgtgatataaggtaggaggattgactgagatctgtgtctcaaggtaatatacaagcgttatacctgtgtagtttgagcagttggtacctttgatcctgctgctatttatatggctgtggcattgcagtgccttgatgtagaacatgtcaaattcagagccagcagtttatgttattttgctggttttcgctttcctatcacacggggtgatgtacgcttagtgttgtgtttgtatgtgtctttgaactggtatttctgagaatccaacgttcaattggcatgttctgctttgaatcgttctatctgagaacactatgctcgatcagcatctggcagcatttggaccttccatggcttgttagtctttgatttcttgtctatcatatatattgggtggatgtgaaaaatggaagctgttcagtgttcacctttcctgacagcctgtgttttcacattggaaaagtctggaacaaaaccttcacaaagatgttgtctcgtgatatataccctttgatgaaaggggcaaaattgttcgtcaatcttctttacgtccaaattcaaagtgagtaggatgatcaccgcacaaagcacctgatgtaatcccaattaatagtagtatggaagatgcactgacaaagtttagcttaaaaaccacaaattgcccaagtaaaagtcaacgtctagtagaatctgttatagtctccgttaggtagaattaacaatactccaccatttttgggctgcagctaaacacccaaaccttcttgggaaccaaacaggactaaagtaaaaggatttttttttttcactcagttttttcacatgaatccacctgaggtttactcatgacatgacatctcatcacacaagctagtactctctctgtttcaccgtttcagattataagtcgttttgactttgatcaaaatcaaactattttaaatttaattaagtttgtagaaaaaaaactgtaatatttttaacccaaaataaatatattaagaaaatatacttaattattgatctaataaaactaatttggttttataaatattactatatttgtctacaaacttagttaaatttaaagtagtttgattttgattaaagtcaaaacgacttataatctaaaacggacgtagtagcagctgctactctactcataaccaaaagcaaaccacacaccacacaccacatcaccactggtcaaaaccctgtttggaaaacgcaggaacagaacagagcaaaggattcccgcggaaaaccacgatatcaaccatttcaacctgggacgtgcaggggacacacacacacagagctgatcagatcatcagagagccagtacagtacaagaagcagagagccttgacggcgagcttcatgccggcgtcgcagtggcccggcatgccgcagatgaagtagttgttccctcgccggagcgtcacctggtcgtacccggtccgcagcaccgccgtgtccttgttcctcggcaccttgcaccgccggtaccccttgccgccgaccaccgccacgtcgtggtactccttgttgtacttgaacactgcatagccatgagtcagtcatgtaccctatttcgttgagtttaaaattgagaaataactaattggttgtcagtttctaagaacttgtaaaggttgtgaaacctaacttctagttactaattccttttccgaattctgtattggataaaaaagagatttgcttcggtccaataaaaagtatatcgaggtaccgatacctcacggtattaaatcgtttctgatcgttgcatctagctgggtaggatgggtattgttagatccaacgatcggaaatgatttggttccgtgagatatcggtacctcgagatactttttattggaccggagcaagtcacggataaaaaactactctatatatttaggagagtttttaattctgaaagaagatgcaactatcagaagcttctcgaaacatacgtacaatcacacaccaatggatctatgcatgaagctttgacattaacttgtgcacttaccgagcacgtcgccggcgtagaaggtcttgccggcgagccaccagtcgaggttgcggccccacccggcggcgtcgcccacgtagtacgtcttgccgccggcctcggcggcggggacggcctccatcagcagcgccgccgccacaaggcacaggagcaccacgccgccgccgccgcttgcactgcctcttccccggcgagccgccgccaccgccattttctcgctcgctcaaatcaaacgagattacaaaggagatcaccagtttagcttttagcacagttttgcacggtgtgtgtgtgtcttctgactcgtgtggtggcgtatatatagcccgcgaaatcgacgcagtgcagcacgtgctggcacgtcgagagcacgcatagcggcagcagagatgaagcttcttccgtggaagcaggactcttcgatcccggaatacaagaatattaatcctgggaaaccaaaatttcaaacaaaaagaaacacagaaaatatttttaaaaaataaaaagagaaaacatttccgtgaatcaaaataaattttgaattgaaattgagcccagtgtgaaagtatggaaaactgaagatccgtttgaaacacagaattttacagggaacggctgaaatgttgtaaactgctcccttcgtctcagaataaagcaacctacaatcagatgggacatatcctagtatcgtcctataataccaaaaacgtgaactttcgatgctatataaccaattttgccaataataaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgttgctcctgcctgccatttcgtcgctgctggtgacatgtgggtggcacgtttgagtatatagctaggttatgtatttaaaaccaccatgaattaatatatagacctagcagtagcacaatggggattggatttaaataaccaattcaaaggtcttacgatgtaaatatatttattctccccaccgcaagtcgtttctataaatgatttttgtgggggtatggatcaattgttgtataagggaagcattttgtaaaaaaaaaaaagagtgcaaacgtttcgcttatatttattcgttcagcttattagcaaaaaaaaataatattcgtgaataaactgttatattggtgtctttaacgatttattaaaaataagtgctataaaattaagtcccagaaattaaattttgacatataaatataagataaggctggaatctcattttcccacggtgattggagcagatacattcaccattcgtgcaagtgcatcatgccctcagatgtgccaagtcctcttcaattctattatatcatcagtaggataagtggcaaagccaggaatttaagcctgtggggtcaattactagtggtttgtatttaagtgaggtcatgtatctaaattcttttggattcatacatgaaaattaaggtttataggattttttttttcaaaaagctatgggtcagccaaccccacagaagaggcctaaatccgccactgaggcagatctaattgctagcagatttaactatttgccgtttaatttgatgtttaactacatgtgtcaataatttatgagccttcatatacctacaatatatagattcagtggtaaatagttatttgctacatccacgacgggcgaatagtctcatatttaaatatatcctaattgcttgcgatatcgactgcctggatgataagatttgaggaaagagaataaaagagagataaaactgggacacatacgaccaatgttgtcagtatcccgatcgtaaaatggtatcttatggtaatttttttttacacgggatgaagatgaattgaggggaaaaaaggagatgaactaaaagtattgagaaaatcagcatatgtctcttttgttgagaggaagagtagggaagtaaagcagagtttggttctagattttcgatgggctcagttcacctactatccctctactttacgttgagtctgtctaacatcccttatgtccaatactagaaatccccccccccccactatacgaaaccgtgtagaataggttctatggcagtataaataaatggttccgttgacgtgacatcctaatcagtaaagaggaaataaaaaaattatggggcccacatgtcatcctcactccttccacttctctctatcttctctctcgcatgccatgagcagggcaagcggggcggtgtcgctgtgtcgagcgaagcagcggcgcacaaagctggcaggcggcgggcggagcgctgtggcgggggtggagtgtagaggacggcagcgaacgccatagaggaggatggcgcagcggacggaaacgcaatgggtgaagaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgatcccgtgtaattagcaaaacatgcatatttatttgcaaacagtaaaacatttgtaaattaggatcaacatgctcaaggggaatgtgtgacttgccttgcttcctcactttgatcttccgaactcttttcctcgcgaccgcggacttccgaaacgacggattctacacgctggcacgcaaaacgaggaaaaactctaataaagaccaaggaaacagtacataaaaactaaacaaacatgtagacctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcgccggcgccgacacgcgggccccacacgtcagtgagcaaaggggacaggcgcacggtggacacggtccaccgcagcctcgggcgcacgtccaccatttggacggcccagatcggcccgagctgatcgggcggccgaggggagcggcggccaggggcactggcgcgacacaaagccggcccggccgagccaaggcgcggcggcggcatgcagccaccggcggcagcagccggcgacgcggaacgacggcgggcagccggaggacagcggcccgcacaggggacggcgatgcacctcaagaggcggcagccggcaagaaagggtgacgggaaaaaaaaaggggagggaggagaggtcctcaccgaaaacggcggccgacgcggaggaagatgacgacgacgacgattgcccgatggcggctggcgaggacggagggcgaacgaggtcgcccttgacctgcggaaggagaagagggagttaggttggggagaaccgatgcggggtgactagaaatgaaggccgatggcgacgacgagaggtggggctcaccggcgaacttagaggatgagttggagcggcggaagacgacgaccaagcagcggacgaggtgagggcgagcactgcgaacgcgccagaggcagcagcacggccgggcgaggtccccctcaccggcaaggagcggctggagcgctgtggaagcggaggtagctcggctccgcggtgggagggggttccggtggtgaatgggagggatgaggcggcggccaggcttgcccttgtggcgtcgaagccggcggtggatgcggcgcagcacggcagcggcgggaccggcggtagcgcgcggctggagggcaccgacggtggtggagctcggggtcgacggtggaagcagtgctcgggctaccaaataaaggggtggtgcggcggccgaggcgtggcactacgcggtgcagcttttggtggcggtggcgcagcgcggttgcgacaggaacagcggtggcgggcggctggagttcgccggggagcggcggagagagggagcacggtggggaggtggctaggaggcgcggggtgctcggggagaggggaaaacggatgaggggaggcacgtgagtcgtttatataggtcccggagggggagaacgtggccgggagaggcggatttgaagggggaaaaggcgccggcgacgtgggcgagtggcggagcaaaccggcgccggtttttgggggaaatgggggaggagagtggaggaggtggaggggatgcggttgctctcagttcggatgcgagcgcgtgaacgggaggacgcgaaaacggcggcatcgtgggcggcaatggcggccacgagcggctgctggctgggatggagggaggttggggatgacaggcggggcccatgggtcccacacgtcggctggagagagaggagggaaactggggaggcaaagcagacttccctcaaggcctgagccggcctagagatggaggaggcgcgcggcccgggaagggggaggggattttgggccaagcccgaagggaggagagggaaattatttggttttctttttatttaattgattaaatgatcttcgtgactttaaactatttctcgagctccgaaaattcacggaaaattatggagagtacattagggcacaaagaatattacaaaatattcccggccaataatttttaaaggaaattttaatttcctctattaattcacttgaataaattgcttaactttttatttaatttctaggaaatgcattatcaaatgatttttaatcccgaacgaaaatcggggcgttacagtcggcctcctatcccccttctcctgccggcgcggccggcggcctctcccatttctccagtcgatgcggccggccgcctctcctcctattctcacaggcgcggccagcgcggccggcctcctctctcccttctcccgccggcacggccggcgacctctcccctttctcccgctgatgcggccggctgcctctcccgccgacgcccccctctcctgccagctgtcccgggctggaagaaaagaaagacgattggctgacatgcggaccccacatttttcttctatcacttacatatggacccccacaatttttttattccctctttgcggattaggatgccacgttagtaaaaccatctattatactgccataggacctattctacatgatttcgtatagtttagggggggagatttctggtattggacataagggatgttttacagactcgacataaagttgagggacggtaggtgaacttattcctcgtaggaatcgtgcaagctgggaataagttcactttgtgaccctcaaaagtgattgaaatctaatccgtgaccctaaaccacaaaaccggatatcttgacccccaaactatgaaaaccggtgcaatttgactccctcagcggttttggagggcggtttcgctgacgtggcggtattgaccaggtcttctttacacgtggcgttgatgtggcgcttaggtggcatttcaattaaaaagttatacgtgggactcatttgtcattcacacacaattgtggggc

SEQ ID NO: 74920 - DNA, 32845 bp, Oryza sativa
tctccactgcatctttcctctcccactcattttattcactccacaccttttcccacttctcttctgcattcctctcctcatctcttccccttccgtatccccattctcttctctggcggcaagcgggcggcgacggatctaacaccgctgccctcggccccaagaaaggcaatgaagatggtgggcagcgacggtggagttcgagggtggctgatccgtcgtagccatcctcggccctagagaggcgatgaagatgttgggcagcgacgtcggagctggaggatggcaaatctggcgctgctgcccctaggcctagggaggggcgatgaagacggcaggtggcgacggtggagctcgagagcggcaaatctggcgccaccaccctcaaccccaggaggggcgacgacgagcccgagtgcaacagaagctagggtttcagcggaattttctttttggtattctttaaccaaaattatttttacagtcggtcggcttaagcgttcgtatgcgaaaataccgaatttaatttgcatgcggttgctatacccgcatataaaattatcgattttcgcagacacctaggtgcaagtgggccacccatgcacctatgaaaattgatctttttttagaaacacattacaaatgcaagcacccaacacccacacagtcatctctatgaacgtgcacacacacattacctctataagcatatccgaaagactataccggcatatctatcgattctatagttatatgcgaaaatcttttatgtagtagtgcttataatcgattctactatcagtatcccatattatcatctttcaaattaaaatggagtatttcacaactgtagcaaccgtattatttcacaccacacgcgttcggtgtgccgcgtactaaaactcttttttcagagatcacgcggcattattgatcgttctctcactggtttaatttcgtcgtaattgcgacatgacaggagtatttgtcagcaactagtattgaaaaagaagagcgcctaaaagaatctgtggcgagcgctgagtgctgcaaaaacatcatcatgagcaatctccatctaaagcgcaaacaaaccacaaattaatcactttttaaaaaaataggatagaggggttatttgagaggtcaagaatccgaaaaactaggtttctcaaattctaggttctaatttgttttatttgttttatggattctaatttttaaagtttactccatccgtcccaaaacagacaaactctagttatttatctggatatacatcatgtccagttacgtagctagagttttttttttttaagacgaaggggtagtgataattttaactgtttaaaaaggtttctgacagctagaaattctgaaagaaggatagaggtgtcagaatgttccaaacagggcaaaaatagaatatgcactgagccgaggggaaaatcagataaattaagagaaaaatagaatatgcactaagccgagggggaaatcagataaattacgggctcccacgtggacgttccgtaaacgacaattcgcgtgcggcactgcggcccaccaccacgtcagatacgtactgatattttcaagcggagtagagtatacgcatgatgctaaaatctattcagtatacgctttctatttttttaaaagagttaaacagtacaacatatacactcaaaacacacgcacactaacccctataaacgtatgcacgcaaatcctacccctatgagcatcttcgaagactgggccgacaaatcctcgagattgataaagtcatcacagacgcctcgttatcgacggatccatctcctaccactgaaaccacaaagctgttaaatcctaaaaaattcgctcccatggagagtcgaacccaggacctaaggggaaaatttgctcccatgagtatacgctttttatttcatcttatttagataccctttcataagtccgatcagttaatgatgattgaggtacaaacacgtgaatattatatagataaacaagatcacttgcgagaaaaagagaaccacatgctatctattactacctccatcctagaatataagcatttttagagttgggcacggttattaagaaagtaggtagaagtgaatgatggagggtggtgattggttgagtagtggaggtaagttgaaaaagtgaatggtggaaggttataattcgttgggaaaagaatgttggtggagaagttatattttaggataaatcttgaatgctaaaaagttattatattttgggacggagggagtagttgtcatgttgattcacgtgcatgttagagcaggtacaatagtaagctataagccagctataaccacatatccagaagaaaagagaagagatagaagaaagcgggctacagatttgtagtcagctgcagtacggactctaagatgttatgtgtgtatgagaggtgggaccaggtattaatggtatagcatgattttatagtcaactattgtatgaatgagctattagattaactatagacgatttagagtaaatatttagctatcctattaaacttgctcttacgaggctaacatatcgttacactagcacattttccttttatagaatctttgatgacttatattttttttatagacagtatattatttgtaagattcgtttgaactgtcctatttcacttaaaatatgtaacaaataagtctaatattgaatatattcaaattaatttttttttctgaactgttctcgctggatagttaaagagttacttcctcagtgtcgttactttcaacgccgtgataagttaattctctagcaatacagttatttctaataccttaaatagttatttatgttttatgtttcttagttactttcctctagaagtgtatttacttataatattatgaagagttccgtctatttttcaaaaagttaatttcatccagtagcgtagttacttttaatataatgaaggattactttttatataacgtaagatttgattttttctaaaataatacagtgattactttaaataaagttggacatcttctctacactttagttgtaagtttattccacatagttttgtattccaactcagtcgtaatgtaattacttctaatgctatagagagttacttctattgcatagctaggttacttctacaatttaaataaattacttttaagttaataaaatgtttgaatatatttaacattgatcttgttttatctcatattttaagtggagtacaatgaagcaaatagattttaaaaataatatataatttaagagatactccctccgttctaaaatataaggcacaaccacccttaactcaaagaccaagaaacaattattatcatctcctagtttgaatcactctaataaatataatgcatacatctaatagaattagagatcttgaggatggaggatttaaaaaagtaataatttaatggagaaaaggtcctaattaattatatgcatgcatgtatatcttatattatgaaacatcttaaaaaaaatagttgtgccttatattatggaacggagagagtacaagttatcaaataggtaagaaaaaaaatacaatttagctaaggagatttatacgtggaggaagtgatcgcggctttaatcaaaccaacgaccgatcgttgtgtagtcgtgttcgaagcagcatcagctatctttcatatacggtacaaatttaagccgccttttgaaggctaaagccctgcaaaaatcgttttgtatagtgtcagtcggatatcttgggcccattgggccacgtctgcgcgagggcgaccggccgcgtcagcgtgagtcggctgacgctgacgtgtccgcacgcctgattcttggtctaactcatgtccggtgattaaggttaatctctagatatatcatctgtttacgtaatatccttcattcacagatataaaaaatattacaaattaggatgggttggatttgactctttctacgataacgaacctgaatataatcagtttaggacttggtcaaatcctattatagattgtaatttttggagaaaaaaaaagtaagtactccctacgtttctaaatcttttaacaccgttgacttttttaaatatgtttaaccgttcattttattaaaaaaatttaagtaattattaatttttttcttataatttgtttcattgttaaatatacttatatgcatacatataattttacatatttcacaaaagtttttaataataagatgaatggtcaaacataaacttaaaaagtcaatggtatcaaatatttagaaacggagggagtacttgttttctcaactacctattttgtaaatcagtagtaatatattcatatgatataactagccatgcctatataagtagggatatgttataagcaaattagggatacaattaattttagatccggtggttacataagtaagctacgcgagtgagcgcagtgggaagatgggaaagtaggactgctaatatatataatatatattcttcagccgttggtcggctttatccatttcgcggaagacaaaattaacaagtccatgatgtcccgtagttaattatttatttacagctttcacatacgtacaactataaataccttcccacaacaacaataatataaggggcaattttatttttacccctacttttgatcttcaatgttgattttaccctgtttttaagggtttttatttttgcccctttttttttttaaatgaaagcaaactctacccctactttagatggacaagttgacggcgttaaatctttggcgaaaagacaatcatacccttatttgatattgcatatttgtctgaatgtttatttaataactgtgtatttgccccctttttacatgcagcttgtattttgataaacttttacaaatatgataattttgatagaatattaaaattttgatataatttttccacaaatttggtaaaatttgggtattttgaagaaaaaaagacagaatttgggcacaatttcggcatggtttttacacagctaacaaaatacatgtagcaatcatcacaaaatcacacaaaatcaagcaaatccaaatcatgaagccaagcaaatacagtccagtagcatgtcgctcctccctatcgcctgtttacagccgagccaggttgatgctgcttgccgcagcgtgcacctccgtcgtgccctgcttgccaacagcttgcagtgcccctgataactgctcgctgcgcgcggcctgctgcttggcgtgctcgccgccaccgcttggccgggccacctgccgtcgcctcctctctgcgtcgagccgtcgccgccttcccgcattaagccgccgatgcctaaccgagacgccgccgtcgcttgctcctccgtcaagccgctaccgtctggacaagagcccaccttcgtcttgtcccctcgtcgagccgccgtcgcctggcctgccttgatacgcgccgccttctgctcgccaccataggtgggattggggaaggcaagaaggacggctttggttatggctcaccaggggtacaaaggtccatcaacgaattaaaaaatcactatttctttttctctctacgttttagctccataatcctaggtcggctaacttccgttaaaaatagggataaacgtctatttcatttcagaaaagcaggggcaaaaacgaaaaccacaaaaaacaggggcaaaatcaatatttaaacatgaaagtgagggtaaaaacgaaattatcccataatataaagtaccttagattaaaagaaactacaaaatattatcttttcttctttttgtttttgaaaagactatatatcgtcacgatggtcgagttagagcatcatcacaacaccaacatgtctagtcggtcatcaacagatcgaacagaacgtccttatcagtacactattgagagagaaaagcacgtttcggcacatcgatcattcagcgtagacccctgagaaaggataaacgtgtggcatcagatcacatattgcaccgacgatcatcacacacctaatctctccatccccaactaacagaaatatactggagtagtatctattaatttttcaagtgaattaattagtccgttaccgatttgtttggtgagtagtgatttaatttagaagtacgtacacgcgatcgatctcggacatttcagctacaagtgcgtgccagcggtggtgtgaatataatgaaattagccgctccagccgatatatgtagacgtgtactaacacaaatactctatccgtcttataatataagtgattttaagtttttacttacactatttgatcactcgtgttattcaaaatattataaaattattcttttacttactttattatccaaagtactttaagcacaattttttaatttttatatttacataaatttttttgaataagacgatttatattatgggacggaggtacatgctagcactgggagagaaatggcgtgtcgtcctcgtacgcagacaaagccatccccactagcttactgtacgtacaggttcactgagaaccagtacatgtacgccgcgcgccattaatttttaaagagtaaggtatacgatcggtgaattttttttgaaaataatattattttaatggaaaatcacaaaactttaggtcggctagacgaaatcacaagtttagcgccctgtcgaactgggacagggtactgtcgaactgccctagttcgacaggctagttgtccaagaaaaaaaataaaaaagtacttgctacaatgcccgataaggacgtatcgaacagggggagttcgatagggcgcgtggcatggacgtatcgaacagcgggagttcgataggcagcgtcgctacagtgtcgctacagtgtcgctacgtctttgatagagaaaagactggactagcatttttgaatgatgcaacaacgcaatatatgatgttgttgttgtttctttgcttccaagtcgtaggccggtctcctcagtacgtgtggatagatatgccacaatgaagctttttggttaagacgtcacaacgaagctaacatcggtatctctgggtaggtttagcttgaaaacgagcccgttgcagtcttatggaatgaaacaaatgaaagaagaaaaaataatgtgcacaaggaaggcaagcccagctataaaggtgctggtcacctcacattcatatgcctcagcccaagtgtttctagcggtcgagcccgatcagatgcaacggcaaactttattgaggcccaagttcaagttagcaaaatggcttcttttaactttgttaagttttgaagcacaacgtaggcgagtagagataaaaatagagcggatagcagagaggatagcttccatccgctctaaagaaaaacaaatacgaatataactcggatatgaaaatgaatgcgggtaagtttttgctagatgcaaatatgtaatcatggtattcgacggaaacaaataatacgaatatccagtgaatagtgttatttggacatcgccaaatgcatgaaacatgtcccacatctttttaactcaccttcgatatactccctccatctcataaaaaaaccaaggatgagatgtgacacatctagttctatccagattcgtagtattaggatatgtcgcatctcatcctaggtttttttttatgggacggggtatatctttagagtttaataatagcacaccccactagcactagctcgcactattaattgagagaatatactctttgtctttgagtttatcttagttcaacgatttaccatagacattatcttttctataatataccggtaagtttatcaattctcctacaatataccattatccattgagttgggcatggttttaaaaataacactaacacacttatagatataaaaggttaacaattgttttatcctgtcataagtctcaaaaaaaattatgaatttttttagcctctttacacaatgtatatgttcaagatttttgtatttctactttttataaaatataatttatcagttatatgttatatagaatatgttttgtgttgttgtttttaatgtaaatcatatttcttaggctacacaaaaatatttttatgctattatttttgcataactaatttctctctcatatactccctccatctacttttgatgtgtatatttccaaatctgaaaattttacttttgataggcatatttcaatcaacaacctatcctcttaatgaatttttcggatttaatgcgtgactctctattcttccacacaagattggctacatgggcatcgagaaatataaatattaatgaatcgcctgtttacgggaaataactagtagcatgtttaaatggataataagtagaattacttatccttagtcattgtgccaagatgcaatatgactatcaaaagtagatggagggagtaccaaacaaaaataactatgttttttaaaaaatagaaataccagaaaaaacatgaaacttatatacacacttgagtaaggaggctaaaaacttcatatttttaaaaacttctaatgggataaatcatttttttaactttgtatgacttcaagggtatttttagtatttccaaaaaactgtcgacgggtgatacccgtagaccggatatagagggtattggggtacgttggtacaagtatctacgtaatacgacatcaagcaggcaaaggacaaagattatactggttcaggccccttgataggtaatagccctaatccagttgatgtgggattatatgatggaaaacacaggttacaaagggaacagtggaacttgacggatccggcaagattgtggtcaagttggttcgactagatccccggcgatttggctccttgcaggctccgacttcgtaggctgtgagggttgtgttggctctgagattcgatgccctaggtcttccccggggggtcccttttatatcacaggtcaggcggtttccaagtagaactcggaaacatcgaaccttacacgatacattgacgatccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaactgagataaactcagtggcataagctcctattaatattatttgaacttttaaataattttatgaattatattatatgttatctattataatattcgccagccgttgccgcctcaaatccgccacgtccggccacaatttctccctcccgagccaatataaaccctccccgtgctctcctcttccatttccccctctttcccgagcccggcactctctccctcgctctccccacgccgctcccgcgcaccgccactttctggcgagctccggccgcccgccaccgctgctccacccaccgccgcacaaatccgccaccaccgtcggcttcgcggcgccgtgctgcagcccggcccctactccatttcccctctccgcctccggaacatcgccgcctcgcgcaacacctctctccgccgccgccgtcacctccagccacgcgccatcgccactcccgccgccactgtgctgcgccgcctccactgccggcttcaccaccgcgcgggcaagctcggtctccgctccgtttccctgttccttcaccggaactccatcccctctgtcaacccaagccaccaccacctcgccgccgccgcgagcgacctccaacctcacgctctccttcgtcggcttcgcagcaatgatagggagcccgacatcccctcatccaagctctccgtcaccggaaatcctttccccgctgtgagaggtgagctccttccctcgtcgccggcttccggccgagttttcccgccgccttgcgcctcctccctattccctaactttccctccatgttccccagatccttccgatcgccgtccgccggttcccgctcgcggaacaccgctggaccgctattgccgtgccaccccgaggagcgccgccgccatctcgcctcccttcggtgccgttccgcttggtgagcatcccctctccgctttttccgccgctctccgcgtgccgacccgcgccgccggtgtcgtcgccggtggtcgccgtccggccgcgcgccgccgtcgtcgttcgccgccgctcggccgcgcctgtactttggccgcccgtggaccactcccgtggtctgggtccacggtgccgccaggctgcggtggaccgagtccaccgtgcgccctcccctagtcccgctgacgtgtgcggcccacctatcggcgcgcccttcccctttgatgacgtcagcggctgtgccttttcctttgaaaaattaaataataattgtgcaataaatcggtaataattctagaaattcatttaattggctcaaaatttctaaaattcatatctaattcattcgaactccgaattgggccattcaacttgcaaaattcatctaaaattgagctctacatgttttttttactttttatgtactgttttcttggtttttattagagttttcctcattttgcgtgccagcgtgtagttcccgtcgtttcggaagtccgcggtcgcgaggaaaagagctcggaagatcaaagtgaagaatcaaggcaagtcacacattccccttgagcattttgatcctaatttacaaatgttttatcgattgcaaataaaattgcatgtcttgctaattacatgggatcagggttttacctatctgctcacttgtgccatgtttacttgatatctgtcctttgtcaatattgggtaataaatcgactagctcatgttacttatgtgacctagctagaactatatgcttagccatgcttaattaccactagctcagttgatgggataactgcagtattagacctttttagtatcatgaggagctgcgtgctcaagacacccggccatgcttcatggtcataattgtccaactaaaatgcgactaaatggtgggctgtgggtgcatggttttgctagtcgcacccatggcaattaaggaccggtttgcgggatgccctggaagaacttatcgtacttaccataagccagcgtgggcaacggctgggcttgtagtgtagctttcctctagccgacgcatccaggcaagggtgggcgtgatggagtttagatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgttgtggtggcatgtcggcgcacggaaacgtgtcgtggggctgtgtcttgtgggtacagttgtacacctctgatcagagtaaaactattcgaatagtcgtgcccgcggttatgggcggtcgaccagattcaccgtgattagtcccaccttaataaatcgactcaatgcactgtagttcaggtgggttggttgggcctgttcaacgtggtatagcgttgatcagtggagatttaatgttactttaattactcaacagttttactattttgctcaataaaatgttttacaaccacctttatgcaaatagccacaaatcgttcttgtgttccccttgcacgtctgcatcgttggtgtggcttgctaagtacggtggttgtactcagccttgctattattcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcgttgtgaggactaagtgcctcttctgtaagtattttacgctttatttacatttggaactgtttattacttatcgttttgtgtaccctggctggtcctggacagggatttaatacacaaaatagtctggaaatttgggcaaaatttctgggcgtgacagcggctagcaacacgcgtaaggaggtgatggaagaagtcggtgatctgggggaatctgttctccccctttttgaagagtaggacctcttgtactcccaagacatgctgtgtaaaactgaatcttaaccgcctttggatgtgcacttattattctagcttactcttgcatgttgatcttgaaaacttttgtcccttgtagagatgttgatgacgaggatgtccagcagcgcgggcagcccgagtcaccggcgactattccggttctcgcgtttgaaccacatgcgttgcccgacaatgtagaccagacccttgctacggggacggagatggcgacgactttcttaggttagttgtccattcatccctttctgctcctccgactagatcaactatgttctcgaaagaggcgcgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaagctgtggaaacgctccgaggtcgtgaggtgtggttcaactcgtacttgaagagttgctgcacatccatggccagggtttgtagagaacttcgagtgccccgtggagatcccgaggagtcggcggccggatacatctcttggctgaatggagcctgtgctcaactcgacggcgtcggcaagcgtatcgacgaggtcttgaagcaggagtgtcgtcgatcgagccgatatgccgaaggacacgtgttggcttgcctacgagatcatcgcccgcgcctggacctcgattttctccgtgagggttttgctcgttctcggaggactccggcggagatagaccacctggcgaggtcgatggcgccgttggcggagaagatcttccagtctatagactggagttggccttcttggtagtcttcgtaacctgtgatagatatctcaggaaaaaggtgtaatatagctttggatttgtgtaaaaattgtaagaagtattttgtgaaatagaaaagaaatctatctttaacaaatctttcttactccggatgtcgtgtgtaagagtgtgttctcagttcacgactttagtcagtcatttgagtcgtacactctccctagcccccagccttgtcgtcggaggaattttcttggaggataaggctcttggacctttgacctgccttggttgaataagctctgatcctagcccccagccgtgaagttggaaagttaatttccgatttcgcggcttggttaatacgcacggcgagaactcttacacgaccagatcttacatggtctttcgtctctacaggatctgacaaggccttatcggctctgggcgtccccaaccgaagatcccttaggttcctcggaggccttgtcaagacggcgtaaagggacatgaggataggtttcaacgctaggtgtcatcagggtaagggatcattgggcggaaacactttgattgtaatatgggcctaagaataggctttattgatactgtaaggtgtcttacaggtacggattgtattgactcatacatagaatttacgtagttggtcaatgttccaagaatttgctaactcgcgaccatcgtcgtctgcaattttgaatgcgcatgaccgcaaaacttgtgtgatcgtgtagggtccttcccatttgggtgagagtttgtttcgccctgcttggctttgaacccgtcggaggacgtagtcgccaatcgaaagtatgctgctcggatgcgcttctcgtggtaacggcggagggcctgttgatagctggctgctcgaacggcaactcgttcgcgatgttcctcgagtagatttacatcgacgtttcgctgctcctcctggtcctcatcggagtgcttctgtactcgtgtactctgatgtcgtagctcgctggggagcatggcctcggagccgtacacgaggaagaaaggtgtttccttgttagacgttgtcggtgtggtgcgtacagcccatagttactgatgggagttcttcaacccattttttgtcatgtgacatgagcctgtcatagacgcgggttttgatcccttgtagtactatgccgtttgccctctcgacttgtacgttgctttgagggtgagagaccgaggcgaagcatatcttgactcccagcccgatgcagtaatcctagaaatcagcgctgatgaactgggagccgttgtcggttatgatgcggtgcagtagtccgtatctgcaaaatatccccttgatgaatttgatggcattgtcggccttgatttcccccatgggtactgcttcgatccatttagtgaatttgtcgatcgccacgaataggaacctatagccgccctgtcctcgtgggaatggcccgagtatatctagcccccagtacgagaacggccaagtaagagggatagtctggagcgcttgcgcgggtatctttgtgtgtttactatggaattgacaggcttcacatcgctggaccatgtcgcatgcatctttaagggcggttggccagaaaaacccctgtcgaaaagctttcccgaccaatatccgaccggcggcgtgtgacccacaaatgccttcatatatatcaaggaggaggtgtctgccatcgtcggacgagacgcatttgagaagtaccccgtttggcgctttcttgtatagatcgttgccgaccatacagtagatctttgctttacgggttattttcttggtctctgtatcgtcctcgggcaactcctcgctgttgatgaatttgattagtgggatgcgccagtcgtctgtggtctcgatatcggcaacggcttgttctgcctttgtggcctccgagctaatgtcgggggtgaccgggctaacttcgccgctaacctcttttactgatggctttgtcaggatgtccagaaaagtgccgggctcgagcggttctcgtctagacgcacgtcgtgctaggtcatctggctcgatgttgtctttgcggtagacgtgtcggacttcgatcccatcgaaccttttctctagcttcctgacttctgcgagatacttggataactcggagttagagcatttataatctttgtgtacctggttcgcgactagctcggagtcccctttcacgattagtcgcttgaccccaagtgcggctgcagctcttattggtcgccctaaagttgaggtggattgtgtgcttgaattgatctccggagggagacgtcaagataaatcctgccccaactccttggctgttgagtgcaccatcgaacgccattgtccacgtttcgttgtcgacttggttgtctgatttgttatcaggcatagtccaatcggctacgaagtcggcgagtacctgggatttgatggctgttcgtagcgcaaaattgacatcaaactggctcagctcgactacccatttcgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtaatttatctctctcgacaacgatgacggtgctaacggaatatggcgtggcggcgatatagaggaataattcttcattaggttggggggcaacaagtacaggggggttctataggtagcgcttgagtgcaacgaatgcctcttcggcttcctgtgtccatacaaatttttcttgcttcttcagcagagcgaagaaaggttgccctcgttctcccatcctagcgacgaacctgctcaatgctgccatccatccggttagtttctgtacttccttgagtcttgtgggcgacttcatgttctcaattgccttgatcttctcgggatttgcttctattcctctgccaaagacaaggaaaccgagcagcttgcccgacggtactccgaacgtgcacttctctggattgagcataaggcgatatcgtcggaggttgtcgaacatttcccgcagatcgtcaatcaatgagtcgcctgtcttggtcttgataatgatgtcgtcgacatatgcctcgacattgttgccgagctggtcgctaagtgcgccctggaccatgcgctggaaagtattccctgcagttatcagtccgaacggcattttaacatagcaaaataccccgaacggcgtgatgaatgctatcttctcttcgtcctcttttgccaagctgatttggtggtagccagagtaagcgtcgagaaagctcaacagctcacagccggctattgagtccaccagttgatctattcgaggaagagggaagtgatcctcggggcacgccttgttgaggtcggtgaagtcgacgcacattctccattttccgttggccttccgcaccatgactggattgactagccactctggatgaagtacttctctgatgaagccagctttgagaagtttgtcaagctcttctcgtatggcttattttcggtctagtgcaaatctccgcagtctttgctttactggcttggcatcgggtcgcaccatgagtttgtgctcaatcacctccctggggaccctcggcatgtcggacggctgccaagtgaacacgtcagcattgtcgcggaggaaggtgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactgttgtcgacgaggccggataacatagtagtagaaccttgagtaccaagtccccctacctggcgcgccactgtcgacgggtgatacccgtagaccggatatagagggtattggggtacgttggtacaaggatctacgtaatacgacatcaagtaggcaaaagacaaagattatactggttcaggccccttgataggtaatagccctaatccagttgatgtgggattatatgatggaaaacacaggttacaaagggaacagtggaacttgacggatccggcgagattgtggtcgagttggttcgactagatccccggcgatttggctccttgcaggctccgacttcgtaggctgtgagggttgtgttggatctgagattcgatgccctaagtcctccctggggggtcccttttatatcacaagtcaggcggtttccaagtagaactcggaaacatcgaaccttacacgatacattgacgacccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaaatgagataaactcagtggcataagctcctattaatattatttgaacttttaaataattttatgaattatattatatgttatctattataatattagttaagcatgcatttgtgctgtaatgttatatgtgttgaactcaatattatgtatgatgatagttatttctattagatagaagtttgggttgttttggtgttacgagaaatgtttgttttcatattcatgtccgatcatattcgatccttatttatttttgagataatttttattactttatgtattcgattttgtcagggttatggataccacatacctaatagtagttgactaaatctcggcaagacccaccacataccatgtcctatacggaaacaaccttcggatataggaggagttccagataaggaaagacaatcaaagttctacatggaaacgacaaggactactcggattgtatccatattggtttctctagttctatttggacaaggggacacctatgggtataaatacaaggccccctaggaggagaggggggacaatacacacccaacacaatcaacatacacggaacaacagaagccacaacatacaagccaacataagccaagacaagacgccggatatcaacttcggagataggtatggctagtcctctacggtgtctccggatactgtcaggaaagacgaaagcgctatctctgatctcgccgggcatggattcgaggaggaagactaccctgttgtcgactacgagtcagaccttcagaccgccatgtcgacaacagttagataggctacccaaaatattgtactggtatgattatggtgaataagatcaacgaccggcttcagccaacaggatgtagggttattatctgacaattcaggggcccgaacctgtataaaaatccctgtctccatctcttttacctcagtctcgtgtataccctagtaccaacgatccctataccatgtaaataccagaattgcgacatcaaacgtcgacagatttattcatatttgttttcgtatccaactaaaaatatgaaacaaatatgatacgagtattatttgttaatatctgctttgtttgcatccctaagtaagtaagtaatgcaagtgtagaacactaaaacagtgtgctttgagttttcataaaagtaagtcttaagtttagaaattgttttacttcatcctcataaataaatttatttgatagcctcctaagagattggaatagaatctagaaatttgtagtctcattggccgtgctagttttgggatacaatgccttaaatctttagtctcacaataactccggtgttaaatttgtagttttatgaagcatcttttaaatatatagttttatgataatttgataaaattatcaatagttttgtaaaaatttgtaggtgataggtgatgtatgcccccaatttgtaagccgtcccgtcaaggcgtcaaccatcaatatccgatgtgggaataaatgaacaggtatacatttataaaaagctctcttctttaaaaaaaacgccttcaaagtttattcaaggtagaaaacaattggatatgtaataatgcaaactatatcatcatcatcatctgatcatgtaagttgcaaccaactatttgatcgatctcacctccatgattatctttgtgagaggcagccatggccatggccatgcttgcattgcatgcaggagaaggtgtggggaacatgtctttagggctggcaggccaaggccaaggcctaaacataaacaaagagaaagagaggaatcaagcgaccaagtcaaccattgcctccatattttcccttcaccacacacacacgcacacacagagaggaggacgtgcatggcatcatatcaatctctgcaactgcaatcgccttaaattatctctcctcctcgccgcgttcctctcgcgaaacgcagcgcattgtccgctcctcctccgatccctagcaaaagcttcctagctagcttgcctaccattgccatcctctcccctccaacctctccctccattcgcattaccgcgcaaaggaggaagaagaagaagaactcactcgcaggagcaccaatggtgatcgatctcctctttctttctctctctctctctctctctcgctacaaattaagcacaattgcaatttcagtttcttgcatggtcaatgatgaattgcaattaatagagtgatttcccccgcaaaaaaaaaattaatagagtgatttgatttgagaatggcaggcgaattctgcgtcagggctggcggtgaacgacgagtgcaagttcaagttccaggagctgaagacgaggagggggttcaggttcatcgtgttcaagatcgacgacaaggccatggagatcaaggtggagaggctcgggcagactgccgagggctacgaggacttcgccgccaccctccccgccgacgagtgccgctacgccgtctacgacctcgacttcgtcaccgacgagaactgccagaagagcaagatcttcttcttctcctggtatgggtacttaaaaatatatcctaatcttttgaggggacgtcctctcatttctcacgtctaaatagttaaaaaaaattaaaatattaataagatatattaatatgtgatatatcattaatttgaacctgacttcaacaaggtgcaaaagaaaaacaaatatgactgaatacacgcatcttagctagagtttaatttttttgctttttacaaatcgtaaaggttgaatttgaatagtatatttgtgtatataataatctatcttgataactttttttactaaatttttcattactaaaagggacaagatgcaagaaaagaacgacagagagttttagaattcattcccctatatagctataccatcgaaattaatatgcgtggctaagttcaatttcatttcgatgaggtatcatttctgttataccagtaaagatcacagaaagtgccatgcatgtatgtgtaggtcgcctgacacggcgaggacaaggagcaagatgctgtacgcgagctccaaggacaggttcaggagggagctggacggaatccagtgcgagattcaggccacagaccccagcgagatgagcctcgacatcatcagagccagagctcactgatgatcatatcatttcatcatccaacaccaccagattaattaattcattcccaacgtcgatcgccttattcaaccccagatccatgcatatatatatgcccatgggttaatatatcatcaattatggggtttatgtccgcttaaatttaccctacgtacgttttgatcctcgcaaaaaaaaacacatacatatatatatataccgttttgatcgactatttatacgttgttatacgacattgatgtcgtccaagtattattatcctattatatataattccttcatttcattctatttttcttctgcttatatcttcaacttttcatttttgtaatttgtaagttgtattgatgcaatttgttggcaacaagaatacactttttctattcatgtataatagaaacaacatattctcttattacgtgttatgagttgtgtgtgcataatggaatttactgtgtccaaacattaggtgcacggctagttctttacttttagattggttgggtgaaggcgaatactgatggggcgtttttgtgatggcacactagtttggagcagcggtggtagtcttgcgaaatgaccgcggagattttctgccccattcgaatgtcctgaaaaggtggattaaatttcggattaaagtggcgcgctttttaaactgctaaacggtatgttccgtgcaaaaactttttatatgaaagttgttctaaaatatcagattaatctatttttcaagtttgtaataattaaaactcagttaatcacacgttattaccacctcgttttgcgtgaaacacttaatctacatcttcatcttcatctttagaagattcaaacaccttaacaatatcatctaaggattaggatgctaccatggcgaaaattctaccttatcgcagagcgactaatattgtaagggagttaggagtatctaaactaattattgagactgattctttggaagtgaccgaccgagaatggtgggagtgtctagcaaacattcgaatgatttttgtcatccatttcacttagatttttcaacgtctatccggatgacacgttgccgagtgaacgactttactagttaatcgttctaaccgattgctcggtgaagaaaaaaaaaaagccaagacatcccttcattttgattgtctagaaaaaacccgagatgaatgaataaatattactaatacatctacttaaaaagttacatgcagttacattatagtcatattagctacagtataattacagtatagttacattgcaattacataatagttacactacaattacataaaagttatactgtaattttataatagttacactttaattatataaagttacactgtattttctagaattacataatagttacgatgtaagtttatcgttgtaactctaatcaatatttattgtatatatattttttgagggaactattttccagcattgcatgcttgctcggttggtcgtagtggttctagcgggaagcgcaggccgcgagatcgatctcacatgtgggcatctgttttatattttcccaccagtacagcacgaatcttgacacaaatcctacggccagaaaattgacagatgtgtaactaaaaaatctgtcgaaagatttatagcaaatccggagatgcttagaggaaagttaacagatagatttgtaggactttggcccaagacctgaagataaagctgagttatttcgaaagcgcaagggtcacagattagctcaaggagagtcttcgagtagttttaccacctggctttctatttttccaggttctattagttcgattctgactgatgattgtaagtataatagtctaagttaattaagtgcgagtagtgtactgtgtaattcttaaaaatgtagtgccttggtgtggttcctattttagcatatatcaggccttggtgtgaacatatcaatctttcttgcatttggtgcctaactgtggacacggttatgcatgaatgtatgatgagactccaggacggttgaaaacacttcaacaatatgatatcaatcttgttttaatcaagatcaacacgcatcagtttcataccaaaaaaaaagggggaagaaaccatgcaacatatctggcagactccgatattaaggagatattatgcaatttacaaaaccagtaacatattacaaaaaaaaaaacccactaggaggtagaaaacgaagattaaagacagtttatcagatgtccatcaaacagctgtcagcgtttcatatccaatgaaggaggcacacaagaacagcagcacacgtttagacgttttcactattcattggctctcatcgacaaataattttattgggatgacaaacacacttttatttggatgataacatcttctacacatgctatcctacgccatattgagcataatattatacagctgtgattactatacaaagccggggcattttagtacattgggaagaaataaactaaaaaaaacacttattacaagaaccaagaggtgcttggacacccaggttcgtctttaacttaactatacatcctttcatatatgaacttatagccggtaaacatcgtgcttatatgttgtattgctggtttatcttttattgcatcagcagaagattatttacagtagcgtttatattatttgttctcatcagatcctacaaattggtgaagaaaaaacatcagtgcataccagtgcgtaaggtaatagctaaaactagagttgagaggaaatagaagtgtacctcaataattagctcgtcagggatatggggtaaaacttctcgtactctatctaccatggagagaacctccgacatgctaccattcgcgggtcttgcagtgcctcggaaccgcaagccagcagctgaagcaccatcaggcctcgaggaagaggatggaacaaccgaagatcctgcaactggctcaggccatagactccaggtggcatctggatgcccataattatcagtcactgaagtcaactgcctcatcatcatctgaactccactaagccccactgatgtcacggcgctggaagaactgggattgtccatcccagggctcgaccatggtggtgcccagctagaatcaagaccagcacctctgcaccacccaacacctatgcatcagtgctgcagaatcgtatgcatagcagtacaactatagggttatggtgatcaacaaacaatttccaaaaacgaggattcactgatatagcaagtgtatgtgtgctaaattataatagcatctgagagataagtcatactgcatatacaatacaagtaggcacagaagagccatcaggcaaccataagaaataaaaggaatagacgagagatggaccagtttgacccatccaacccacctgcacgcatgagtgtatgcgtctctttcggccctttccagcccaaccaaccaaacctgcacagatgtgctctataaaacttagccccttatctctgactccatgtgtatgcaagacagtagcagcttcacctctttctccatctaggtttctctaccctcacaattactctccccactccccctgcccccctgctctctatcctcgacctacctcttctgcctcactgccacgaatcaaggtagaattctcccttgcatagttgcaatatggaagagctggtagcaagcggccaggagataatgcgtttttgatggtcaggaagttgggggagcgagaacaggagctaaacgcacactatatcaaaggtacaaaagtaccaggaaaatatcattacttattcaaattattttggaaattaaacaaatcaacaatacccgataccatatccccttgtaagttgtatcccaccacatccatgtattggatacgtatttgcacacaggatcagcattttgttgtataggtgattaataggaagataaaacatatatcttctggtaattttgagtgagcatgagttttagtcatctttggggatcccttctttgccaagttttcaaaattatgtttcctttggtaagtctttattactaccaggttacaatttcaatgttcaatcaagattcaatcctaaaaatatgctaaacctgccagtataaatcaatctgactggaacaaaatattcaaaataatgatggtaataggcaggtgagcaccatcagtttgacatactaaacctacttagtttcacctagaatgaataagattcgaaaagatgcattgaaagactttggttcatcattatgaacaaagataaagtccattaggaaatgaaactatggctattattcttcctttttctttagatcaactaggcctggtaaactcgctttcatacccatttaaaacttcaattgaaccacaaactaggaccaccattaagtgatacattacaacaaacaatagcttcatcggattaaagattatcacagtatctagatagaaaatgtgcatgccataaggctaacaaaatctttgcgagggtagtaacttgaaagagaacaggaaattaaaaatgccctcaaactataccattcatacactcaaataactgaggtagtctatcaaggcctagtttcaaataacgatataatgtcagacatttgcccaatcactttataaaatgagcttaagttgtgacaatgaacaccaggggcgaagaatagggaagacatgcatgagtggagcatcaacatggtagcacaatgctgatcttggttatgttcacggtcacggcagatgaatatgggctgggaaaaatatgttttgtgacaaatgagctgcagagatatggtgcttaggtgaggcaatggtagccagatatgagaaggggacaatgatgtttcctgagaacttcacatagaagtgatagtgctatgaatgtggccatgttggcgaagaatgaaaggaatgacaaatttaggattttccctcctgtgagtgcactctattgtgctgttctacaagccatcatcatcttccttctttcagcaaaaagagcatatcttcctcttccttctatctccgaaaagggcatatcttcctccttgtctgagcaggatgtgtgctcaattcagatctagcatgcataatggagtcgaccgctaggggtgaggtggaaggtgttcgtgcacatcagcctatggcacacacaagggattcacggtaaacagcgacagggacaattggacatgatctctgctgcactgtctttgccacgacagccaccacctacactacagtaatctggtaagcaatttggcactgcagcagaaagatagcctctcgcttctttaccctgtgtgagatcaccaccctccctaagacttataagctgcgagataacacttgttggcattgcccacgcataccaccaaggatcatccttgccaagtgccacagcccacaaccagtgccaggaacagtccaagatcctgatcatattatctctacatactccatcgttccaacagctaccagggtaaatcaggcggcttttgtgataaattatatttgcttaggcagttgtaaattaatgaattggcagttgaaatgagatagttgggaggaactctacaattatgtcaagttcaatctaccatacaacaactgatcaccaagaatgtagtggaattagctcggatgctggacaaaaggcattacaataggatgttcaaagataaaatttctgagaaagtttgatccagcacctcaggaatcaatgatggctccaatgtacaggggttttctagacagcaaaagttaaccttttcttttctcatattttttgttcattcccgtactcttgttgatgtagaaacacatgcaggaagcgcttatggaacacatagagcatgctggtgaggaggcaagaaactggtaaacgaagaggtcatagagtggcatactcactctgagtaagcaacagatgcagttggttgtttcttcattggcacaaactgcagagcagcctcctcagaggcacctgctgtttttgctcctctaagctcccatttagtctttgcactgctgatttccacattagctgccttctcttccatattatctctctctatatatagctaggcctgcctgaaggttgcaactggctatccagctagcattgagtaacaaatgatgggaggctgtcaggctgacttgtggatccacattgttagctaatatgtgggactgatgggatgtagtgatttcataaaatcgagcacaaaaactatcgtaagatgggtccttaaaggtgtaggtttgtgatagttttgaagttttgacaagacatgaataggttcattgaatttaccccaaatcacatcaataatttgacaagacattgttataacatgaatatgatgagcaatgtgaagaataagaaaatagatcattccaagtttgttatacacacctccaaacagcatctgcaggattctgatgttcaataggatgttcatgaccaggaaccctctgctgattcaaccccgcattaagttgttctgcaattaactggacgtttcctacctctgctgtagatcttgtgtgaccttgagatgacagaaagagaggtcttcgacaagttggacatgagtaaccatccattaatccttggtccaacctacacatagcaacaatacttaagggaaaaatcaaacatagaatgcaatttgatgtggtcacatttgatggtaagatgtgaagctatacacaattgctaagcatatctacttttgtgggtgtagaagtgttgcatatttttgtactaagtgagaagcagaggtcagtacagttgtacgaaagagcaacaaagggagctgaacaacagtctaagctgaaatacaagtaatactatgatctgttactaatgactaacaactgcaacttcttcacatcagcttgctggcaagcttcaatctcgtcaaagatatttgtgagaatctgactaataatttgctaagaaggttaacagaaggaccatccaccatgctcagcaatatcaattttccttatgcagagattccatgacagaaaaatttaagtcaaccgtaaaataggaatgttggtcccgtattttaataagtaaatttggaatgcataagatcaaatggacagttatgacggcatatggagtctgttcataactacagcctgcagtccttatgcaaatagtgggagcacaatttccagaaaatgaaaatgaatctacttaaagttttttttttggtaggacattatgagctataataaaattgaaccacagaccatcaattgcaaaatagtaaaaggaactcatcgcgtaccatgatcgcaagcaagctagatgaaatagatggttgcaggataactttttagctcgagccattggtccctaggagttgcagatttcaaaagaaaatcagatacacaagcactcaaaacactacagatcctgtgaaaatctagaaattgtttaccctacagatggcacactcatcgtcgtatgcacagatttcatcatatgtagcatctggaagtgctccgtcgagtgaactaagtgcctttcgtaacttggcataagtttttatccgcttccaaaatgaagctataagagcctgcaaacattttcaaagaattccagtcagtacatcatacatatttatttaaagtttatcgaagttaacaagtgaatgtcacactcacgcgcaagttcaataggagaacagcgtcaaccagatgaaacgccataccacggagccagaagatcattgagtaatgaccaagtgacatcaataagcttatcaagtcaatgacaaaaccaaaatttctgactagtctgcctctccactcagaaaaagatcctgcagttacaaagcatgattggaccctggtggtaaagttgagataattcaagagacgcatgtacaagaaatgagacatggactgctcaacctgaactaaattaatgttccaacagatcatagagcaaaatttacagtattacaaacagaccagaccaacataacaaatgtcagatgagtgaatgaaacctctgttatatactccggcctgtcaggaaaaaaaaaaggttctgttttttaccattggcatggccttggaaaaaaaagatcagcaatttatataaaaccgattattgagatcaatatacatgttttttctttgtgaccaatctaaatattcatagatatgttaccagtgaaagataaaatagtttactgtatgcgttctaggattttttttttcattcactgaatctggtgtttgcattcttgtctaggttagtaataaccggttaaccacgaaactcatacagcattatcctgcatgctcagccctagagggtttactaaactgaattaaatgagtctctgagcagcgaagacacgcttatcacctgctgcttgcttataagttttttggaaatcaagatagtccacaccactgtccatttgatgtcgttgccatatgtcaaacaactgaaatccatgcaccatgattgactgctaggaaaatactatgtgagaaaaggttgaagatattcagaagtaataactgcatgcaggtaaatgctcataatatttttaacatctctagttggcatttataagcaccacctcctttgaacattaaatgcaatgcagatttctttgataatgcaagatcgttataaattaagaaaagataaggaggagaaacttcccacaatctgggttgaagtacctgcagtgtctcaaagccaatactaagtggctcaaaaaacataagccaaaatagttgagaattacacgacttgcagaacccaacacaaagctttatcctggagaagatagacaatcaattaagtgtgagcttttaaaagtattacatgctacagttgtgtcaaggacaccataacaaaaggaaatgtggtaaactcaagcatcaatacaactcattccattatactccctctggtcaaaaatatttgtcgttttaggaccagatttggacaaacttttaaaattccgaatacaattttatgtgaataaatttataaagtctaataagttcatgatattatgaaagtactttttgaggcaaatctatgtatatcatttgttttcttttttaaactaagcatttaagaaattattgatggtcagaattttaaaagtttgaccaaatcttgtcctaaatgacaaatattttttttagaacacgcaggagatctgcatatcatttcattaagaaaaaggagaaaaggtggacggtgttagagaaagactccgacacccgccaccaagggtacaatagaacaccacacacccaaaggaagtaaaacaaactagtgcattagcagcacagccctagtaaagagatcacgaagcctagcagctcctgctaggcaccaaagagcaccctcattagcgatggcttggaggacatcaaccaagcatggggtggcaccattaaaaacacaattgttcctgtgcttccaaatttcccaagcaaccaagatgattaacgtaggattctgataggattgcaggattgagaaaacgtaggaataggaaaaacgtaggattctgataggaatgtaagtgtaaaacagaggattgcaaaacttaggaaaaacacaggaatgaccgtttgattgaaccacaggaaaaacgcaggaattggatgagagagatagactcaaagaaagttaccaagaggttgaagctcttgctaaatttcctccaaaatctctataggattgtccattccataggaattttaaaggattggatatgattcaatcctttgtttcaaagggcttcataggagattttcctataggattgaaatcctccaaaattcctatgtttttcctccaattcaaaggggccctaaagagtttagcccttccttctcattatcaggtaaaccccttactgttcttgaccaccaattggcaaacctagcagtatcttgggttggaaagctagagtagccaagccgttgcaggaccaaataaacgagatttggagtgagagatgtccctccaaactttttttaagaagaaattgtgagagtgttggggattgaacaagggatcttagggttgaaaccacacaccccttgccactgcactatcaagtgcatctctaaatgacaaataatttgaccggacagagtaagtttataacagaagttgcaagttgcaagaaattgtaagggacaataatttcatgttggaagtgagtaagtgacatcatgcatctctgacatctacaaaatcaaaataaatttaagtgtacccaacacctaagcaaagaaaaaattatgtgtaaataatatttctaaacaaaaaacagtaaaatgcagactaaccagggaatattaccatagtacatcagccgatagaaccagcaatagtgcagaatatacacgaaagtattttgatggagtcgctgatggtgaagcattgagctgttcaaggcgttctctagccaatgattgaaacatctggatgtacgagaaattttagttaatgtaagggtataatcttaactagttgaagacttgaagttctaaaacattaccttcagggaacaaagaaggcccaaccaacttgaccaaaggattatttgttgagaattaggaggcacaaccagtgggagaaaagttccctggaatacgagagagatcattggcatttcttcacatggcaggcaacaacaagaacataaataaataactgtaaattgatcatacatcctcccttagggcttgttcggtttggaaggggttgaaggggattggaggggtttgaggtgtaataattccacaccacaataggtgtggaataaatcccctccaatccctccctcctggggattaaccgaacatggccttaagattgaaattgaggatgtaccctcctggcccacaagttaggttgatgaccccacatgtcaatggcataggaggctaaatcctcaacttttgatttaaaggagggtatacgatcaaatctcccggtttacttttccaacttgtaaatcgtagtcttcacttctacaaaagggcatggaaacttctactccctccatcccaa

SEQ ID NO: 74921 - DNA, 25995 bp, Oryza sativa
tctcactgccgggccgagctcgccgtaccccgccacgtgtgcctcccgccaccgccgctgtggtctcctccgtcttcgtcgcagtggagctcagcccaggtgccgccgcgcctccgcccctcgccaccatctccgcctgccgcgggagagagagagggaacggcgaggagagagagggaactgagggaggggagagagaagggacacgtgggtcccacaatctattttctgtgtcattgacaaatgggtcccacatatattttttaatctaaatgccaccttaacgccacgtcaacgccacgtgtaaaggagacccggtcaataccgccacgttagcgaaaccgccctccaaaaccgctgagggagtcaaattgcaccggtttccatagtttggggggtcaagatatccggttttgtggtttagggtcacagattagatttcaatcacttttgaggggcaccaagtgaacttattcctgcaagctgggatgagccgtgggccgcggcctgtgtctccatatgatggaccatcaaagagttggtttccaagcgttcggccagaaggctagaaagacgtgaacagagacagccaatggcctactgccgagaggcccaaaagttgctaagattggtcgtagtttttgtcggcccatgtaggatagatatgaggtcccttactttttgacgaatccaatttttatccttcaaccaaaaaaccaaatacagcggtcaaaaccggtgtaaactaactccgaaggcggtttggacggtggacggtggtttcagctgaggtggcgctttgactctatctttatctgacgtggcacatgaagcaaaatctaacaatttaacaaataaacaaaatatgtgagcacgcatgtcagtcaaataataagattgaaaaatagtagaacccacgtatcagtggacctacttcctccacctcatccccacttctatgtatcttatcctctcccaagggagtagggtgagcagagcggcgcggcgcggtggcggaaatccgctgccgacgccgatctccacagcttcggcgctcccaactccttccgccgtcatcatcacgccttctccaccgagctccactactgtcttggtcgccactcctacttccccacctgctttgacgatgacgatggcaacatgttcgaggatgcacacctcatcttcttcttcccagtctcctctgtcttcgcaccaccgtccctcgccatgtcagctgccgccgcatcatacaggcccctcttctccctgctcccacagcatgccacactcccccttctagccgccggacccctctcagcgcagcctctgccacttcgtccactccacctccttcctccccttcatctatttcgactccctcgaggacaatgctctccactctgtccccatccttctcagcactctccaacttgctcgtcgtcctcgagccccgtctccgccgtcctacgcgccaccccccgacctcgacggcatcctcgccatgggcagcggctcgccgcgctgtcccctcgccatgggtggagaaaataggaccaccaacatgtgggtaccattatttttctttatcttagtttgactgaccatattttgtgtcaattatttagttttcaattttgtttttttccaaataaaactgtcacgaaaaagccacgtgtaacaaagatcaagttaaattagtcacgtatgtaccgcgtaagccaaaactagagataatagtaccgaagaacttcgtttgcactggttttataagttaagggggtggttgtatctggttttcggtttagggcgtaaatcggatttggtatcaagttaagagatatcaaatgaacttattccaacttagtttcggtcagcccatatgcacaaaactcatggaatcagccgtaccttaattgaaggaaagaaaaagaagaaagaaaagatactgattttctttttagaaaatgaattaaaatccggctacatcgatgtacacagcacagaaaagatactgatcggtaagcagacagccattcgatctcttgagatgagctcaacacgcggggggtgcacgcaacaagatcacaacaaagcttgcgaatgaaattatactactccagtacttaagtatactaagcattgtctcaaatttcaatgctgggtgagcagagcaccaaatgattccggcaaagcacactccagtagtagcaaatcaatcaatcactacagggagaggggatccaagtttttgaccagctttgacgaatcctcactctcctctctcgcacacattcccccaaccaacaaccttactagaacaggataaactaatacttataagcccagatctagcaataaaacccaccaccaattaactaatcaaccggatccatgagctaaaccagtgtcagtgaggcagtgacacaccaatgtagtagaactagtaggaggtattaatcatacggtaaaaaaacaaaaaaaaaagaagaaagaaaaaaaggcatgcatcttaggggcacttggggccgccttccttggtcttccagttgttgtagcaggggcaggcgcccttgttgccgtaggtgccgggcggcacgcacaggcacttggcgcagcacttgttgcagaacgtcaggcacgccttcttgtactgcgtgttggagcacctccccgcgcacttgggcgagcactcccacggcctcaggttcccgccgccggccacccctccgccgccgccgccgccgcgcccgcgccctcctgccatcacctcctgcacgcgagaaacaagaacgaacaagaacgtcaagattaacccaagattcaagatatatagtaatcaggttgaaggagaggttagagagattgtgaggttaccgatgggaaggcgatggaaaggaggaggaggacggcgaggaggaggaaggggatcttggtggaggacgccattggtgggtgcggtggtgtttgggtgggttagggacttagggtggtgtttatatagaggaggaggaggaggggaggacggcgagattggtgtggagccgtggaggagtaaagatttgtgcgtgcaggtgcggtgtttggtgatggggttggggttggggcatgtgacgcgccacagtggacgcgtgaaccggtcgatgggcgcaggcgcgcagctgggccgtagcactggcatagtgggcattggaaacgcaccgctctcgctctgtccattattgcgtcgtgctggtgttggtggtggcgggaacagatgaaaaacatcaaaaaaccactctgcattaatagttccagtacaggtagtagtagaggttttcaccggccgtggtggaccagtacgatactccttttgggtagctttgggcgggcaattcgagtttcgaggtaacgactaagagcaagttcaatagtatagctaactgctagctccaattcatctatagctaatctaatagttcatttatacaatagttacatactacactattaatacctggtcccacctgtcatacacacaccgtgtcttggagtccgtgctacagctagctataaatctgtagctcgctgtccttctctctcctcatttatctccttaaaatatgtttgcagctggcttatagcctgctattgtacctactctaagagccagtttaatagcatagcccattgctagctccaattcatttatagtcaattcatataatagttgtttactatactattaatatctgatcccacctaccataacacagtcttggagtccgtgctacagctggctacaaatctgtagcccgctgctcttctctctcttcctttatctttttaaaatatgtttacagctggcttatagcctgctattgtacctgctctaataccgggaatcaaacgaacccgaggagatgtaagagcaagtttaatattatagcctactactaactacaatttatctatagtcaatttaatagataaatcatacaatagttgtttattattttattaatatatgatcccatctgtcatatacacattgcgttttagagtccgtgctacagctgattacaggtctgtagcccactactcttctctcatattttatctcattaaaatatgtttatagctggctaatagtctgctattgtaactgttcttaacaaaaaaataacacgacgaggtggtgagatgctactccaagtctagattaaatcggtgagtgggtcatatactataagtaatagtactccgtagtttacgtccactagatcggcggcacatgctgatgccctttttccagtgcacctccactagctactagttctggtactccattctactcctggagagggcaccgcacatgcgcggttcgtatccacagcttgcgggcaccgcacatggatgatggatcgttccaggtttgtattcaccacagctcttgcggcacatggactcccccatctctctaccctacagattgtcgtgcactcgtgcagcagttcaattcgccatgtagtagtagtagtaaaaagtaaaaacttgtatatatactcaggtacttgtactatagtagtaaaaaggcgtccctcgtcgtcgcagagctgttcaaaatttcggttgcacggggcacgagggcagccggcaaaatctccctgttttgctgggggcttttcgcacgccaaaagtccaaacgctctctcgacagggtttcatttaccgcggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggttaccgcggttaccgtgcggtaaccgtgcttaccgccggggcgcggtaaccgcggccccggcggtaaatgaaaccctgctctcgatctttccgtttgcaatgcatgccacgcgagcgcgagcctagatccgcggcgcgaccggcggtgtgtgtgctgctgctacgccgccgtcaccggctttccggcatccacgtggtggggggctgcgtacgacggtacgacgacgaacatgcagtgtttcggggcccagacggcggtggtcggcaggcaatggctttgcttttggctggcctgcgactgcgggagggagaggagggtaacatggggagcggcaggtgggcttggggaaagtatttacagctcggcgtatgggacgacgattactggtggccggtggctgctgctgtttactgctactacaactgcaacccttcgttgccttgtcgatttgtcatccgcgcgagagcgctccgggacaaatcgatggtgtcctcactgccgactctctctcaagaagtcttgggccgtgtttggtagggctataaacttcaactcctagctctaaattgctatttcagttggagctagctcctattagagttggagacccatccaaaagtgtttgacaagcttttagctcccgatctaaaaaatattgaaaaaaaggaatccctgctgccggccgtgcgccgcccaagcatcgtctccacgcacgccggcctcgcgctacttcccctgcaccacccatccgcccttgtcagcgtgccgcccgtcacaggctgtgcgccgctcacacgtcgtcctcgcttgcgccgaccgccccgccggagcaccgctgcccgcgcaccccacccgtgcgccgtcgctgctcgcatcgcccgccgtcaccgcaggagcgtcaccatcggcccgctgcctttgcccacatgtgggagttaagttttggggggggggggggggaagggaggaggttgagcttgggataattcagtgacatttttatgtgaatgtgttaaaaattaaagggtagtggatcttttgggttggagtggagctgtggagcagaaaaaacccagctctacacctgtagtttattttttaggagtagctctactaacttcactccaaaaacagaaaatatggatcgtttggtacagctccgactctagataagttggagttgaaagttagagccgtgccaacggaccctcgtactccagctgagttcgcaatgttgcaatgcacgggcgacgatcgtcgtccgtggagtgtagattcctatcattttggtgacctttgcagagggcgttgttgatcgatgatgcgcatttcggccattgcagatcaggtgaatcacgattagcgccctattgtttaggttcccggtcaatatggtcttactactgtatatgcgtctgattaatttcgaattatgtttatttatttcttctccagcatgtgtagtgctccctccgtcctataatatagcaatctagtataagacgagatacttcatagtatagcgaatctggacatgcttcatgtcatgtctaaattcgttgtactataaagtgacccatccggttctaggttgctatattatgggatggacgaagtagtagagtatgggtgtgttcggcactgctggttcctaatcttttccatctcgttttccgcgcgcacgcttttcaaactaataaacggtgttttttttaaaaaagtttctatatgaaagttgcttaaaaaatcatattgatccttttttaaaaaaaattagctaacactttattaatcacacgctaatggaccgctccgtttttcgcacgcactgttcccggctgggaacctccagtagcgaatacacccatatgtgtggtagagatctggatcctctgccttaggaaaaaagcagaggtgcacgataaaatgagtctactactatggtagaaaacagtgatttgcagttttcactgtagcaacagtacaaaacagtgaaaaatactgtgcgcaattactatagtgatcgatctcgtccatttcgtgtgaaccagacaactgaaaataccccaaagtcacggtactgttttacctctgactttaaccccgggaccttaatccgtgtggtagtagataatatgctatgcacatctcccgtgaggcaaagcgtaaccttgtggattgtcctccccgtgcgtaaaaaaaaactaaaatgtattcgatagaaaattaagtttaaaatcttgtatttttcttacctaatgatttgctttgagttccgtgctctgatgacccaagctcttattctacagttgaccccttctcctttagttctggtgaccccctacaaacagtaatggagctagtgtttagggtcctcgattatggctaggggtaaggccgtaagggtgggggagggggaagagagggaagatcgctggatttagaaggatggtcatgggaggcggcggctcggtgttgggtcgtggacatgagcaggcggtgaggcgctcatggcgacgtcgaagccatgagaatagaggaggatgatgagccatcgttaatgacgggagcaaagcaaacttgtggtgaggggcggatcaactgtgttaggtgtggtgtcacctgacaccaatagattcttgtttaatctaagagcaggtttaatagtatagccccactattggctccaattcatttatagacaatctaatagccaattcatacaatagttgctaactatacttgttggcggatggcatgaggcccttcgaccaaatttgccgaaacccgtggcgaaggctatgaaccaaggatgaggcgaggcgaagggtcgcgtgagtacctgacgaagaaggatgacttcgccatagccagttcgccctggcatccagcgaagaaggacggcttcgccatgtccagttcgcccccgcaagggccgaagaagcctttttggcccatcaagcttaggggctatagggccggcggtcgcctgacggcccatcaaggacccataagtccccttgacattatgtaaccctgtaaacgtctctttcataagggcaaccatgtaaattcccccgtataacctaaaccctattagtaagaacatgtaatggggctataaatagtcccctagggccatgtaatggggggatcccaagtaaaattaaaaatttaatacacttcgtttctttcccaaccactgttgagtaaccacgtctttcgacgtatgcggttgtcgtttcgacaacagctggcgccgaccgtggggacctccgagcgaaaccactaagagcgaatgccaccgaagaaggtcgcgaaggagaaggttacaaggcgaaaggaaagcgacaccggagtgggcatggccgccgaagaaggagcggagccttcggcgtcggtcgccgaggttggaggggcaccgtctgcttcggcgacggcaccgtccgcttcgacgccgacaccatcactgctgccttcggcccctgccacctctgagcaggcgccgagtgtgaatgacgtggcgaaggcgaccgcagtggcgagggcacttcagaccagggcggagatcctttcgacaagtcagctgctggtcccccaagctgctccgtcgcagccagcagcggcccaagctgcgctccctgccatacaagtccaagtcaactccgaccctgaaacacaagccgaagccgatatggagggcatgcggcaaaacatggcacgactccaagacatgcttcgccaaatgcaagaacagcaacaaacgtacgaagcggcaaggcgatccaaggttgcttcggcaccgatcctccagtattcggcaggttttgtcccacctcaagtctatccgcaagtgcagcccaagcccgctccgccgcaagtcttgcaggcaccaatgtactttgtcggacagccgacagtggcaacagtgccccaagccgcgacccaagtatagcctcagccacttggccagctgtcgcaagccgtagcagaaggggcttcggctctgcaggcacaattccaagctttcctccagcaaatcaatcagccccacaacatttcgaatacaactccctcaactcgtccagaggggaattcaagtcaaggtgcgctcagttggttgccgccgaaccagccgaatctgaggacttcgccatggaatcaggtacctcagtgcgactttaccaataccgctcaggcgcaaaccgttcggccgcaagcaccaacaccaggcttcggaacaagccaagcaccaactcatgtcgccatggcgtggtcgcagccagttttcgatccatccatggcggctcagcaagcatcaccagtcggagccgggcagccgaacgccatggctcaaaatcatgcgcaagccgtaatttcacctttcgccacgccgtacccacagcaaggcaccgcaggcagagcgggaggcgaaaagggtctgccgctgagtgggggaatcaagaaccgcccaattccgccccagttcaaattccctcccgtcccacgctactcgggcgaaactgacccgaaggagttcctatccatctacgagtccgcgattgaagcggctcatggtgacgaaaataccaaggcaaaggtaattcatctcgctcttgacggcattgcccgttcttggtatttcaatttgccagccaatagcatttactcatgggagcaattgcgcgatgtttttgttcttaactttcgaggcacttacgaggagccgaagacgcagcaacatctgctcggcattcgccaaaggccgggagagtcgataagagaatacatgcgtcgcttctcgcaagcctggtgccaagttcaagacataaccgaggcatcagtcataaatgctgcttcggctggtctgcttgtcacgcccggaaattcactagtaatttccgaacttatttgtgcataaaatcctcgtccaggaatcaaccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgatttattattgcaaggtgagcatatgacatactcagcaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacagcacacccatgctgcataggcccaaccattctgaacaaccatacccggctgaacagatctaactccaaaccaggagctaagcaaattattacccggtataacatctataaatattgtgagaggtgtgagactaatcacgaaaaacattgttcaactcgcccataaccgcgggcacggctattcgaatagttttactctggccagaggtgtaccactgtacccacaagacacagcctcaacatcatgtctacaatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttgacaagtaattaattaaccaatcacgattaaccatcgtgaactatctttaaaccatcattaaataataatgagtcataagttatcccaatagtgtgctaatgtttctaagcatggctaagcaatcatatctaatatctagctgaaccaatatataaagctcaaccagtcaagttataatctcccaaggtatcaaggaataaagtaatcaagatcaaaagggccataacaaagaataggttaacaccacccagtgacattcgaaaataaatgcacagttgaaataaatagagaatttaaatataggatcaacatgctcaaaggattgtgtttaagatctgtgtgacttgccttgcaataatcggtcttcaattaatcttcttgaatacttccggcgcactcgcgaaccttcacaacgacggaaacgacaagctaacacgtaaaacgaagaaaaagactaataaaaaccaaataaacagtacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacctttatatggattttaattgaattatgacgcaataatgaattatttttgaaaaggaaaagaaggattattgcgtcagcgggctagggtttgcggtggaccgggtgcacggcagcggttcacggaaatgaacggccgagatcaaccctatccaaaacggacggctgagatcgatcggtccacgaccggctcacgacgaacggtcccgatgacgtcggcgatgacgtcacctaccggcggcggcttggacggctcggacggcgcacgctcgccggcgaacgacagcgcggcggcgcgaacggagagctccaggacgaagagcgcggcgcggcgaactcaccgatgaccaaagcaacggcggaggagcaacggacggcgccggcgacgaggaaaaggcggcggcggtcttcgggtcgacgatgacggcggtgctccggcggtcttcggtggcggcgaaggagcggacgaggacggcgacgaccttgcgaacccgatggcggcgacggcgaccgacgacggcggctgcaacggcggcgcagcgcggctgaaccgacggcaacgacggcggcgactaaggctacgcggaggcggcgctagacacgacggcgggctaaggcaaaggtggcggcgggtagaggagacaccgggggtccttataaaggggctagcgagcggcgacggaggcccacggcgaccggcggcgagaaggaaaggtcggggattcggaggaaagagaggaatccgattcgacctcgaatccacaagtttccaaaccgaattaggcgatgattccaaaagagaaaaggaagaggagatctcaaggatcatttgccctcaaacaattcggccggagaaggaaagacgcggccgaatttggaaagcggcggcggagcggctcggctagggtttcgggcggcggcggcggcgcgaggaggaagacgggcctgacagacaggccccacctgtcagcggctgagagagagaggagagcggcggctcggcggactgggccggcttgggccgagaagagagagaaaaggttttgggccgactttcggcccaaagccaaaagagacttttaaaaacccttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaaacttttaaaatcatttctaattattccttttaaacaacaatttataatttaaggattttaaacaagaaaagctcttaacaattataattagatcattaatgatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattctaataataatttattaaatagtttataaatcctgaaacgaaaatcaggatgtgacactgctcgaaggcgaactcacaaggaaaatcgccaataaggaaccacaaacactcgtgcacttgcttcgcatcattgacggtttcgcaaggggcgaagaggattccaagcgacggcaagccatacaagctgagtacgataaagcttctattgccgctgctcaagctcaagcacaagttcaagttgccgaaccacctcccctcgcggttcgccagcctcaaacggcgatccaaggacagccgccaaggcaaggtcaagctcccatgacctggagaaagttcagaaccgaccgcgcgggcaaggctgtgatggccgtcgaagaagtgcaagccctccgcaaggagttcgacgcccagcaagcgagcaaccatcaacagccggttcgtaaaaaggtccgaaaagacctttactgtgccttccacggacgctcttcgcataccacagagcaatgccgaaacatcaggcaacgtggcaacgcgcaagatactagaccacagcaaggagcaactatagaagcacctcacgaagcagcccaagaacaaacacccccggtcgaacaacgtcaagacgcgcagcgaagggtaatgcaagtgattacgagggctgacccgccaggccaattatccaaaaggcagaaaaagatgcagatccgagcggtccacagcatcacttcggcgggtgagggggcgccacagtatgtgaaccagctgatctctttcgggccggaagatgccgaaggagtcatgttcccgcatcaagatccgctggtattctcagctgagatagccggctttgaagtccggcgaatcctggtcgatggagggagttcggccgacgttatcttcgccgaagcatatgctaagatggggttgccaacccaagctcttacaccagcaccagcgtcgctccgggggttcggcggagaggcagttcaagttcttggccaagcacttttgctgatagctttcggcttgggagaaaacagacgcgaagagcaagtactgttcgacgtcgttgacatcccgtacaactacaatgccatcctcggccgtgcgaccctgaacaagttcgaagccatttcccaccacaactatctcaagctcaagatgcctggcccagcgggagtgatagtggtcaaggggcttcagtcttcggccgcgtcaaaaggcgatctagccataatcaacagggttgtgcacaatgtcgaagccgaattgcacagccggccgaaacacgtgccaaagcccaccccgcatgacaaaatagtaaaagtgcagattgaccatgccgaccccgcaaagctcgtatcactgggggacggcatgggtgaacaagaagctgagggcatcctagcggtgctcaaaaagaacattgatattttcgcttggagccccgatgaagtggggggtgtttcggcagacctcatcatgcatcacctggcagtcaagccggatgccaagccaagaaagcagaagttgcataagatgttcgccgatcgtcaagaggcggcaaaagccgaagtccaaaaactactcagggatggggttattcaagagattgaccacccagagtggctggcgaacccagtactggtgcggaagtcaaacggcaaatggcgcatgtgtatagatttcacggacctgaacaaagcatgtccaaaggacgatttccctttgccgcggatcgatcagctcgtggattcaacagctggctgcgaactcatgagtttcctggacgcatattccggctatcactagatccatatgaatccgcctgacatcccgaagacagccttcatcaccccgttcggcactttctgtcacctcaggatgcctttcggcctaaggaatgccggagcaacctttgccagactggtatacaaagtcctttgcaaccagctggggcgaaatgtagaagcttatgtcgacgatattgtcgtgaaaagccgtagggctttcgatcatgtgtccgacctgcaggagaccttcgacaacttgcgcgcagcgggcataaaactgaatcctgagaagtgtgtcttcggcgttcgcgcgggcaaattgctgggtttcctagtttccgaaagaggcatagaggcgaaccccgagaaaatcgatgccattcagcaaatgaagccaacgtcaagtgtacatgaagtacaaaagcttgcaggccgaattgcggcacttagccgtttcctctcaaaagcggccgaaagaggtctgccattcttcaagaccctccggggcgcaggaaagttcagttggacaccagaatgccaagcagcattcgccgagttaaagcaatacttgcagagcccaccagccctcgtaagcccaacaccaggaagtgaactgctgctatacttagtagcttcgccggtggcggtcagtgctgccctcgtccaagaaacagagtccggccagaaaccggtttattttgtctccgaagcactgtaaggggcgaagacaagatacatcgaaatggaaaagctcgcttacgccctggtgatggcttcgcgcaagctcaagcactacttccaggcccacaaggtaatagtgccttcgcagtaccccttgggcgaaatcctccgaggcaaggaaatctcaggtaggcttagcaaatgggcggcagagctatccccgttcgacttgcattttgttgcacgcacgactgtcaagtctcaagtactagctgacttcgtagccgaatggacacctgtgttcgcttccgaacccgagcccgtcgaacaaccctgggtgatgtgctccgacggttcgtggtcgcacaaaggggcaggcattgtggcaatactcacttcgccgaatggcgtaccagtccggtacgccgcaagactgcagtttaatacaaccaacaacgcagcagagtacgaagccattcttctgggcctaaggaaggcgaaaacactgggagttcggcgcttgctaatccgaaccgatcctaagttggtggcaggccaagttgacaaaacctttgaggcaaaagaagaaggaatgaaaaaatatttggaggctgtcagaaccatggaaaggtacttcatcggcataacagttgaacacttgcctaggggccagaatgaggaagcagacgccttggcaaaatctgctgcttgtggcggaccgcatttgcctggcatattttttgaagtactgcacacaccaagtttgcctgtggacagtttgacagtcttggcaatcgaccaagtgaaactgggcgaagacccaaatgactggcgaaccccgtttgttaaatatcttgaagctggttggcttccggacgacgaagcagaagcaaagcgcttgcaaatcagagccacaaagtataagttggtctcaggccaactttatcgctccgggacgcttcaacctctactccgttgcatctctttcgccgaaggtgaggaaatggcgagggaaatacaccaggggctatgtggcgcgcaccaagctgcaagaatggtggcctccaaggtatttagacaaggggtttactggtcaactgtgttgaaagtctgtgctgagcaaattaaaaagtgcgaaagctgccaacgtcatggccgaagccaatctgcgccccattataacttgcaacccattgcgccaatctggcccttcgccaggtgggggctggacatcattggcccgttcccggtagcgcgaaacgggtacaagttcgtaattgtggccatagagtatttctctcggtggatcgaagccgaaccccttggggcaatcacttcggcagcagtacagaagtttgtttggaaaaaaacattatttgtcggtttggagtgccgaaagagttcattactgacaacggcaagcagtttgactctgataagttcagagaaatgtgcgaagggcttaacctggaaatcaggttcgcgtcggtcgcgcacccgcagtcaaatggggcggccgaacgtacaaatggcaagattctaaaagcactaaagaaaagactcgagggggcagcgaaaggcaaatggccagaggaattgctatcggttctctgggcccttcggacgacccccacaagaccaaccaagtttagcccgtttatgcttctttatggcgatgaggcaatgaccccagtagagctaggggctaactcaccaagggtgatgttctctgggggcgaagagggccgcgaagtatcgctcgaactcttggaaggggtaagagtcgaagcgctcgagcacatgcacaagtacgccacaagcacttcggcaacttacaacaaaaaagttcgaccgacggagctgatgcctggtcatctcgtcctaaggaagaaggcgaaccctgtagcggttggcaagcttgaatcaaagtgggaaggaccgtacctcatcaaacacaagtccaggacgggatcctttcgcttagcgacacttgaaggcgaggagttcgaccattcctggaacgccgcctctctcaagcgcttctatgtctagaatgggtggcacccaaatcgccaacttgtaaaaatgtacataccgttatgtaagccctttggcactatgtaagcctttcggcaagaaaaaaaaagaaagagagaaaaaagagaaaaaaaactggatgtagggctattatccaccatggaggcccgaaccagtataaaatctctgtgtcctccgccttctttttatttttcgtgtgattgataatttgtggaaaaaccccaaggcaaacgcctgatcagcgaaaaaggccaggggggcgaaacgaatcggccgaagcatcgctcgccgaacgttgaaaccgcaacagcttgtctcagaaaataactagccgaacgatgttacgctcgatcaacataaaagcaaaagcgtttctttcaacacagaacgctacagatcgaaaacgaacgatgaaaagctgaaaagtcagtacacctatttcgctaatatacgcaaaggggccggcatgttccgacctaacaaaagcacaaaatgtgacgatgcgaaaaatagcgaaaaggaaataaaacacatttttattaacttcgaaagaatagaaggttcacacgatacaattcaccttacaagtaaaaatacatcttcgcccccataatcactatccctccctaaggaagggtcaggcgaactaggttcgtcatcactactaatatcatacacaaccttaagaggagtagggggcgaaacacagactaaactataacgacgctgaaagatcgtttcctgacgtttagtcttctgatggtttcgccaaaagcgagccatatcctccaaacgtcttgaatgaacaagatcgtaatcttctaaggttcgcccggggtgcgcccgcagccaatcggcaaccttgaaaaccttatagctgcgaccgtttatctccatttcgcgataagtaggacgaaatggacatcgcaccttcggcagacccttcaacgccacaaatttctcggtttgacttcgccagctcccgaaaggaggccgaatgcacgactttcggcgaaccccctggtagactgtcacgcccggaaattcactagtaatttccgaacttatttgtgcataaaatcctcgtccaggaatcagccgaggtacacaaactgacaatttaatatacagattcatcaataactaaagcgaataaatacttacttaagaggcacttagtcctcaacatgaagaaaactacagcggaaaataaaatctagcgaagctccggctccactcccacaggcagctcaactggggtataagccaaacgtcttctccttctggatcctttttcttcaactgaggttgattgattatcgcaaggtgagcatatgacatactcagcaagccacacagcaaatatgcaagtgcacaaggataccaaaggatggcataatattggctcatttgcaaaagcagcatttagcaaaacttttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagctccacatcatgtcaccatttgcctcagtaccaccacggtacctcggaaaggagctgtgacattaccccttgcataacacaatccaccacagcgcaccttcctggatcataatcacccccttataaacaaggcatggactccccagcgacccccgtgggcttatctccgccacttctcagtctggtgctccgcaatgaaccatgctatacaaaaggtaaagccgttgcccacactggcttgtggttggcacggttaatgttccacaacagtagctcgcgaaccagtccttaattgtcatgagcacgactctcaaaaccatgtgctcacaacccaccattatcaagttttagttggcaagtaattaattaaccaatcacgattgaccatcgtgagataccattaaatataaccataagtgatagtgaaacattagttatcccaattatgtgctaatgtttctaagcatggctaagcaatcatatctaatatctagctgaaccaatatataaagcccagctagtcaagttataataacccaaggtatcaaggaataaagtaatcaatgcaaacaggccataacaaaggaataggttcacaccacccagtgacattcgaaaataaatgcacagttgaaatatatagagaatttaaatataggatcaacatgctcaaaggattgtgtttaggatctgtgtgacttgccttgcaataatcggtcttcaattaatcttcttgaatacttccggcgcacttgcgaaccttcgcaacgacggaaacgacaagctaacacgcaaaacgaagaaaaagactaataaaaaccaaataaacagtacataaaaagtaaacaaacatgtagattacaattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatatggattttaattgaattatgacgcaataatgaattatttttgaaaaggaaaagaggattattgcgtcagcggactagggtttcggtggaccgggcgcacgggcgacggttcacgcgaacggacggccgagatcgacttgatccaaaacggacggccgagatcgatcggtccacgaccggctcacgggagaagggacgataacgccagtgatgacgtcaccaccggcggcggcggctcggcggctcggacgcacatgctcgccggcgaacggcggcgcgacgacgagaacggaaagcaccgggatgaagcggacgacacggcgaactcaccggtgaccaaaggagcggcggaagaggaacggacggcgacggcgacgaagaagaagcggcggcgctcttcggcttgacgacggcgacggcgctccggcggtcttcggcggcggcgaagcggtggacggggacggcgacgaccttgcgaacccgatggtggcgacggcgaccgacgacgacggctgcaacggcggcgcgacgcggctgaaccgacggcaacgacggcggcgactaggctacgcggaggcggcgctagacgcgacggcaggctaaggcaaaggaggcgacgggtagaggagagctcggggatccttatataggggttggaaggcggcggcgaaggcccacggcgaccggcgacggcgaaggaaacttcgggaagaacgaatccaaaacaaactcgaatccatcgatttccaaaccgaagtagaggatgattccaaaagggaaaaggtggaggagatcccggagattgtttcccctcaatcaattcggccggagaaggaaaggatcgaccgaatttggaaagcggcggcggcgtggctcggctagggtttcgggcggcggccgacgcgaggaagacgacgggtccgacaggcgggccccacctgtcagcgacagcgagagagagaggagagcggcggctcggcagactgggccggactgggccgaggaggagagagagagcggttttgggccggctttcggcccaaagccaaaagaagacttttaaaacctttttcaatttaaattattcatgaaatgcaattccatttattaaaaatacttccttagctcaaataaatcccagaaaaatctaggaattatagaattaagcaaagtatttaacaaaattttatttagcccaattttatattgagatttaacaaattaaaattagatcttctcttttaggcttttaaaatcatttctaataattccttttaaacaacaatttataatttaaggattcttaaacaagaaaagctcttaataattataattagatcattattgatcaaataattactgaactgttctttgtatcatttaggaattgagctccgaaaaattcgagaaaatttcagagagtataattaatcatggagaatttaataaaaattaaatccatccatgctttagatttaggaaattttatttcccacatttaacttcacttgtaaattaaagaacatttaatataaattctattaataatttattaaataatttataaatcctgaaacgaaaatcaggatgtgacatagacagtgcagaaaaaagcaaaacacagcttacatggtaggaataggcggaagaagggggaggtatggcataatgcgaaatgagcgaaataataatatgtcaaagacttggaccgacagtaaatggcgaaaagtaggtctgttatacaaattttaaaaacgcccaacggccacctgtttcggttacaataaaagggtttgcggcagattgccgaatatacaatggttcgccacatctagcgaacaccaaaagaaaactatgaaaatctaagagaagggcggagggcctcacacctctgggtggtcctgggcatcgcttccaccccctccggccgccgcgccttcctcttcacaaaggtccgccgcctctgctttcaccagctgctccaaaaggcgcgccttagcggcggagcggccatccttctgccagaattgttttcgctacgcacgaagtgcgggcgaaatgtcttgcgcgctgatttcccaatcccccttcgcgtacttggggaactcggcgatgtgctcgcagccgaactgctgcaggaggcccatggtaaaggccgctgacacgcgcgcacagcagtcgccgtatgcggtggcgcagtccgaaaccgaaccaccagcctgttgggtccattcggagaagtcgaaggctgaggcatcttcggaggggacaccctgcacttttgcgcccatatcagtaatggcgaggcggagcgtttggcacgctgtccgcgcggactaggtggttttcaccatctcccgcgaaaaccgccgcgactcctccgtagcgcttgcttcggccttgcgaacctcctgccgaagagcctccatcttcggctcggtgaggttgtaataatctatgagcacggcggagtgggccttctctttctccagttcggcctttaagagatcgacttcggccctagcttccttccctttctcccgttccgattggagccgcttgttttcggccttcgcctccttaagggtgttcgcaagggcctccatctccaaatttttgcggcctaattcatcatccttggcccgaagacggcttttgaacccgtcaaggcgggctcgcacggttcgctctgtcgaacagtgagccgtgaggatctgggtgcaaaataggagcggcgaagagaacaagtgttagttgtaaaaacatggttaaattgttccggaagtacagataaacacggcatgaaacatagcataataagcagatagctaatgtaagcatagatttaatatcagtgaatccccttgagcctaaaataaactatagattagcagctaagcagcaaccattcttaactgaagaatgacaaagacaaaagcaacacagtataatcaagataaataaaacatgataagcaatatttcagaaccatgtgaaagcaagataaacaccaacaccctaaccaagtaactcacaaaatgatgcaatggaacctcaccaactgggcacccaccattacccccgagcagatggcctatggctgaggacgaaacatagcttggcctatgttcaaactacagcaacaacatggtaagctagtcaagcactcagaagtcagagaggagagagatggaccggagacgaaacatacgcacctagcggtgaaggggcgggcagacctgcagccgtgggcacccgtcgatcccgttggggacggtgtgtccagccaatgaagatgtacgccagcaggccttgatagaatagcgggccgatggctgaggacgaccgtagcagaagattgtgtggaaatcagcgatggcagcgatttcggctcgacggggtagagagacaaagaaacggcggcgatggagactgcgcgggtgaaagggatatatcgatctggtgaggggaaaggcgagcggtgaagaacccacggtggagcggcgacggtggagacgcgaaggaagtcgcgggagcggatggggaatggaaaacctagaagccgcggcagcggcggcggcggcggcgtagatgcgaacgaccagaggaatatctgggagctggtagcggctgcaaagaaggaaaaaacgaacggctggatccagtcaagcaaacaatcgaacggctcctggcgtaatgcaacagtgaaacagtaaaacagtagcgtacagtgccggacggctgtggttgcaacggcaaaaactatagattttatatgatggatgacaccagtgagatttatcctttgacaccaccacgtccatggaagcagccatgaaagcccatcatttgcttaaattgcttcggctaaagttagctaatacaacccagccggctagctattgcctgttgggctgttggcagtgagcagccgaacatgttgtgtctaatcaataacgcatatcccaacatctcaatgaatttttccaacttcccattcagtttgcaaacaaatttcttttccacttacatttatataacatgtcacctaaataatgtttaaaaacttctattaatttatttggtttaggtattttatttctagagattttgggggctctaaggctccgagctgttaagtgttgttctttggtgccggttggatagtgtacggacacctggtctaaggtttttaatattcatttgtaatattatgtttgtgtagaaaaaaaatacttgtggtgctatttattttgcatatatgtatctagtatgatctagtatatagtttgtggtttttcaggatggtaacttagttttagtaccatgcgatcactggatgtttaactgctggttatttgaattattatgcaagttcatctacattattccacctattaactctactacttatcattattcttattacttttcatgtatattattactttgttagaaactacgataattgttatgatttaacgatgacaccattgatccaatatcctagatccgcctctcctagtggttaggagctaacgaggatgggggctggtggggcggggtacctcaccgctactgacttgagaagagggggggggacatcgagtgagtagcgcttgatcccgattctcgtgcgacactggtgtgagggatgtggttaggtttatgtcgtactgcatgaatcttaaagcatccgatgatctaaaatccgcaatattttattaggtgtttgtcgagctctagtgacaaaatggaccagcaggtccagcaccgaccggcccaatctttttttttccaaagaaacaatggcccaattaacaagattgccccgtgtggacgtgtggaggaataagctcattttgactctcttaaaccacaaaaccgaatatctcaacccctaactattaaaaccgatgcaatctaactccctcggtaattttggagggtgatttcactgacgtgatgcctacgtggcaatgttgacccggtcttcgtcctacgtggcgttgacgtgacacatttgtgtcattagaattaaaaaaatatgtgggacctatttgtcattaaaaaaatatgtggaacccacgtgtcattctctctcatcccctttttcctatagatggccaaagggcccgcccggcatggcccggcccaggcacggccgagcacggcccagcagcaatcgggccggcacggcccgataggcacttcgtgccggggcgtgccggcccatgggctgcacctcccgcccaggcacggcccaccagttgtcgggccgtgccgtgccggcccgaaggcatgggtggcccatcgggccttttttaaaataagtctatttttcgtccctcctctttggactatttcatatgtatagctaaaataagtctattttccgtccctcctctttgggctgacatatgtatacctaaaataagtctattttctgtccctcctcttcggctgacatatgtatagataaaaaagtctattttagatccctattctttcgttcatggcatataatatgtctaatttttactt

SEQ ID NO: 74922 - DNA, 19472 bp, Oryza sativa
catccctccaaaaacccttatatctatgaaagatcagagtatccacgtattggacttgtgctaagattctcaaggagataggattagatctaaattagattgtacatgtattatggctgatagttattgaacaaagtgtaagactgcatattatctaatttaaaagaactcactatcaagctgctttaaattcactaaagcatatattgcaaacatcattttagagcaagtctcttgtgttgaagactacgagcttatcagcagaaagtcaggagaaaaggggagcgcatgcgcacacagagagagagatggatagagcgcttaccttgtaaagcacatagttaatgatgtgttccaacacctttctagtctcagaagaggttaattgaacaaaaaatagtgtctgcataaaagaaaaaacaacattaacgccactattgctaatatgatatgcatacgttaaatataagctaagctgcaacatcctctttactaaaaatcattaaaagaaatctggatgctcaggtaaaatggtttccgctaaatcatggattggaacaatggaggaagaacaatgccctgccttgtgccttcaaaaaggtcacctggacacctggctttgtaatagtatgaaccatcctttctctcatatataagtcactaagaatctaaactaggatagcagactagaagtttagcttcctctatgaaatagtgtttttatataacatagttatcatgtttgcaatgcaaactgtatgcatacatggaggacgagcttttccaacagacaaaatgctttgattgaactacaaaattgggtcaaactctaatgctccttttaaagattcctatggaagtaaaaataattaagtacagccagtttacgacatgaatcaagaagtggatgtatcaatacaagttcttacatgaatattaaaccacatgcacaaaaatgagtctagaaggaaatcgcaacgaaccaagtcacacactgtcagcttagctcttgctctatcaaagccatataacagccattcagagacgtaacagaaatcctctagcatcgaacaacaaaagtaccacatacaaatatccagttcagatttcagaaccgcttaacgtaacaaaaatcctctagcatcgagcaacaaaaataccacataacagaaatcctctagcatcgagcaacaaaaatactacgtacaaatatccagttcagacttcagaatcgcggtgttcaagcctgtattcaagcatgttgttgtatagttgctattggcattgctacttccccatatgttccaactaccatagtttagataagcatctactcaactgaaatgcaactcctgagaacatgtggttcttcgcaatcagctaaagcacaatattcctactaaatcactccattatctcacacacttgatgattccaaaaacaacatggaaacaaaatgtcattagctgatttaatgaaggaaaacacgtccattctaactaaacaaattaagtttatttctacctaaacatcaaacatatcttcagcacgcaaattaaaccaacaaattgggcagcaaatttgaatcaacaaatttgggcagaaaaaacacctccatcttcccaactatcagcttgcatatattattattgcttatattattattactgacaagtggtcaaccgacaaaagtttttttttccccaaacagcacaatctaagcgaatgaccgcgtggccctgagcagcaacaatcccaacccccatcccattcccgatcgaccgattgctcaccttgagggagaggatgaggacgaggaacacgtgcgccgccagattcgccaggagcgcgacggtcacgtgcgagcccagcaccgtgccgagccagtcccctcctcctcctcctcctcccccgcccgccgcgtcggcatccccgtcgaggagggaccccgcccaccactgcagcgccgcggcgctggccgcggtggatgccgcggcgacgtagaggctgttcaccgccgccatgcgccgcgcatcgaagacaggtcccccacccctcctccacaaccctatggcctcctcgtcgtcctcgtcgtcgccgccgccgattcgccggcgatgcgggggaatcgcggggttgcttgcggctcgggggaggtgtcgacgacggctttatttcgggggggccgcgacgccgtgagaaaaggggggattgaggggaggaagaggaaggtgggggggggagccagggggacaaaattattgacgacgggatggatagattggaattaattatgttaattaaagtctagatatttgacgggtttaatacgggagaattgtgcgtttcagtcctaagggttatctgtaatattgtttctttcctaaaatagattagtactctctctttgtcctaaatgtgaaagccatataccagattagatattttatagtaatatgaatatgaacaggaaacctctgatcatattcgtctgatgctagtttctatatattggaatgaatggagtaataaattttagctatcaatttagacaaagtgcatgtatagattcgtagctaaaagttactaaaagtgcattatacattttatagtactacgaatataaatatgaaacatgattagattcgtagtattttaaaatatcaaatctgatactatatttctatatattgggatgaagggagtaataacttttagctatgaatttggacaagtgcatgtctagattcgtactaaaagttattatattttgggatggagttagtatgatgttagtattatttcttttcggagggagaactatgttatggttggatgatgccttcaacttgccaaatcccaactttaggtggttgttttgcagttgtttagttgatgccattgttatgggtagctatatttttcatcggcctatttcaaagacacaattttttgcaacactttgcctaaagcttcaccttatgtaatatgaggtttggcaatgttaatcatcaatcgaacatatctttatctatctattgacatgtttggtattgctccagcctagagaaaactcaaagctgtagagtttggacttgagctatgtttgatttggattattaggcagattactgctactgattatatacttaattatatgaataaattgaatactttaagaaacaaacttaacaaatatgcgtcctttgagtgtattttccaaagcttagagtaaataatccatttcaataatctgaaacgaaccataaaattgtttaaatatgacaatacacgcatacttaaatgtatatatttcctatgaatatagaagttggatttctagcaactattgtatttctctaaatttccctgtcaaacttacaaaccttctccatttaactgttattaccatttactgtgcacatgtctcctccctacgattgttgggggctaaaatattttttttatctctctacattaatattgtaataatccttttccagttataatagcgaagaaatttattgcaaaaagatagcggtggtgacagtgaacccgccaacccatttatcctatcgtaaattttgcaaattactcattcaaagatttaatgttaaaaatagagaaatatcgtggacaatcacatatgaaatcaagtgaatgtttccctataaaagataaggtagtaacatatttcatgaattatatagttttacttgtatttgataatagtatgatatagttcttttatcatagtaaagcataaacatttagctagtatttcgaaaaaggatgtggtgcacacacaaaagaaaaagaaaagaaaaaatggttcatccacggaatattgcaatatgctgcgaaggtaggtgcgtttgtgcaaaacggggtacgggccgcgtgcgacgcctgcctgcgcacaccaccagcagcgagagcgagagagggggcgtggggcggttggcgcgccaaggcaggtgggtcccgtgcgtcggtgagtaccggaaaagcgagagctcggtaggtgacgcgtagagcagcaagccgcgccacgagcgagtgaccgcgcgacacgaccccgacccggcccggtcggtgcggcgcggcggaggtcgcccgggtcagccgctcgccgccacgcgagacgagacgatcagacgagggctaaaataaaaaaaaatcttctttttttttccctgggcttgctaattccacgctgcccctctttaggggtggaaacgagccgagctgagctcgcaacaaactaatttggtttggcttggcttggttagggaaacaagttaaaactttagctcggctcggctcatttcttggctcgagccagttcgagctggcttgcaagcctttctattgaaacgactcttcatatatattttataaatattaaaaaaagtaaaaacaaatcattaacatgtaaaatttaaataagtttatatattcaattcttcaaaatcttaatgataaattttaagttgacaaataataacgccatataaagtaaaataatcgatataaacacacgatgcctaaggctcgcgagccaaaacaagcggctcgcaagctagctcggctcggctcatttcagcaacgagctaaaaagatggcttgggcttggctcgtttgacttacgagccgagcctagccaaccaaactcaagccaagcccgagccaagctcacgagcacgagttttttttccacccctacccctcttatccgtttgtggacacagcgaggggcattattgactttgcagaaatggagggagaaaaaaaaaagatgcactgctaaaaaattaaaattatactactcgcttcgttttcaaatactccagtagtactgccactagactgccaacattgactaggagacattcgtttttttcttgaccactaattattcctcaatagtttgattagactatgaggatggaagtgtgcttattccttaaccctaacactatgtaaagagaggattaaattttggacgtggcacgcttttcaaactgctaaacggtgtgttttgtgtgaaaattttctatatgaaagttgctctaaaatatcagattaatctattttttaagtttgtaataattaaaactcaattaatcacatattattacaacattgttttgcgtgaaacacttaatcttcatcttcatcttcatcttcaggagatttaaacaccacataagagaatggaagttttattctttgttgaacatggtcttttagttcaaaaaattccaacttattttttcaaactatttcaatattcgatcactttattcccttaagtattttttaagcttagtttatcctgaatttaattaaaatggttcactttattggttaattgcatttctcttctttgtttatctttatatgagtcatactttaagcttaaattttatagagccatagatggcatcattatcaaatttataaaaatttaataactacttgcttgaaagttaaaaccttcatgttaaaattagtttcggtgtttccaacctatgtaaacagcgataacaaaaaaaatgttgagaggtaagttataatacatatattaatgctatcaaattttatttcaaaatatgatttatacaggcataaacgaaaagcccaaatattatcatggagtaaggtgaactattgttaagagttgggtataaaatgagacgaaaagttgtctaagggttaagtgctctggtgaaaaagtttggggagtaaaattgacattttgcttttaagttactcaaaaaatggcctttttttgctttttttataaaatataaaagtttgaggatgaatgatttctattgccagctatttaaaaatgggggagtaactattttgctatgacgcagtatactaaagtgttgattgtttgcgctactttgcagctgcaggctgcatcaacagtagcagctactcaaaaattaaccgcggcagcagcagcagcagcaaggctgtgctgccacagctagcataaatgaacaacccttaattattctattcggtaattacatatttaacactgaaataagatattgtcaaacatttgaaactttgacaatcaataactctaaaattagttaatttcaaaatgcaaaagtggtatgggcaatctgcttagaaatgtactaatgtacttcataatatcttaaacttattaggttaataaacttgttctaatataaacttatgaccaaagttacacaccaaagaccttaaataacaaatatcgtattttttttactatagaaagcactgtcagacctctagcagcaggtattatacaataaaacaattaccagactgcaataaaaattaatggtttgcctcacaaagtaaatgggcacccaattaatgcacaatacaacaagaatagtacactacaattaatcttgtatattataacaattgaccccatgtagtataattattgcttgatccaactatcacaacaacaaagcaaagtgttagtctgtctactagcagagaaaacacacccttaacttgcatctattttgtagcatttttgtcatgttcctgcagcagcaagtgggttttccatatatatttcatacattgagctaaacacaaaccaggtttatcggttccgttccaatatgtgccattatattccaccacctaaagctatgaagcgagcgagcggcatattgttccaatcaaaatatcgttaatttcagttattctgattaaattctggtcggtattgatcagaattaacataccacttgtttcagtatattttaaacatgagtgatctttccgttgaatttggcttggtcgattcataaggatacatgataaattttgtaaaatatgatagtaacatgatgaataactttgaatcactctatttatattttgtaaattgcaagttctattctggagtgatctttatttcagtccaaagtggctcttgccatgcactggactttgctcgtgcaatgttcatgtattcttaataacgcggattcacctaaaggcttttttatagcattaactgcactaaaagtcagtgggtcacaattacattcaaagaaaggattatgtctagctataaactcaatcatccatgttatattgctctcattgctatcatttttagtataattatgggcacaaatttgataaaatattgcataatattccctccatcccatcataatatgagggattaaattatttaaatttgtcccaaaatataagggagtctagagcactacctgtgcaccaattgaccctcattcaattttcttcccactaaacaaccttccaaccctaatattgcctaatctagtagggaaaacatatattacaaacttcatatgtagtgtaaatctggaaactgtcgtacgatgtacaagtgaacgtttgagatttgtctatatcatcataagcaattttttttactaccagaacaaaaaattacttatgattaaatctaggagaaaaatactcaaggtgatatggatgaatctcggatgtccattcgtgtatcctacagtagtttctaggtatgcattacacacttcctcaatctattgaggggtatttgatctttttttcattttccttaatctctcaaatgcatactaaaatcacttctagtatatgatggagttagtaacatatttatactctctccatttcaaaatgtttgacaccgttgactttttagcacgtgtttgaccattcgtcttattcaaaaaatttaagtaattatttattcttttcatatcatttgattcattgttaaatatactttcatatacacatatagttttacatatttcacaaatttttttgaataagacgaacggtcaaacacgtgctaaaaagtcaacggtgtcaaacattttgaaacggagggagtattatcttattaaaccctgaaacggtacatctgtatcggttggtatgagaacttcctttctaagagccaaattggaatggcctctcgaatgaaattgacaatcttgatgcatatagggtagaaaaaaagctcgcttgcccggcttgatggctcagtccaaaattgttgcgattcatctagtttttcttttgagatacaaatttcaatctgaaaccagaagacgaagcatactaaaaaccgattggtatcttcgaaaaatagataagaaaaccaaatttgttttcgtcgaaaaatatagaaaaaaaatgttagataattggaaaaaaattgtgaaaatgccatttcctataaatttagtaatctcccattgacatacacacaatatgtaatacatattcataaaagacaatacatatcactcaccagtcaccaaccattggccaaatagaatgcctgtcacctaaatattaaagtccattacgtacatagtttagagtccaatacatatattgaagtccatttcattactacatggaatttggcccatgaaagggcttccctttttctaaataattattcttttctttcctactggacaattcaagaaatgcatggaatgcaacatttttttgaaaaaaaaaatatcctagtaggctctatgaacatcaaactatttataggatttgatttgatttttttcgttttttatcattttaaatttaaatttgaatgaaacccattgaaattctagacgactactacttttgagtcacgccaaaacttcagtgttcatcgaaattgtgaaccctctgttcactccctttagctttgtagacatacatagatcaatccaaagggcatgcttggtcactttcacacattatcacatgtgcgtttaaagcatctaggcccccgtcgttgattttggtaattaatgacaagcgctatttgtgaactaactattatcttgagttatacattttgagataggttcatatgatgtgtatgccatggatgactatcgaggattaaaatcgatggcgcaaagtaaaaggaatgaagacagtaaactagtggttttattttaattgatcgaggagtttgggcgatcaaaatttgctatatttatttatagctttgtcatactatcaaaaggggtaatgacctaaacaaaaagatgatcaaaatgctacattaggtcatttgtatttagacttggttctctgttagaattgaattgcatcttcggtccagggccggtctgaccgaggacattatgccggtctgaccgatgatcccaagtcggcctgaccagcgggttgaatgcctatggttggcctcgcgattggcgacccagagccgccagagccgcagccatggccggtctgtccggccaccctatggcggtctgaccgacccccgtgtgttaatacattaaatgcactgtaacggctagttttccaaccgttacaatgtagtccggtctgatcggccaccccatggcagtctgaccagtagagcacggagttggggatttcgaccctcaatggctagtctttgtgtgtgtgtgggggggtataaatactcccccaccaacaacagggggactctcttggcacttgcttcacttgcatataccccttgcaactactctcacactctctagtgtttgtgttcatccattttgtgtgattgagggttgattagtcaagagtcaagtgtattgcttcattgtagagctagtgcggcacttgatcatcttcgagccgggtcatcgcttgttactcttagaggttgccatctcctagatggcttgtggaggtgtttccctgtgacctctccaaggagattatgaagaaggcccgacgccagttgtgagtggtttggagtttaccacctttggagttaaggaagaactacctttagtgatcgaggctttgacatcctggccgagggcttaataggattaatactcatatcaacaagttgcaacttcttttccggaagccgatctctaaagaactctgaggttaagcgtacttggcatgcagtaatttagggatgggtgaccgatcgggaaactcttcccgagtgcgcacgggtgaggacaaagtgttcagaaaagactctatgagggcagtctataacctatgaaagctgcaagatgtaagtgggctcggcctgggaaaggcgggacgttacaaaatggtattagagccgactctcgcggtttcacgggcgcgcgtcgcagttgcataggcatgtgcgcatggctggtgtggactcttgcggtttcacgggcgcgtgtgtcgcagttgcgtaggcatggtgcgcatggctggtgtgtacttggagtggtcacacagcatggcacatgcgctggcattggacacacggacgtggccaagagggaacgttcctagcttgacaagttgcaacttcttttccagaagccgagctctaaagaactccgaggtctcgcggttttacgggcgcgtgtgtcgcagttgcgcagacatggtgtgcatggcttgtgtggatatggagtggtcaaacagcatggcacatgcgctggcattggacacatggacgtggccaagagggaacgttcatggcttgacaagttgcaacttcttttccagaagccaatctctaaagaactctgaggttaagcatgcttagcctggagcaatttagggatggatgactgatcgagaaattcttcccgagtgcgcacgagtaaggacaaagtgtgcagaaaagactaattttggtctatgagggcagtatatgacctatgaaagctgccagatgtaagtgggcctggcctgggagaggcgggacgcttgacgaagggggcatgcggtggatagaaagctgccagatgtaagtgggcctggcctgggagaggcgggacgcttgacgaagggggcttgcggtggatagaaagctgccagatgtaagtgggcctggcctgggagaggcgggatagtccacttcgtgggccggctcccacctcgcccaccccttgacgaagggggcttgcggtggatagaaagctgccagatgtaagtgggcctggcctgggagaggcgggatagtccacttcatgggccggctcccaccttgcccaccctatgacgaagggggtttgcggtggatagaaagctgccagatgtaagtgggcctggcctgggagaggcgggatgttacagaggcttgggtagtccacttcgtgggccggctcccaccttgccaccccttgatgaagggggcttgcggtggcttcgtggttttgagcggtgaagttgggttcgcctcaacggggattaggaaccggcgagtttccgaacctcgggtgaaaaattccttgtctcttgcctcatttacttattgcattttcatctgtgcaatttactttcatagagacatatctgagcccatatcaccctaggatttcaaaacataacttagttgcaatttactttcatagagacatattttaagcccacatcactctaggattgtaaaatataacttagttgcttagttaagtttatccctcaccaagcctagcaacttaggttagttttgattaggtgtgatttaattttaatcgcctatatattcaccccttgtaatcgacatctcgatcctacaacgtctaataatttgctagtcactggtgcatgggaagcgtgggaagaggggaagggcaatttcccttttactgtagtaaagatatgcttcctccgttttcaaaataaataaacctagtatgtgatgtgacatgttttactgctatgagattattaatactaactcatagtactaggatgtgtcacattccgtattagatttgtttattttgagacatgaataatatgggattgtggtgggaagagaacgtcgtggttttttataaataggattggggcgagaagaaaagggaagaaagacgattgtgctacatagtactagcaaattagccatgctatgccatgggatacaaaatgaaaccatttttccgtgtttgtagtaggaaattttagttttgtttctattcattttctaattggctggttttatggaaaaccattctttcttctttttttttggtggggatggggtgcaacatcgattttctccagtggtttttttagatttgttgaaagcgtgggtagagaggaggacgacttcctttttaatgtagtagagatagttgcctattttttaggagaaaccgttgtttttatagagcattagatcacatcattggttttctccgctaatttttgtagatacatgggaagcatggggtagagaagaggtgggcgacttgggctgcactcatttatgatggttaggaacttctcacatgggcttaaaaaacaagataactcatttgcacatgattaatttagtactccctatacagtatgcaacatatcttaaagactacaaatctggatatacagctatccaaatttataatcctaggtcatatcctatcctagatacatttatattgggactgtggagattatgggtaccccatacacacacggcatggttatccgactagttataggggataacttatatctatgaaatatgtaacagatcatgacttgggtattacgtttccttgtatattatggaacggcctaaggtcctggtttaatgatattgtaaagtagatttaggaaactgataccgtattggttaaggtttctattttgtaatcctgccctccatcctatataaggtgggcagtaggccctctagggggcagatgagacaactagatcgtcagatctataatacactcggcggattcaaatccccaaacagaagtagggtattacctctcattgagagggcttgaacctgtctaaatcattgtctccgcatccatccacttttaggtctcgtgcgctaccccttttattattgccgaattcttgtttcgacaaggacatagggaatattaacggatttcggtgattttttttgagagagagcattagagcaagtttaatagaagtatagccaactgttaggtataaaagctattccgttcatctaatttaatagcctaccatacaatagtttcatataaatatataatacactattaatacttagcccatctatcacgaaacctctaatgggcgatcgatcgcccagccgatggggtagcgatcgggtagcctcccccctccctccacctagtttccttttttgacaccgtattactttcctattttagtaagtttatacacagtttacacatctaaagtttagagaccaaaagtttataagtcaaaagtttatatatccgattcaaatttgaatttgaattcaaatattttttatatatagtatttctatacatctaaagtttatacacctaaagtttatagacccaaagtttataagtcaaaagtttatatacccgtttcaaatttgaattttaattatatccgatttgaatttgaattcaaatattttttatatatagtatttctatacatctaaagtttatacacctaaagttcatacacccaaagtttataagtcaaaagtttatatacccatttcaaatttgaatttgaattatatccgatttaaatttgaatttgaattcaaatatcttctatatatagtatttctatacctctaaagtttacacacctaaagtttagatccaaagtttataagttaaaagtttacatagccgattcaaatttgaatttgaattcaaattttttatatatagtatttctatacataaatttttttaacttttgttttttttttaaaaaaaaatttgtggtgtagaaggaggggaggaggaagggggagaggagggaggagtgtattgagtataggggagggggaggacgggacccgcccattaggcgtgccccatctatcacacacacgtactcctccgttaaaaaaaaactcaccatcgaagacaataaatctgaacaatctcatgtctagattcgttgtcaagttattctttgttttagtggagggattaatatcttaaaactcgtgctgcagttcaacataaatctgtactccgtttttcttttatctccttttctctttcttcgcatatgttttttatgggtgaggattctctaccataatgtcactattacgtgaatcccacccttctattatttcacatgtcagtgtctgtaatggtagtgtaattatggtagaagatgtgaacccgttttttactaccttgtcttatagtattagatgtgaacctgttttttactacctatcttatagtaatggtctactgtatccgtcctataatatagcaatctaggatatgatgggatgtttcatagtgcaactaatctggatagaccttctgtctagatctattaaactataaaatgtctcggctgattctaagttgttatattatgggatggagggagtacttgctattacaacaactgatcaagcaagcaaatcaccgaaaccgctcccgaaaattcaaatatccaacgctccatttcgcttccccacccaaattcccaatcccaccccgccgccgccgccgccgagcgataccggggccgccgctccccatggacgccggcgacgcgagccgcttgggggagtcgctggacgccgtctccgccgccttccagtcccgcgtcatggagctccaggagctcgtcctcgcccgcaacagtaagctccctctctccacaacctcacccctcctcattcccatctctctctctctctcctcccatcaccgaaaccctccgatcccctgaccccgcctgcctcccccacacgttcgcagtgtacccggctacggcgataccggacctcgccgccgtcgacgtgtcgctcacggccatggaagcgcagttgcaggcggtccgccgccgcctccaggaggagcgcgaagccttccccaaggccaaggtatcgtcctctttctaagatttaatcaatgcactgttaaattggcagtacaggttgttccttggttgctgatttgacgaacatggggaggggatcgacacaacatattttgattaggacctaaacaatcaaagggatttgatacccactaatcccttgttaatccaatcctcctgtggcgtgatgggttgtgtagaaatggttggattaatcttgcctgttcctgcggcgtgatggggttgcagtgagtgtctgggtatgggggtaaatggatatatcagttaccgtagtttgagtatttggagaattgaacaaaaacaaggtctttgtctttctgggaaaaaaaagtattatatctttcgataattttgctattgctcctaaatccaatcttaattttgttcaatctacccgtgaaatgaaatatttctaactagtgatttcctcaaatactgatgtagaaactagtacaacagtccttgaagcaacagcggaggctgcagcttatgcttgcaaacatgccaactgggatgcgcgaggatgtctttgctacacctctggaacataattcatcaatgtatttgtgaatattaggaaaatacattggctgtttctaccttcatttgtgatatcaagttttgtgcgttacaggatgtttcctgagtcgctcaatttcagctcggctgttccagaagtcagagaccatgatttaaagattaaggaggagccaactgcaccacccaaggtaaagatatacaatcttatgtaacttttactcattgtctacaattcttttcagatagaaattataattgtgtcatcatctaatttattcttttattactgagaagaagggaagaggacctgcacctcgttggtacatatccactgaggagcttgattcgttgtcatcgtgagttctcaattgcaatgatagcttcatttcatttacttgtctttatataccaaccacattcctttatctgcatccaatatgtggttaagtgtttttttttggtgtttacatctgtccgtttgagataatgcgatgtataccatatgaatgtgctacttctttctacaccattcttcttttctgcatacttagattttcttttctgaacaaatggtaagaaatgctaggtgaatgttttgtgatttacctagggcctgttcagattgtagccaaaataaatcttaccaaattttggcattgtcaaaattttgccaatttggcaatattgccaagttttggcaagatttcttatttatttattagagtttggtacgaaactaaatggatgcacatatttggcaactttgccaaaaaaatggtatggtttgaaatggcatcaatctgaacaagcccctagaattgagcctagacatgacttgcagtcaaaacatctgccttctttgcctttgcatcatctttttgctatgtgggtctcacaggcaatgaaggttgtcatgaggtttatattatcaatccagcactactgagtatggagataagtgcctatttacctatgttcctataagttgaagctgttaaagtgctgcctattggttttgtaacccatctatttcattatacaccaagttcaatcagtagagaacctgaaatatcaaaactcaagagacaaacaatgcaatatagctggtatggtcaacttctttgagtttcttataaatctaggttctttgctaacttgtctttaagaaatggttatacactatagaatagacgaaatcacatggaagttggaacaatatttttactcaggaaggttgctatttcattttcccattgtgtagaactatataagacatgcaaactggtgccatgccttcaaactaaaaatggcatcccattttgttactacagatacatgagagggaggctcactctggagaaggttaacattgccatcaatgaagtggcttcatatgcggacggcaatgctcatcttgttgcatgtccaaagaaaaaggttgatcatttcaataactttactccaccttttatttataaaaaaaaatcaagattattgaaaaaacagtgggaactagctggttcctgcacataaaccaaatttacccccaaaatcagatgtttcattttctgtttttactaataagcatcatttgataaactgtagaaatttccattcttatgtggagactttggagagaacttgaatataatataagtactaaccgttaaggaaacaattgaactttcccgatagcagaaaccagcacatcttttgtcacagttttcaaatcaatggaagtttaacctgtaaacagccattgcccagttgtatggtaggattggttgttgaccatccttaatgttcttgcagttatcagaagacacatgggagaaggcactggtaagttctggaaggatgttgattcgatttactcatttttgtgcggaatcagcatttttttttctttttaggaattaagggacattgcagcaagagagtcagttaaggggaggcatttcttcttggaaactgatataaagggaccgggcttaaaacttgataccacagggaaagcaatccttactgtaagtatatgcagctttgaccacttgtgtacaaatgattttttttcttctatatctctaagatgattttaatgatatacatatttggtagacaaaaatgctattcaaatttttccctttgtagttggcaccctttcaaagaaatttggtagcataatttgtatttgtcaaacttgaacggggtagagaaagaacatggtacgctaaattaaacattaactgtggtattgaagttaagcagttaaacaattccattcatatgttttgccctgtttaacaaaattgatttaacatttcataactcatgcgacgcaccatacttacactgcattcctgtctgtttatttgtataacagccagtattaacgagactactagtaaagccatttacttggcaccattaatgatgaatatttgcttgaatgaaaataggatgctacacactaatttcttgaagatgtgaaacaaaaactactactgatttgctcttgccaattggaattttccttttctgccgcattaatcttctcgtgttttttcaggtccttcgtcatctcggccgcttccaggagacccggattgggcatcatcgcgttttcatactttcaaaacaacagtgaatgaagggtctcctccaagctttatttaggtgctggagaatataaagtttaatttggtgttaggctggagatagatacgcatgcattgagcttgtttactaattgctatgctgtagtttgttgtatacaggtcagggcaagtactataatgctctatatgctacccctaaaattgccatattggattgagtgatgaggtggaggagataagtgaggagagagatgatgaaccacccctaaatcaagaggcaacctccacacaaatctattatctatctatctatctatctatttctattatataataaaagtctattaaattttctacaaattttctcaagctgccacgtggcattctacgaacgcttctaagctgtcacgtggcacttttagaaattagaaaatttcttaaaaatctataaaaaaaaggaaaacattttactgttgatttttattaaatttagtggtcccattattttaagcgtttagatttatccgaatcaacctacaggtaggaacgtacgcacccctctttctatgttatggttgttaagatttaatccataatttgttacagattaatctatctatactaatataaaaaggagttgtctccttgcaatcttacaggtgaaatccacatacttaatccccaccgtccatccgacatctcatctaatctgatccgtcgtctcatctcatcatcatcgctgtgctaatcccaccgattactccgcccccgagcgcgcgactccgccgctccaatccccgccccatcctcgctcctcttcacatcctccctgctcttctcatctcagccgcacgaatccccgccgcctcgatcactcgctccgctcgattccccgttgccgccgttggaccagccaccctcctcctcgctctgtgtgcatcctccctctctcagcagcacgaggaatccccgccgcctcacctgccccggctgattccccgcggccgacgcagtccaccgccggaccagccgccccctcctcgctccgtgcgcatcctccctcctctcagccgtacgaattcccgccgcggtccactgccggaccacctcattcgctggtgcgcctcctcgcgactccccgccgcacgccaccgcatcgtgcccctgcaggcgacgtggtggttcccccttccgccagagccccatccgagatggccgcatgcagtcggcgtcaatccagggcctccatcgcgagctcgatctgcagcccttggtcgctggcgttcgaagctggccccggtgtggagcacgccgttccgcctctgttcaaagccctccaactcctccagccgtaatccccaaccagacttgctccatctatcgccaacactcgatctg

SEQ ID NO: 74923 - DNA, 58553 bp, Oryza sativa
ccctgcactacatatacgtggtttccaattttcccggatgatgagcccaggcgacaaacctctcgactcgacgacctcgaaggctcgaacgactggacgtcctgcccatcggggagctcccactcaaaccagcacgccatgttcgccaccacgagctccgcgagccgcgtcgcgaacgccatgccggggcaccccctcctgccggcgccgaacggcatgaaccggaagtcgccgccgccgccgtagtactcgacgccggcgttgtccccgccgtcggcgaacctccccggcctgaactcccccgcgtcctcccacgccgcctcgtccctcccgatcgcccacgcgttgatcatcacgcgcgtccccgccgcgacgcggtggccgtggagcaccgtgtcctggatcgcctcgcgcgggatgagcagcggcagcggtgggtggaggcgcatcgcctccttcatcgccgcccggaggagcgtcatcttccccagctgctcgcctgctcctccttgacgatgacgacggcgtcttcgtctccttctcctccgtgtgcagctgctacgacatgtctcacctctgcttgcactttcgccatttctgctgggttcttgatgagctcggccattgttcattctatcgacttgtagactgtgtccgtgcctgccgcgaacatgtcctgcaatgcgacatgaaagaaatcgaaacgaattttagcatgattatttgattggtgataattggagagaacttaccaagatgaggagtcccttgacatcgatcctgtcgagcttgtagccatggtcgtcgccgccgttggccatggagagaaggtcgtccatgaggtcacgggcctcgccgtcgccgtcgtcgtcgtcgtcgtccccgcggctcggctcgtggtcacggagcaccatctcgagaacctcgtcgagcttggccgccgtcctcttcgtcctcgcgtcgagccccgtcgcccagtccacccaccggagccgcgggaacatgtcgctcactgcgatcgtccccagcaggtcggcgagctcccccaccgtctcgcggaccttcgccggctcgacgccgccgagcttcttcccgaacgccgccctcgacacgacggcgtgggtcaggccgacgatgagctcggtcaagttgacgacgcctccgcctccgccgctcgccgcgcggatccggttcacgaacgacgcgacctcctcctcccggagggcgcggaacgagtcgacccgcctcgcgctgaggaggtgcacgacggcgacgcggcggaggcggcgccaccgctcgccgtaggggctgaacgcgacgtcccggcagccgtacagcgtgccccgcgccgtgtgctgctgcggccggccgcagaacacgtggtcctggtgcctgagcacggcctccgccatggacgccgaggagacgacgagcgcgcgcacggagccgagccggagctggaacagcgggccgtgccgccgcgcgagctcgcgcagcgcccggtggtgccgcccgcggccgagctggtggaggttgccgatgaccggcaacgccggcggcgacgtgatcgccgcgccaccacggccaccgtccgcgccgcccgatctcaggtagctcctaaccgcgacgaccaagcacgtcgccaagaagagaaagccgatgagcaggccggagtcgagctgcacggccgccatgaacagagctcacgacacacacggtgtacaatgtgcaagccttcactgatttccttggtcactttagagcaggtacaataacaggctataagccagctgcaaacatattttaagaagataaatgaggagagagaatggcagtgggctacagatttgtagccagctgtagcacagactccaagacacagtgtgtgtatgacagatgggactaggtattaatagtgtaatatgtaactattgtatagatgagctattagattgactatagatgaattggagctagtagctagctggctatactattgaacttgctcttagacatgcaactagcttatgcacgaacctccaaaaatcctatgtggcccaatcaggtgcaataacatggacctcgatgacatcctataggacacgccagcaatcatagcaaacttgcctatgaaatatctgggtctccccctgattacaagccggctgagaaagacatacctccaaccgcttgtctacgcagcctccaaaaaaaagaatagaacgcttcagcaggcttcgcaagcggaccaatagcttctcgacttggacctgcaaggaaatgcgggctggacgacaaacctgattgaccaacttatcggggtttggaacgcactacacatggtagagcacgaggaggacaatataacatgaaagcttactaaccatagtgaatatatgatagtgtcatccaaaacagagtctggaccttcgccaagttggcgaccagaggttggccaaatggttccatctgccccttatgttgtcggacccagaaaacaaccctgcacctcctcgcggaatgaatctagcggcattagcggagcgggcggcgtgcggacgactaaatcctagtcagtggtggcaaactttgacggtgatagatttttttttgactaaatcaccggggggggagagaatccccacctgaatatattgagccaaatgatcttacacagggcaagctttacctacgcaagcgcaggggccctggaggataggagaacagaatacacggagaatacaacgaggagagaacagagaaagaaaacctcctaaaagattataattgatgaacgacacctgcaaaagttatcttgccaaaatacaagaggcacccaataaggcactccgcactttgatgctgttggtcggctagaagatatggaacgaaaggaatcgcataaccttccaacaaaaggagctttcagctacctctcttctagccaagatcaaggaagaggccaaaacttgggccttagcagaaacgaaaaatcttcgtaattagttttcttttagttagctcagaccaaaggtcctaagcttcttttctttcctttcgctttgtaaagctactccttctcaattcaatgaaattggcgctcgtcaattcattaaaaaaaagatatgcactatagaagttaagaagtacgcatcaacgcatgggcacagaaaaaaaattcaggcgggaaatacaaatgcaaatgcaaatcgaggaggcaaatccaacatggcggggagaggcatgatgccacgtaatacaaccatggatcacattaatggcgacgacgacgttggccggtgccaatttttccacaggggatttgctagatttcaggcacgtgccttttccccttccatatgcagcattaggacccgtttagatccctgccaaaatttttcaccctgtcacatcgaatgtttggatacattcggatacattcatgtagtattaaatataaacctaaaaataattaattatataaattgcgtgtaaattacgagacgaatcttttaagccgaattgctccatgatttgacaatatgatgctacagtaaatatttgctaatgacatattaattaggcttaataaattcgtctcgcagtttacagacaaaatctataatttattttgttattagtatgcgtttaatacttcaaatatatctctgtatatcacacgccaaaacttttggacctaaacacggccttagttgctggttggaccatcgggcctgggcttctataaagattgagctaacttttggggcttaatcgtctgatttggcccaacttggatatgggccgtttacaacatttggccccacacggattctcaagtcttacggggacggacacacctcatgcacttcatgccatctcgaccgtccaaaatgcaatcgaacggatgccgattcatctcaccatggacgcggtccagccaagcaatgccagcataaaccgcgtgcacctggtttatgtgctggtgtgtcctcgccgccgccatcgccggtcaactccggttcaaaaaaaaatttagagagaccaaccactcatcgtctctctacttccatccgcttcaaccttcaggtgcgccgcctcgccctcgtcggatccctagtagggaggggaggtctccgtctgccggcgggaggcgcgggcgccgccatgaccgggtgcgtgcgtctgcctgcccccccactccttgattggatcgtgtagcacttgccccgagctgttcccctaggtcatcggagggaatgcgatttgggattgggcgggatgcaaaggaggcgtccttttgggttctagggtttcgcgggattgcgttcccctgttatcctcactgatttgttgttgtttatcatttcggtttggtgaatgcgatttggattggggacagtttgctgtgtgctacagtgaaaacatggagattatcgcaggatcctcagacttctctattgttttttttttggattgatatagatgcattgtcttgtttatgaggcccggtgttcggaccgcgtcatacattcgtggaacagtgtgctcatgccttcggtgtgagacgaaaggttgtgtcttttttttttttttggttctctggcaggcgatgactgaatttcgtcactagcttgtagtgttgtaggcttttgtagcttggtctgtgattgtatagtagaaggatgacgcttctgcattgattttagttcaaaggagatacttttgtttttgccatttcggggggggggggggggggcgtggtgggggtgcagttatgcactacgtatgcattctgttctcttgcaattgattgaagggcacccagttctgctaggtgttgcaccgttttagtttagctgctgcttctttctacagcgtggttgtgctagttatagcggtctccattatatcaatttagtttgaaaaaacactagtggtgttactactcctttgagttaaaatgtgccaactattagtagcttgtatttgggtatacacctctccaagatgaggttgaattcctcatattcatatagtcgtgggtagcaatagataaccttttttctttatatgtggcctgctgataagatcatgtcatgcattgtggaacaatattttgtcgctatctgtttcagatgaaaggcgggatctgttttttagaattttttttttggagggggcaatgattgaatatcgtcactagtttgtagtttatgcttttgcagttaagtttgagattgtctagcagaagtacaacgtttttgcacttcattatagttgaaaggaggcatctccctgttttctgccatttctggtggtatggtacctattttatcaaatctttgttggaaagacattggatatagcctttgggttgaaattttgctaattttactattgttagcttgtctttgggccatcaggtatgcatatacatctctgaaagctagaggttgcccactgccttgtattcctactttagtacccttcacaaaatggtgaaaaaagactattgttcttagtttacgtatcattgtgaccagcatttcaaattgtgtcagaagagcatagttttgaacatatgcctgtcatccataccggagatcaatgtctcttgatttttgtaagctggtgcatgattggtattagtatagatatacagttctgagaaactacattttgttgtagattgaatcgtggtttaggagtacttgtctcctcaggattaattggatcattctttgggatcattttaatgatattagatgtgcctttacctgcatttggtgtgttgctggttaattatgccgatctatatgggagttcctgcagttagtgttcttgaacaaatctgcttcattcatctgtcttaactctataatcaatatttctgcaggacatcctggataattgacagccatagaattgcttcaaaaataaaaaatgcatctggatcggtggatgccagtaagcacaaatgggttagcaacccaactaaggcttgtccaaggtgcaaccacatcattgataacagtgatgtaagagatgtgttcttttatcatgtataagaaccaaatacgcacgtagtatatcatttgtatttcattcctgctttataccattctaaacagattaaacaatcaaataaaactacatgtgaacacctactgagtagtgtcattgttatgcacctttgttttcgtcgagtcgcctatatcaataaatgaatggatttttgctattagcaacttactatttatcactttgacagtgactcttttgtatattattctgaagtcctctgactttctctctaacatcgaagctttgtttgtgtatactttcagatacaccactcagtattaataaataatgtgtgctattgagtgcagtcctctaatgattaatatttcaccacaggttgttcatcaatggcctggtttgccaagaggtgtaaagtttgatccaactgaccaagaattgctttggcatttgcttgcaaagcatggcaaagttggtgcaaaagctcatccgttcattgatgaatttattccaacagtcgaggaagatgatggtatctgctatacccatccacagaaacttccaggtaaccgttagtgaaaggatatatatttttgtttctctcttcgtggggtgagcaagagaagtccaattttattttcatataagagtaaaattcacatttttcagcttgtatcaaatgcttgcctttggtccgttttcttttggtatttattttcttagtcacaccatatgcacaaagtttggcggtagtgcgggtgtggcaataaggctacttattttacttctctttattggcttattaacccttgatttttcactattccactcagcaacactctacaactaagtaattctcattgactggtttgcatttcttaaatggttccgatagagcattcaaattctactttcttttgacataggaatctcagtttctaactggaaaattgttgttttttgtacctctgttgtattgcttgtggtattcttcaactgacttttttttctttttcaggtgtcaagcaagatggaagcgtatcacactttttccatagaacatttaaggcctataatactggaataagaaagcgccggaagataaacactggtgatcttgctgatgtccgctggcacaagactggtaagacaaggccagtagtagttgatggaaaacaccttggttgtaagaaattcatggtgctatatatgagcaccatgaaaggtggtaaacctgaaaagaccaattgggtgatgcatcagtaccacctaggaactggggaagatgaggtagaagggcagtatgttgtctctaaattattgtttcagcaacagtttaaacctggggagaagaacgcacaggacttaacctctgcagatgctttagaatctatagttgctgaagatcttccaaatattcctccacttcccctggaagaacatgtttttaccaaccaagaactagaagttcttgagaaatctgaaactatcactgaccaggtaattgaacatctaagctttctttatttcccttccaccttttccctatgtgcagcacatatttccaggtaattcgacatagcaaagaaaatgtcaatatagtttctttataatgatattaaagggaattggataaatgttgtgccttcttttgctggcaaatgtacagggaaaagagactagcgaaataaacaacgaagataacgctgtagaagatgttgcgcatatggctactgagaaacctgaggatggagataacccctcatcgcaagatccgaaatggtgggaaggtgaatcccagttcctgttagactctcagcaactggcagagaaccttgcgatttgcgatgagttccttcagagtcagagccagacctcatgcggcggtggagatgatgaaaccgataagataaagccccgtcttgctgtttatgcccagttgccagtagaggacttgaagaaggatctggaagaatgccagaggttggacccctcagatggcacaaatcttgagcttgaaaatgcgtctgaatttcgactgagccaaattgtacgtttccattgtctcatgttaaaacgtccagttttctctccatcctttactttgctaaacttgtgcttcacttgcaggagttttcgcaggatagctttacgacggcatgggctggtggcaaggtgatcgattgacatgtctccaaggtgctgtcaacaccattttgtacattgaagaaacaactgaagcctcttccttctgcgagacaacagtaaaatgctgtcgatatatgtggtgaagcaactcttgtctcggacagtaaaaagtcataattttggcccggcggcttgccggggtaggcaaaaggtgagcttatgcgctggcttgcccctgaatcccttgatgcatatggactgtgcaccggtgactattcaatgctaaagatcacatattcctggctgtaaattgtgatggtggatgtctcattttgcttggatactctggaccatccggtggtacaaggggaacttttgcttctggttgaactgattactccaataactttcgtgttaataacttttgccatcatgatagtgcctattatttataaatgtggacacaagtcattttctggagcttgtggtaaagcagggctgagaatctcgtgcaagcttcatcttgtaaattgcagtaatcagcataagattgtgacagataacttccatgtttcagttcctatgcattactactatctaattttcctcgggcaatgagcatgaactatgcatgagactctacagaagatatcggatacgaccatacgaatggactaggatgaggatgctactactggccgccaattttgcttggcattatggtggattactctaatattgttttgtgaaattgtttctactacctccgtttcagattataagactttctagcattacccatatttatatagatgttaatgaatttaggcacacatatatgtctagattcattaacataaatatgaatgtgggcaatgctagaaagtcttgtaatatgaaacggaggaagtatttttttttcattatcaaaattatttcttttaattcatgttacaaatgatagctcctcgaaaatttgaacaccatttttttaaacatgagatagaagctccaccgatcaattaaaagggaaaaaagcttaacaaggtctataaaacaaagctataccgatcctactggtaacaaagttaatggacgcttaaaaaaagtatggacacaataactagaaagaaatttgagaatatacttttccttttaaaaaaatggacatgattgtaggaaaattgagaaaatatacacgtcatgtggcgcaaaactatggagtaacgggaccaaccaacaagttcttgctaatgggaaaaagagagggttgaatgtgggtgctgttcttattttgcccgagggatccgaattagcgccgcccgactgtatttctcctgagttgaaagaaaagataggaaatctctcttttcagagttatcgtcccaataaaaaaaatattcttgtgataggccctgttcccggtaagaaatctaccccgcgcattggctgagcgtcactgggttggtcccacagcccggccacgtgagactgagggcagcaacaagtaccgcgccgtgggtcggtcccatagcaccgggtctacaggccccatcgtttggccaagtatggataatagcactgtaataataatttataagtaataatagcactgtaattaaacttttatatatgtgctcttaacgatttaaataacaatgctgaaaaataaactttaataaaaaaatcaaaatcaacttcaaaattgagttgtaaaattcaaaatttggcagcggctgatattgtatggaggaaacgatgggaatcttaatacactgatgcatattgattttctcagttcatctatctctaccgagtttctaatccctactccctccgtaaaaaaaaagtttggacatagctaactacaagtggttttttatgtgaagagcacatgttatcatgatgcatcataacttcactaccccggactaaacaagattataatatgctgcaatctgcatggtttctgaaactttgaatccattttgaacaaaaaaaaaaggttttgagatgacatgtagacctagtggtgcggagctatatctgatatggaatcgattgggtattacgccgtcccgactgttgctaccttcggtcccgcgttgctgggccacaggactaacccactgccccgcagccgaggcgcagggtggagttggtatcacgctgttgagcaacggtaccaccgtcctcgttgtcggtcctgcagcttcacgccgcgccgattgacccacccatgtcttcgctccgtgggatgtgtatattttctcaattctctacgattatgtatgtataaaagcaaattcttaaaaatgaaatctatatcctcaatatttttttctaataactattacaattggatgggatcaatggcattaatttgatacgtagaacggttacgaatttaataagttattgttttcacaatgactaggcttatgaaatcaaatatagcacaacaacacaggctaaacatctaagcatcaattgcttgttctttccatgattgccgtgacaatatcacaataccttgttctcactaatactctatgtgattttatctctacctgacaaaaccaaataaccaaatttttcaccaacgtcagctgatgcacggtgtaattttggctcagctttgggtcccctagctgttgaccacgactcttacgacaggtaagtgtggtgtgtggataaaggtgggcccaagcccatggcgacgggcccaccacccagcggaggctgagagggacaccgtgggtctcggaaaaaaccgtaacggcgtctctctccgttacaacggagaatccttcgcaaacacggtacgtttttttcgtatccaggtccacctcagcccctatccttttgcaaacaaaaagagaaaaaaaaaggtgacctgattgttttatttgctttgcaccctgtcaatacttctttgttagataaacacccctgggaatatttttcctttggcaaatcttatctgcaaggaattgagtgcaaggaaagccttagaaatgacatagcaactcatgtttttcctatgtgatggattgagtaagtcaataatgtgatattttttattatgtggaaggcgtggccatgcataaataattattcatgtacactgtattcacgagtacatcgctgacactagatacactcaaagaatgtattcacgaattcatacactcaaagaatgggaggctaacaatagatccgtgacatcaataaaattgagggctgctagcccacgggataccgttgcaacggaatatttacgaaatattttaagtgactctcctttttccttccctctgtctacgtgtgctcccctagtacctggtaccttacgtaccggttggtacttgatacctgctatcttaggtaccggttggtacctagtacctggtaccttagataccaactagatatcgaccgatacctgatgcccagtacccaagataccgggtggtacctaggtatcagaccttggtaccaaggtatcaagcctgatacttgtggggtatcagagggtaccgtcaaaaagaggaggagacgtgggggagggagcgccgcaacggcggaggatggcgtcgaggaggcatggcgaggtgagggacgtgtgttcccctagtacctggtaccttagatatcggttggtacctggtacctggtaccgactaggtatcaaccgatacctgatgcctggtacctaaggtactgggtggtacctaggtatcaaaccttggtaccaaggtatcaagcctgatacttgtggggtatcaaagggtactgtcaaaaagaggaggagacgtgggggagggagggccgcaacggcggaggatggcgtcgaggaggcacggcgaggtgaggggtgaggcccaagccagagagcgcgagaagtctcgaggaggagccgaggaggaggttgacggccatacctgttgcaggtcgacgcgggctgtcagcgtccatcccgaaggcgcaaaagcggcaggccgcagcggggacgacagtgacgccgaggccgagggcgaggacgaggggagctcccgcttcttccctccccggggcgatgactccccggcgcacacccgacccgacgagggcggcgagccagagcggcgcagcgaggggaggcgagctcgagggcgaccccgccgagggttggccgaccttgccgacgcagtgccgtcgtcgtcctcctcagccgccggagacgacgacgacgaccccttcctcccggccggcttcgtctccgctcggtcttcttcagagagagagaggggggggggagagggagagggagggctgcagtgctgtgtgatttgggggaggagagtgaggtaggaggagaggattcggatgattttggggagaggagtgaggtaggaggaggggatcccgtctccacgggatgtcgtggtgtaggttttctgataaatttttattgaaagtagcacatgagcaaaagctcgcgagctttaccgagccgagctcgagcttctactgagcttaaccgagcttggctgtgtatagtttatattgcatgctcaccttattgatataataaactaatagataaatatatatattagtatctatttacacaataaattagcatgtgttagcacaatatatttattttagtcattttctactcttttattactgcgattaactagaaaataattatacttatcaagagattatcattaaaatatatattatgctacttatggccgagctcaagctcgaacgagctcgaatcgagcttgcctaaaagctcgaaggtgcaataggctcggcttgagctcggctcgagcttgtgtcgagttcgagcttaggcaaacgagctcgctcgagctcggttcattgacagccctagcggggagttaaactatgtatatttcttgattttttccactacatattcacatgaaataaaatgtagagaagtcaaatctttcttggtcgtggtgaaaaaacttatgtgatgatcaatgcggaatggagggagtaataagtaacatattgaagtcttgaagcctcttttctttttgacggtttgcaaaattgttttttttttatcagaatgatttacgcggtattatgtctcatttggattgcaatcatgcttatagtgtatagtttggaacattttattacccttgactttgcacctatgcatgcatatcctctcaattcctccgaatcttaaaaagatactttattgtttatcattaattttgttgaaataataattccaaatagtaatatatactccctttgatctcgaataattgatacttgcactattcaaatttaaattttatcaatttgtattttcattaataaattacaaatatggacacgactacagggagcgcatgcactcgttagtgctaaccagcgaccatccttttttaccaaaaatagtacagtgtgtatcaactcattacccctcttactaaaagtagtagcacctgccacatgcatcctcatttaaatacttatatgatctaagatccgattactcagttgtgttcgttgcagttaaatttatacaacaagatcttatatgattatattatgatgaaaaaatatttatgtttgtaaaatacttttattatatactaagttacttttatcatatatataaattacttttagatttagatttgattaaattacttcctatacattcataatgctatgaggtggttacttttattattgtttttagtcaattccataatttgtgctgattaatttagtctctagatagagttatgtttttatccttacaacagatttacttctaatgttatgacaaagttactttccttttgtcttaagttacttctattataatatatgtaaattacttttagactttattaaatttacttttatatgtccaagaagtactttagtgaaatctaaaaataatttagatatattataaaagtaatttgtaatttttcatcataatataatcatgtgagatcttattataaagatttaattgcaacaaatacaatggtgtaatcggattgtagatcagataagtaatttgaaagaaaattttataagaagggagaaaaagacatagatgcctaacactacgatgcttctctcaaattctaaactctgatgcttctcgactaaatcggatggccgcgccaggcgtcgctgcgtaagactagatcgagaggcctcacgttatagaatttacgttcaaatatattatattatcagagtatttggtgccataaatataaatttttattcttcataatataggtattattatttataaataattcatgctactttgcactccggtcggatacgccctaactatagataaagccctgatcgatctccatcctgaaacacacgcaaaaccgtattctaattctaattaaacagaaactcaaatcacgaagacaaacaaacataaaaaaccgtttgcattacaacacaacccaaataaccttcctgtcctcctccgatttaggtaggccccaccggacagtgactcgaccttggcggcggcttatatataaaaacacgcaaagttaacacagcgcggccttcttcccggggatcaggacgcaacatattcacaacacgcaaggtctaatccgaaaaaagggaaaaaaaataccctcctcgcacgaaacgaagccaacccccaaactccgccgtcaccggcgaccccctcccctcctccttccgccgccgccgccggcgaggcgtatcccgccggtacatctagagaagaggtggtgggaagggtgggggttggggtgggagcaaacgaggcggcgagacatgaatttcttctcgggggtatgggtgaggacgatgatgaagcggctgtgcaagtcgctgctgaagaagcggctcggggatctgatcctgggggacctcgacctcgaccagttcgacctgcagctcacccgcggcacgctccacctctccgacatcgccctcaacgccgacttcgtcaaccgcaaggtgagcccctctctctctatctcgtgccccgacccgtgtgttcgattaggatgcacccgcccgtcgtgattagtgtgctatttgcccgaggttgaaattctggtggcagagatgggaattgggtgtttggggatgggaattttgtttttttttgtttttgttagaaaaaagaattttcctgtttagttgcttggtggattcaactctgtatgattttgatctcgattggttgctagcatgagagtgtgggcttgaaattttggtctagaattttttgttgcagaggaaataatctgttcgcaggaaaaaaaaggaaggctttttcctttcaatcagtaacctcgggtatgggtacagttcagggttatttgtgttcatttcatggctaaagctcatgatcgcaggtagagtattagggtttaggagaagtggagaaggggttataaagcttatttgcaattcacctttttcagttggagtgttgggactaatccgatacagtgtaatgtttgtaaattatgttgaatgcaaagcttctagaatacaataaagttaacagaaagtatcaaagctggagtaggtgattgttcttttctgctaacctgatttgttgtggtgagtagcatacagtagtcctcttatatgtgcatgaattcaccactaaagacacatctatgttcaacattttgcgatccatgaggatcatggcgctgctggtagcccaatatgatacatttgttcattcacaagtgttgcatacttgaatagaaacttataccgcaaaacttgtgaaacccactagattttgggttttccagttactttattaaaacagttctatttttttccctttccagttgtcaggatctgctatcatgatgaaggaaggatcgataaaatccctgctagttagaattcctctactattaaacatgcgcgactgttgcgagattgtcgtggaggatttggaacttgtgcttgctgcatctgtttctagcgaagatccttctggtgatactgaatgctctgtttctggtagtaatactgacgacacacagaaatcagtccaggccaaaagaaatgaatctgatggcaatcagtgttctacctctgcatctcgagatgtcgacaaaggtgtccagaggatagctaatgctgtcacatgttttcttaccaactttaacatcaagttaaaaaactcttatgttgtatttgatcctcaaaacattttggataacaaggtcccagaatttaatcgatcactggttttccgaatcaaagagaccgaatttggaaccaatctttcaacagatggtataatcaaacttcacaattttgtgacattccatgaggcggtcattgagtttttgaagatggatgatgttgatgcgcatgcacttcttcaggatgatttggatagaggaccagcagacatttcatcaggtcatagcactaccgcggtcttgacaggtcctatcggtggattctcagggaaattgaacttaagcatcccatggaatggcttgaactttaagaaacttgatgcagatatatctcttaattcattagaattgcggttacaactgagcagtatccaatggctcatggatgtgtgggattctctccaaagaagaaatctagtacatgaacagagttatgcccataataccgcagacatatctagatctgccagttcatatgtatcaagctcttcaaaatcaggttcaggttctgtgatagctagcagggaacatttgacagaggacacattttctcaactcaggcaagaaaaaacacaagagccttccctgactatgccatacttgattccggactggattccagtgcttatccatgaggatcacggtgaccctgattcagtttgtgatgaaaggtttgttcctttttgtttttcatcttcctttcttttcatgaaagttcaatgatattcactgcacctttgcaactgccatccttttttacatatagacatttcatcaagagtatacttttgacagaactgttgtcaaataaataatttttgaaatgaaatgcatttgcctcccatttgtatttccatgaataggtttggccagatgtattacacagaacttttctccccatcttcgttatatactatgtactcttgaaggttgaccatggacaaatcctccttttctttccgtgcaaaaaaaagaaaaacatttttgggtgcttgtgcaagctattttcttgctaagttacttgcctttaaatttcttacgggaagcagtttgtttaaaccaaataaagaatatacataactacactactaatatgttgttatcttggacagcatcgaccagttctttgaatgttttgaggaactgatgaactcccagactaatctgggaaacagtggcatatgggattggacatgttcagtgttcaatgcaattacctttgtatccactttagcttctggatcagatcaaattcctaaaggtactatggtttaaacctttcaattttctattggttgtccacattatacacttctcttgcagggatacagaacccttatcatatggatttatttattgttcttattgtgcctgtttaccacatatttttttctcctgacactctttcctgtggagtattcttggacaatgttcttcagcttcaattttcttttactcttgaacatcattcatatcaagcaggatcttttgcactttccatgaaagacaatgtttgactgttagctcctgagtagactgaaaggaaaatgttgtagaccactggttaaaataacagttttgtctggtgtgtagtaataatacattgatccactgaaaacatctcctgttagttggtattacactggtgatactcagggaatagcactgatactcaccaatgaaactgcacggtacaatttaaagttattattgtaccatccctaccttggactagtccaccttatacaaaaccatactgcatgaactgaatacttgaaacatgcagaaaaacgaaaattactgttatctcttgaatgaaggtcaggtaaaaggtacacatgctaggttatgttggcttatgaataatgacagatgttatatgttctaagatacagtaacagtctggtatcaacagatgcaacttacgagtaatgaattctctccattctcttgctattagcaaacctatcaagcatgtccaaatatctgttggatgtatttctggcattgaaccaagtatctgcagtgttttactttttctggctaaattatcagaacatttatatattgcatcactttgttacttatttttccttttcatttcctaacagaaccgccgatagagaaaaccttgcgggcttccattgctgagatatctgttgttcttttgttcagtgatgaaatggatgctggcaattccagtgttcctatcagtcaattcaatgacatgagaaattctgaaatgttttcaagctgcctttcctttgcacattttgagcaatcaatgatatctcctgctcctgctgccagcttgaatatgcatcacgttgaagccaagtgtcagaacattcatctttccctggaggtctggtctgcttccaccaatagcactttttcgtagtttatatctcctaattttatgaagcttgattctaatgttatgttcttgatgtttgcagacatatcctgaaaacctaagtctcaagggatcaattgctgctataaagcttgatgaatactatggcagtaagaacaatgattcagatcatccaaatcttggtgctgctttcttgaacaataatttttgcagagaagttcaagcttctctccctcaatctgtatttgcttatcaagattaccatgaggaaacatcacgccgtcataccaacaattcaaatgacctcactaaggtcgaattgctaaacacgtttggtgagtgcgtattccactatgatgtcagttcctcaggtcaagatggcaacccagtaagctcaacttcactatcagtctgtttggctcctttggtttgctgggtgcactttcacacaatatatatgctactgaattttatcagtaaaatcgagtctgatgttttgcatggggaggataaaattcataggaagaatgacgaaaaaaatgtcaatttgtctatgaagtcaaatgtttctttgggaggaagccaaaaggttcagatagccctgtcgcctgcaagagtcatcttttgctttccttctgaatcatgggatttgagctgcccatccatgctggataagttccttgtcattgaccacacaccatctctgaaatcaggagcagattcatctccacatcaaaatgaaatgcctaatgatgtcaatgcaatcacaccatctactttggtccatttggctacagggaactttgacatctatttggttagaccagttaatgatgaactgaatgctagaacctgttctctgagtaggcaaactttctcttctctgaagattttctctgttaccggatccaattgtcatgaaactggcattacgatgctctggaagaagtatcctttaaaagaccctgagatggtgagcaaaacttggagtttgccaaacctgcatgagcaaaagattgctcagaacaaaaatggtaaatgggttggtgtttcctcttctacaacctcagaagatcttgaggaatcaagttccagtatacgcagggagctcctccggagcacagagtttttgttgcacattaaactttcttgtgtctcagttcatctcagtaagaaggactgtgggatactaaaccatttgctaaaaaacatccttgatggtctttcagatggagcaactggaaattttgaaaatgacagtgacaattgtatgccaatccatgatactgctagccaaacatctgtcatttttgaatgcagcatcttggatatctgcactgaattggatgaaactgttgaagttggtcctttattgcagactgaactagaaggttcctggaactgtctcaaattgtcaatttcaaaattttctctgctatcctcttctaatgttggcggggttaacaatgccaattttctttgggtcaatcatggtgaaggtgagctctggggctctattactggtacggatgactatgaagaaagcaaagatgttcttctagttgtttgcaaggattcggcaagtagacgaggtgatggtgaaggtagcaatatcttgtcttttggaactgcgggctgttctgtgactcatatcatgaacccaaagtttcagaagaattatacttctatcaatgttcgttctgcaacagccgttgcacctggtggccgcatggattggataagcgcgatttgcctattgtttagttcagcttcagatggaactgaacaaccagctaatagtagcacaatgaacgattcccagggtggtgaacctttttcatcactgttctttcttgagctggttgatgttgctgtgagctatgaacctcatttcagaagttctgcactcagcgctgaaactccagactgcaaatacttttcatgccttttagctgcatcattgtttaaacttcacagcaaatctgcatcaaactctacagctactgattttgatatcgagctgcgagatctcggggttctcatttgtggatcctctagttttaaaaatgtcagttgtggctatggtgcagattacctccgtcggatgggctatgctaagattgtgcagaatacattcattgaagctgttctaagaattgatacttccttttggaaactcgaattatcagactcgcaattcgatattggtacttgtcacgatacgacacatggtgttattcaattgtgctcccagcttcagcagctatatgctccagatatgcgggatgctttagatcatctacaatccagatggaatagtgtccaacaggcaaacaagcaaaatatgggcactgatgtgtcagaaaagtcagagagtagcattgataatctgacagattcagaggagtgcaagtcagatggtttgcttgatgatataattgagaatgccttttgcactgaccaggacttcgcaagctactcattgagtggtagcgaaatggatgaagagtttggcctgagtaaggccatcccagaggcaaatgatgcctgtatttcacttgaatcattactagttacccctgaagccagtactagtgatgatctaataattgaatcttattatatgccaccttcgtcatcatcaactctatacaatgaagaccagggcaattgtgctcctagaaccgtagagtgtgacgaaggtgaatggtataataattttcccacaatagatgaaaaccatgttcaaaggaacaaaccacgagaagagcaaatatttcaacaaaaactgaagcctgctattttcatcttgaattctgatgaatcgtgcagtctgaaaggaaaggttcttattcatgatatagatgtcaagtggcggatgtacgagggaaatgactggaaattagctcagaaagatacgattagccggccgtgctcaaatggcagagacaagaggtcttatttagagtttattatgtctgcgctcaatatccagttcaatatgtatccagatggggatatttttgtttctaagctatccatctctgccaaagacatcaatatttgcgaccaaagtacacatgctccatggaaaatggtatgcatttttctgtccaaattatctagaatttactattaccactggactaatggtttctaaatcctctatccattttcgaatcaaaggttcttggttgctacaactcaaaggattacccgagagaatcttgttctagtgcattcatgttagaactggagtctgtaagacctgaaccacaggctcctttggaagattacaggtaaatatggtgtttctttacactgaattaaactatcagaaaacatttgtgattttgcttgtttctgttaatccatagtgaacattgcgtttgcctcatacttaatgggcttgcattgttaaaagaaactacaaggctacctttttgtgccctcgatgtatgaaggcactcattgcccaggtagatgtaggaaaaaacctatgtagtggactaggttccacattacagatcatattgcaggaataatttctagtgtacccagctatttgacttttttttttacctcagcacatggtaatatgcaagatgatgagtctgagctgaacaatagaggcacatttctgaatgtaataattagctcttttatgatgaatttatgtttctggattcgatataaatccagtgtttgtgtactgctgcactttgatcgcaattctgtaccctcaagtccaattcaaggagtaacgtaaaatagcagatagaacatgaaggtcctttattaattagtgttttttatcatgttagtatatgataaaatggtaaatttaaaattataatggtgatacaaatgagatagagcttgttaacgagcttaacgatctagcttgtgagccgagctaagctaggcttttagttctctaaggttaacaaactgagctgagttggctatacaccccacacgtcaacaagtttaacttgagtgcatgtaaaataaagaaacgcatagaagatggcagatccaaataaaaaaaaatcatgcatgcgtggttcttttggcagatattatttcacccttttgccctttagccctttagccgttgctccacacacattttgtgtccatataccatatctgaatgctgaagtataagtgagtttgagtactggtgtcttttttctactctctatttttggtacttattttagactcagtatgatgactgatttccttgcactatcctaaatatttcaggttacatcttgagattttgcctctacagttgcatcttgatcaagggcaacttaacttccttatcagtttcttccagaatgacttgtgcaacaaccctaatttggcttgcgaaaatgagaatattgacgcgcagagtacaatgtatcgaagcgatacaattgctgatgaggcattacttcctttctttcaggtatcttgaagtttttcagtttttatttcctctttttttccccactcatggtacttgagatggacatatggttttaattttttttctcctactttacctgatatattttaacaattgtttttacagcaactattagtttcttttcattttcaaaatttttctactaattagcagcatggatcttctttgtttagtaaacaatattatggtctaatttatttcttttgatgctagaaatttgatgtgaagcctcttgttctgcacattaattatattcctcggcattttgatcctgttgcacttagcaaaggaaattatgcagaacttctcaacatttttccatggaaggtaattcattgttcagaactatacatcatagccagtcgtatctttgtaggcaaccctgatactaaatttgctgtgcagggaattgatttaaagctgaagcaggtttctgccatgggtgtttatggtttcaataatatatgtgaaatagtagctgcagaatggttagaggacatctcaaaaaatcaggtcctaatcttcccacacatatcttacatttatattaaagatgcctgctgttgtgtacaccaataccgattcaggacatgcaatgctataagagagaatttaaaatttgcatgttggcatacactatttcttcacaaaaaaggagaatcttatatcttcctgtcttacagatgattttctattctcatttgtttcaaaaattttctattctcatccaaatcgacaatctgttccttgtttaggtccataaattgttaaaagggcttccacctataaaatcattagttgctgtgagttcaggcactaagaaattggtctctttacccataaagagctataagaaggatcggaagttgctcaagggaatgcaaagaggtaagccacatatagctgcactactatgctgaaatattttgtttgacatttctgttgatgtgttaatatatgatggtattgtgaaattcttgatgtcatgcatccctgattacacttgatggtgattgacaggtgcggttgctttcattagaagtgtttccattgaagctgtggggcttggtgtacatttggcggcaggagctcatgatatgcttctaaagacagaaagtgcccttacagcaattccaccacctttagcctcacgtgaagcaaaaagaaccaaagacaatgtaagagctaaccagcctgaaagtgcgcaagaagggctgaagaaggtattgaattcatccaaattgcacatgaactcatcttttctgagatgaactcatctgttgtctgctaataacatgttgctttaacctaactatttgcaattctatttttgtttgtgatttgcgtttactttctatatcaatatggtaagtactgccagtataagtttcatttgctgtgtaattatcaataattcaatatatgctgaacatttttcaggcatatgaaagcttgaccgatgggtttggaaggactgcctctgctttgattggaaatcctattaaagtttataatcgtggggctggtgccggatcagctttggctactgcaatctgtggagctccaggtgctgcagtggctccattatcagcgtcttttcgtgctgcacattatacacttcttggtataaggaataggtgatttcactcatcctcaaacctcaaatcagcaaacattgtgaagctctacggttattttgaattcttaaatcagtccagaccattcccaactcactgttgactcctcggtctgttctgttatcatttactcgatgcaataggactaagtttttctgatcacatttcacatgtgacatgagaccatcagctagactcaaaacatggcataaaaatttgtattttctaatctaacttgttttctttttttacttgtttatttatgatatatcagcaaagtctccatgcacatgttagataatgctccctttgttttttaacagatgacaccgttgactttggaccatttgtcctattcaaaaaatttatataaatatcatttatcttgttgtgacatgttttatcatgaaagtatgatttatactttagcatatttacactattttttttaataaaacaaatggtcaaacgttattccaaatgtcaaggacgtcatctattaaaaaatggagttattacattttgtaatcatatacttcctccgattcatattataagtcgttttgacttttttttaagtcaaactttttaagtttataaaaaagatagaaatattttcaatccataataaacatattatcaaaatatattaaatgttagttttaatgaaactaattgtgtgttgtagttgttgctaaaattttctataaacttggttaaactttaagaagtttgactaggaaaaaaaatcaaaacgacttataatatgatgaaacggaggtagtatttataaaataaaaataaaaaaataaaatctcctctctcttttttcccccatataatggtgagcaagatctcaaggtctgattgcacaaattctgaatagttttctatttgagattggagggagtaatacaaatagatattaaaaagatttgaaaatagaaatatattgacttgcaatttactgtattagtatatttttgtcttctgttggaactggaagaagttagcaacggaaggtaacaaagttcatggatctggacagcttaggattaatcaataaaacttcgtagctaaataactgtaactgacttgccccaaatgaaaaatgtatatctatgcaaaagaatgagaatatagttgatttatcgtcctaaatattatcagtctgtgcactgataaaactatttgttactctgggtaaaatatgtgtttgagcaaaaacagtttatttacaccgaggacttatgagggtcagaaggtgcttggcattccctacattgacacaagctcacttaactgggagaacttgtaaccaatgatttttaactaggctcttacgaattgcaaaaataataatgtgcatgaattaggctaggcaactgactaggtaactatggaacaatctacagaaaaatctaattgtgatcttggtttgatttataatattagtggaattgagttctcttccgatcagcatcggtgaaaatacatatttgtcctatgcgaatgttacaactcttgagcatacttcatttttggcatgaccacagactgctaatgttggtttgctaatattttcttttcttctacattcacagccttgatcctgaacgcaagaaagaatctatgtacaaataccacgggcctcctcaattgtagacttccattgagaagaggtggtctgttcattcttttgcgagatctcgtatttacctggaagaactggttcaagagcacatgtgtgcaatctcatcaaagggtggtgggcaaacttgtacaggataagtcagatttccacactagcaatccaaccatttgtgaatcagtgccatctccgatgttcttgttggagttcataatccatctcctctgcaggtgtacagtttcagatgccacgtcgaaaaccttcatactgtaaattactagcacacgatcacggttgtaatcacaaacgtggccacccggagcgggtggaagttttgttgactccttgcttaggatttggctagagagagagggtcacagggagcttggctcggtggctcttgtacataaatttggtggtgattactgagtagtgcaaatgtaaatatctctcttgtttctcggttttccatttacgtttttgttggtttgagaaactgctcactgtaactctcactctacaagtgtaaatatcatcaggttttgtgctgctgcaatgagatataagcgcttgtttcgcgtgtgcgtgtctggagatgatcttttgtagtaactgatggaagtccaaattattacgcaacgcttctgctacctgaagtagttattgagggttatgtaatctacagaaaattggagatacgagatatgagaaggggtacagtattgtcattcacattctttcaactgtccacaaaacctctcctctccttcctttatatagccaattcttatacatggtacataaagcctctcctcttctttctttatagccaattcttatacatggtacataaagcctctcctcttttttctttatatagccaattcttatacatgtaaagtagggtgaggcctgattagtgtattgggcgttcattggccaagtttttcaacactctcctgagccgtcaccatgtattgcttatgcctcattaaagctccttaatgagccagtggaaaaaaaatagagaaaaagtacataacatacggtttgtgttgcacgggttgcctcattaaaaaccttgataaagaaatgcgggaaaaattatctaagggaaaaagagtacaacccctccaattattcttattaggtactttgtcattctggactaagtttggcaagtgagtcagtgaaattctcctcctgaattttacatttctctaagtttcaacatcccgatccctcagatgcacctttcaaaaggggatgttggtaatgacttagtgaataaatctacgatattttcacatgacttgtatgcaatactttaatttcgttcgtcttatgcagttcatgagcataaaaaaaacttggggtatatatgcttggtgagattgcttttcacgtaacccatttgtccttgtgcgacacatgctgcattatcttcatagataattataggagtctggatggtgttcaattcacatgattgctaaatgtggtgaatcattcgacgaaaccatgcatattcatgagaggtttcgtatagtgcgatgattttcaagtggttcatcgaagttgctactagattttgctttgacgatttctaggaaatttttgttcctccatataggaaaacataactagtttgcaacttggctgtgtgtgggttcgataggtacttcctccattccaaaataagtgcagccatgagtttccgtgtccaactttggtcatctgtcttatttgaattttttttataattagtatttttatcgttgttagattataaaacatgaatagtactttatacgtgacttatgttttttattttttttcaaaaaaaaatttgaaatcagacggataattaaaattggacattgaaacttatggttgcacttattttgggacggagagagtacccagcatctgcatatcctaccaaggtgaggtcctggttctttctgtagaacaatttcatgtccttactttcttgaagataatggaggatgtccttgatgcccttccaatgcctcttggtgggctctgtgttgtaccttgcatgtaagttgacgacaaatgctatatccggtcttgtgcaatttgcaaggtacatgagcactcctattgcactcaagtacggatattctaatccaaggacttccttcccttcttctcttggtctatacggatcttggtctacttggagtgaccttccgaccataggggttttagaaggatatgtcttttcaaagccaaatcattctaacactttctgtgtgtagattgactgatgcactaagaccccttcgggggtatgctcaagttacaagcttaagcaatacttagttttgcccaagtatttcatttcaaattcagatttcagatatgagcttgcttcttcaatatccttgagtgtcccaatgatgtttagatcatcgacatatacaaatattatgcaaattccatcctaggatctccgtataaagacataagggcaatcttcattgttgttgtagccctttttgcttaagaaatagctaagccgattataccacaatcttcctgactgttttaatatgtatagtgacttcttgagttgcacactatacagattcctgcttgctctgtcttggtttgggacatggaaatctcctaataccttcatgtgaatgtccgtgtccaagttccatagagataggtaattacaacatccataaatttcatttccaaattcaaatttactaccatagagattacgcatctaaaggtaattctgctcatgaccggagaataggtttctttgtaatcaactgttggccgttgggtgaaaccttgagctactagcattgctttatatctcatgccacgccctaaaaatcgcctaaattaataatccatattttaaatcatttttagaaattacttttaaagcctacaagttaaactctaataatctaagaaaaatttcaacataaaattgagctagataaaatttcattaaatactttgcttgtttatctattttctagatttttctgggaattatttgagcaagggaagtatttttaataaatgaaacatcatttcacgaattattttaattggaaaagttttaaaaatcctcctctaagccgttgggccgtatttggcccaacatccctctctcctcgcgcgcgccgagcggcccaagccggcccagccgacccgcttgcccctcctttcccctagccgccgacatgtggggcccacatgtcggggccatcccctacctccagccggctggtcgcccaagccgagcccgagccgccgcctccctctgccaaatccgcctctatcggtcgcccccgagtccgattagttgaggggaaatcatctcctccttatcctcttcctttcccctaaggtttcggagaccaatttcgcccggataaaccaaatcgagttcgttttgagtttatctctccaaactaacccgaagattttccggcttcgattcctctcggttggagtccgatctccctaatctaagcctataaatagcttcccctagtcgtcctcttccgtttgccccaactcccgagctccctcgtcgcttgtagcgccgccgccgctttgctctagccgccgccgtcgccggcgatcctccggtcgtgccgcaccgccgctagcgccgtcgccgccgtcgagtgcgcacggaggagggaaagctcggccgccccttcgccgccgtcgccggacaccgtagcgccgtcgccgtcgctgacccgagccgcgccgccataggacctcgtcgccggccgtcattcatcgtcgtccgtcgcgttttcttgcaccggtgagttcgcgtcgtcgttctctacgtgtagatggccttagatagcccggccgacccctctagcgccggtggtcgtgttgcccgcgccgtggccggcggtgatgacgtcatcatgacgtcataaatccctttttctaggttttctttattagatgcaaatcgattaaacttcggaaattcataactaaatcatcgtaactcggattcgagtggtccaagttgctaaatttttctaaaatcgagatctacatgttaaaaatatccacatgtactgtttatgcttgtttttgtactgttttggttgattttgttcttttgctttagtttccgacgttccggaggagagcgttttcgttgaggaaggttcggaagcatttgcggaagctcaaggcaagtaatatagatcccaaacaaccctttgagcatgttgaacccgtttaaagctaatgttttattttaacttatgcattattttcgaatgtcatcgggtggtgagcctttcccaattaattaatggccaaagatgtctttattttcctatgggtaataaattgattagcttgtaccttatatattggattggttcagttagatgctatatgtataattgcttagccatgcttagaaacattagctcattaatgggatgaatcatactacattattaattatggttatatttaatggtagctcacaatggttaattgtgttatgttaattaattgataactaaaacctgattaaggtgggttgtgagcatatggttttgatggttgtgctcatgacaattaaggaccggttcgcgagctactgttgtgaaacatttaccgtgccaaccacaagccagcatgggcaacggctttatcttttgtatagcatgatttattatggtgtgccagactgtgaagcggcgagaagtctgtgggggtcgctggggagtccattgcctctggttttgagggggagatcatgatccaggaacggtgcactgtgatgagttgtgttgtgcgaggggtattgtcacagttcctttccaaggtaccgtagtggtactgaggcgcatgatgacatgttgtggagttgtgtcttgtgggtacagtggtacacctctgatcagagtaaaactattcgaatagccgtgcccgcggttatgggtgagtttaacaatgtttttcgtgattagccccacactattcattaatgataatattgtgttaattaatttgacttttggtttggaatggtatattcctggtatggaggtttgatttgtacaaccggggttggttgctcagatgaggttgggcctatgcagcacgggtgtgttgtatagtgtttatttaatactgattaattattcaactgttttattattctttaaaatgtttattaaatgctgtttatgcaaatgagctttactatgccatcttttgttatcctgtgcacttgcatatttgctgtgtggcttgttgagtatgtcatatgctcattattgcaatattcattcgtcagaggaggagtacttcaatgaaggtgatgatctggaggattaggctttgttcgggtcgagttgcttgtggagtggagtcgccatagctgttccgttttgtttttatttccgctgcgtataattttattctttgagaggaactatccacctctataatagtttattattttattattgtgcgaatattaattagttgtttgttagcactctattatcaatttgttattgtgtgcctcggttaatttctggacgagggtttaacacacatgtaagcgtttggaattttggatagaaattctggacgtgacatctcactaactcgttattctgattttttctttcgaacaaataaccatttatgcccgtatatgaggagggatacggcttacagggtcaaatacctctcttttgtttagagaaattaactcgattgtgattgctttcttccattcgtcccaatccgaccttttcttgcattctgtgagtgatatgggctcgcagtcgagattcacgacagaggctattttcttagcaaagtagatatctacatttgctgttgctctatcaaatgattctcccgatgtgtttatggccatttcttcatgagctacttcttctgaagcttccacttgcttcctgttgttctctgttacaggggaaagttcctttagtttgctaggttctatgtgtgcacacacattgtcactgacaactctctcggtgggaaggtttaggccccctttgattcaaaggaaattcataggaattttagatgatttctttcctataggaattttttctatacagccctttgaatcaaaggaatggatcttatggaatcctatgaaattcctatggattgcctaatgccatgtaaattttggaggaattctaacatgaggtaaaacctcttggaaactttcctttaagtctttatctctcctctaattcctgcgtttttcctgcggttcaattaaacgactattcctgtgtttttcctgtgttttgcaatcatctattttacacttacattcctatcaaaaacctacgtttttcctattcctatgttttctcattcctgcgattcaaaggggcccttaggtctggtatgcctcttttcataggttccatactagtgccagatctccgctggctcctcttttttctttggatatttttgcaattggctgtaccaagccccctgtcccccttttctctagacgtttcttgatacttgaggatcgagagactggagttcttgtccttttgttctgaggcctccagactggatgagggttaccaatttcctttggtatttcaatctctccggtgcattgcgtgcatgcacatgcgacttggttacgctattcaaattacaaaaatggttaggcagttgattcactaaactttgcaaatcaattatttttagtacctctccatttgcttcattggtgcgtggatcatgcgcatggatccccatgtctggccatgtgatttccaaattttctcatccaagggttgatttcctccccataaaaaggggaaatgatcctcatcgaagatgcagtcagctaaatggactgtatgcgtgtcgcccgtcatgggttccaaatacttagttatatatgcagtctcataaccaacgtatatcccaatctttccgagtggacccattgctgttcgttgaggtggtaggataggtatatagactaggcatccaaatttgaacagatgggacaatttcggtgtgaccccttgcaccagtttcatttttgaatggatgttgtaggccgatgatctgaaattaataagatttaccacgtgtagggctgcatgtccccaacacgtgcttggcaatttacaaccttgcaagagtggcttggtgatgaatttaattcttttaatcaacgcttctgcaagtccattttgcgtatggacgtgacatatcgagtgctctgctttgattcccattgccatgaaatattcatgaaatgcttttgaaataaattcgcagcattgtccatttgaatggactgcacatgatgatcaagaaaattattcttaatttggatgatctgctagatcaattttgcaaagtcatggtttcgttttgatagcaggcacacgtgcgaccattttgaggaagcatcaatgagcaccatgaagtatctaaacggcctttataggtgctgtatagggccacatatgcccactgtattcgtgctaagaatgcagggatttcatccttcattttccatacggatggtcttgtgatcaatttcccggtggcacatgcatgcctcgcaaaatcttctcttttttttttctgaaaggaacatagaaagggaagcccctgttaaaaaaaaatctaaattgataattgaaaaaaaagattacaacaacctaatccagtttaagactacatctttatcaccctcattcaatctaaataacaaaagaaggagatcacccttgagggattgtctccaagaaaccaaggaatgaagaatattctcaaagaaatcaaattaacgtgcaatctccaatattacttgatctgaattgatgggccgcacaggtcctacatttgcacatcgtgctccatgtggctgaccgcagaggatagggtggagtccgccggtgatggatgttgtttgctatttttcttttgccggtgatggatgttgtttgctatttttcttttgcttgtcatctctatgacatgaacgaaaatgttcttacatttttttcgtgcttgctagatgatggatggctgctactgcgcaacgtcgagcccatctctataccacaccgctacacccttccatgattccatcgtcaaactaccgctcgccacccggttaccctctccactacccgtcacaagacacagactagcctctccattagcaaaaccaccaggatcctattttcgtgatggatttttcgctgaatcattttttttcttttgtagtgtgtggttaagcctgtaatttttttattcatatggctattttgtgatacaaattaacaatactgttagtatcagtttttgctcttatactgtgtattgaacacattagtaaacatattactacacgattgctacgagatcatgggctatatcgagaggaatgtggtaattcttttactcgcagaccacgaaattgaaacaatatttacaacactagtaaaaaaaattaatagcgttgtaagccggtagtagttcttttaccaccatctaggaatggtgccatatgatgtgggggcattcatgcaagtaaatttgttacttttgaatggggcattcatgcgagtaaatttgttacttttgaaggagcagatgtgggaggctgggaggagtagatgtgggaggctgggagtaaatggaaaacttcatagagtaaatccgttacttttgaaatgtgaggagatactagaaaaacagaaaactcggtaagaaaaactagatggtaaatattttactaaaacacgaaaacagaaaaactgaagagaaggaaccaaaaacggaaaaatctggatggttaattttttagcgggcgcttcgatcaagcacggataagatgtaaaagagaaaaaagaaacaaaaaaggtgggggtaaaaaaacaaattgaggaaaggtggtggtaaaaaagcggaaaaccgtaaggagggagcattgtgcggcactccaactaatattccgtatgcagcgcgtggattagcgctagggaaaatttcatctataccacaaacttttgagcggtacccaaaaaatagcatagaacttcccaccttcccaacaataccacagtagaacaggagcggaacggggcggcacgggaaatagcgcgatagacaggattacccctcaggcttatccctttcattcatgcactcgtctctccctctccaaaaccctaaacatggcggtagtggtggcggtggcggtaggtatagatgaaattttcccttagcgctactgtatgtaattattatatatttatatatatatattatacctgaattacaatgtagttacaatatagttacagtgagttactactattgtaactaatatgtaactagtactccctccatattttaatgtatgacagcattgactttttatcaacatttaactattcgttttattcaaaagttttttgcaaatataaaattatttatgtaatgcttaaagaatatttgatgataaatcaagtcagaataaaataaataataattacatattttttaataaaacaaatggtcaaacgtttcttaaaaaaatcaacagggccgtacattaaaatacggaggaaatatttaattaatatgtaactggtatgtatctaaacgaaaaccaaatgcgcccaatcggctagctccgttcagtcataaacgagaggttgtaggtttgattctttgctcctgtgcactttgcgccaatttttattatccgatctgcacgaattttgatgtgatctaacagtctacaatttgaaagtttttaagcctaaaaaaccgtaaaaaaaatatgcaagtactccctctgttttataatataagactttatagcattccccacgtagtaaaaccgtaaaaaataagtaagctataaaatgacgctcttatcctttgttcttttcctcaccggcgctcggattagtccgtccgcatccccggcgctatgcagccggccgacgacggcaggcggagggcagatgtggagtagtgcggcggctgcggatggtcgcccacatcctcggaggctacgcagccggccgtcgatggcagtcgcagccacgtgcgcctctccgctgcaactgcacgggccgacggggcatcatcggacatgtctcacctttcctggagcttgattgttggcattcaatttcttcgagactcgtcaatactctgaaattgtgcgagctggcatcagggtgatgtaatgccattaagcgtatgacaccattcatgagctgcgctttgtgtatgccctgacttaatcttgtgttatgcactgcaagaattcacaacttcactttctgtagccagggaacctttaggcttcagcatctgtttacttgatgcacctgctgtttcttaagtctatatgtttcaattatttgtcctcttattgtttgcatattatgggtttgattgtttatcctctgtttatgtttccgcctatatcatttgctaaatacctagtgcaatgtattgggtgcgactgaggagtgaggactagtgttggatggagtattagtttcagactttcagtagatggtcagatctcagatgcaagctaacctgttgagtaggtattgggattggagaatttggtgccaggcaaatcgaattttctggttcgccatttagcatggatcatggcgtcacgagccatatggtgacacatttgctgatttgcatctgaaactttcagttatgtcaatattttcctattcacatgagatcttctgactgcaattccataaatgtaaatattttcctgcaggtgttttcagatggatgggcacttattaacatgcaattccattggaattcattaatttatcattgctgccaatttgcttttcagtcattcaaagaagttcacagccattcatattgtcattaggtacttgcattcatattgttatttaatttctaatggtgagaagaactgaacacaaaaaattgaacagactacacaaaaaattagtgtcattcagtttccacacaagcaactgtcctagttgcttcctgtgacaagaacatgaaacaaactgacaaactggagtacacctaagttatcaggaggacatcaagaacagctttatgcattgagttaaaaattgatattgatattgtaagttggggaatatgttgtgatttagcatagctaataacatctagcaatatgactaaatttttttccattttaacatccagaaaatcaacaacggtagtcatagtacatattatcaaataatttcatgagaaggagcacagctagaactattattcctatgaaccaatttctaatgtcattggtctccttttcctgcttggacaacttcttgagtgaaatttccatgtctaaaaacggtccgccatttccagctctagcttcatactaaagatcatctttagtctcggtttttagtggaaccggaactattgtggatttcggccgacggaccaaagatggtttctccaccagtgtacccagattgacatgttccagcaagtgccaaagctgcttgaatgtcttttgtactcttggatgccagatctactccaatcagagtgtcatcctccttaaaaaaacaggactgttatattgacatgcatgactaaattaaaagaaaatttatttatactgaattaccactaaaaaaatgacatatgcttggaatgaaacttacctatcaacacacttcagcgtacaacttatgtaataccactacgcatcggcaatatccttgatcaccggcatcgcagcaacagcaaacgaaaagtcctagagcttcagaggacaactggagcaccaccactatgccgctgtggccgccgacagctgccaaagtccccaccgccgccaccacatcaccggctccaacgactccatgactaccacgataccgcggccaccaccacctcgctccacgaccacctcgtcactgcagccgccaaagcccccgccgctgccacaacatcgccagctctaacgactccatgaccacctcaacaccgcggccgccaccacctcgctgccacggccgctcacgcaccagccgccgccaacaccacctcaccgccacggccgccaccacctcgccgccacagttgcccatggacaagccaccgctgttaccactcatcggacagaggggattcaagcaccttccacctctctcaacactgccggtaccacctcatgggcaaatatgtatctggaggtaccacaccttgccaatcgtctgatcggatagaacgaagggcagagatttgttaccgggctacctgctgaacagaagaaaatctcttcatagtatcagaagaaagtctgctcatgcacctcggcagatcccgccatggctaaccccagacctgctcccgctttcgcactcgtttctaacatcaaaaaccacatccaccgctcaccctccaactctctacatggtgtgaacttttctttgttcttctcggccatttcaatctcaaggcacacgtcgacggctcacccaaaccagccaacgctcaattatcaacagaaggctctgggtgccgcagcgtgaagaaaaataccccggaagtctttagaaatcagctatgctttatccatataagtgataggtaaattgaagcagttccttcttgtccttattagtcagcaggcactttttaaagggctgctctacttcgtgcagctttgggcagatcgatatgctcacgaactgcatggatgaaagaacgtgtgatcctccaatggatgacagctccgagcaccgctcgagaagcaggcatttgacctaaagatttgtgcccagcggaatggactccatgccatcgcagctagacaaatgcaggatgttgagagaggtgaggctctgtaggcaggccgggaagtcaaccttacggccagacacaatagagagtcgtcggagtgagggtggcaaaaccattccctgcgggcataacaatttgcagtggattttcagatcttgtaggtatttgaatcccacgaaactatcgacaggcattgacagtcctagatcgctggagctgtcgatctctatggacttgatggatggcaagtattccggggacaagcaccgatcaagattctgcaggtcctcacaactgtaaagacctatataggtgagtccactaagacatgttgtgccattgctgctactgctactgctgcttgcatgctgcatcgtttcaccaccagtcgaaccaccaagaattgttactgttttcagccaaatatttcctgatagcattagaagttcgagggaaggaaacgatgggattgacagatttttcaagacgccacaatggaaaagcaccaggctccttaaagtcagcaggctctctagtctaaaccaactaggagaaaagctatcacccccaaaaccttggactgtaaggtgttcaattcttggtggaggatgcaaggcttcgagcactccattctcactactcttcactaaacttgtgactttctttcgccattgtagaactagattctggaggtaccgtttttcaacaaggctagcctcagcggcctcttcctcgttcttaacattacaaatagaactaataagtagagctacactgagctgattcatgcccctcaactcaccaattttccgcccatcccctgtttcaactataaaatattgcaagttccgtagacgagacagatttccaagcctacttatctctgataactttggagagcaacctgttggcaatgctagacgatgcaagttgattagctttatgacatccggactaattgcttttagacttgaaccatttgcatcaacaacctataggctgtaaaggcaccagaatttctccggcaattcttgtacaccgctataagaaatatcaagataacggagactgttcaactcgcctatgctctcaggtagcttgaccaccgtgcaaccctttaggctcaaatataggatgttggagagctgattgaaccaggtaatctcaacattgaaattgattccaaacctaagtgaatgtaatttgttcaaatcctgaatgcctctcattccgctcttcagggattcatcagcgacctcgactgacatatggcgaactgcatatagcattctcctctcattccgagacctcaaatcttgcatcaagaggcattcatccacagaaacggattgcgccatatcatggatcaagtcatgcatgacctatctagttcgattaggatacttggggtcggtttgaaaaagaaacctgctcctcaaatcatccaaatacctaatccccatatcttcaagacgtgtgcttccacttgacacaacaaagccctcggccacccaaatgtcaacgatctcatctcgttcaaagctgtaatcttttggaaacatgcagcaaaatgcaaagcatctcttaagttcttgtgggagatataagtagctcagttggagggccggtaatatctcattctctcgatgtggcagctcccacaattcactgttccgaactgtctcccaatgttgcacggtcagctccatattcaacaaacgtccaatagttttggcagccaaaggagatccacataacctagaggcaatgttgtgaccaatatcttgcaattgaggatatgattctggacgctcttctccaaatgaacacttgctgaagaactcccaaaatatatctctatccaagccttcgagttggataggcttacaattgttggtggcaacacgatcagcaacagttgtaaatcttgtagttactaagatcatactgcctttaggtccgttcttgaatggtgcataaaatgactcccactcgtcaatagcttcttgccaaatgtcatccaacaccaaaaggaactttcgtctccctagctgctccatcatttccacctgaagagcatctaaactgaacagtggcttatactcttccttggtgaaagactcaatgatctcttttgttattcttctcttgtcaaagaggtctgaaacacagacccataccctcctcttgccaaagtgagcttgcacccttggatcattgtagatgaactgagccagggtagacttccccaccccaccaatgctaaaaatcggcaagacagaaacattgccgatgcatttggcctcatcaagtctaggggccctgctgctctctcccttcagtttcttcgttctgcaggatgctgatttcgtgccagtgacagtggctgctgctctcttctctttagcccgtgcagcagcacccctggtgagtggcacacccagtaactcaatcacctgatctcgttgactattacgtccaatcatcgaacgcacacccagcttctcaatcactagatctcgttctttatcacggccaaacacttgagacacatctatgactgaacttgtctccggcatgtgttgaactgcctcgatactaagacccactgaattgatcgctccctctaaatcagccacagccttgtcgagcttctcctgggcctactttatccttgttttgctaccacggatcaaagtttttgcatgatttagagaggaagataagagttgacctgcccagctccggtcagcgtcctccatcttttgccgcagcgcctggtcatcgaactcgcggagaagatcctcggcgtcgtaggtggtgtccttgagctgcgacagaaggatcgccatgtccttgttcttgaacctgccccactcgccgcgattgatgaggaagcgagccttgggcaaggtggcctgcaggcgggacagttcatcgctcagctgggtcgcttcatagatgttgatcccggttgagatgatcgtttccacggcgtccatcacttccgtagtccttgattacttctccggatcttgccctctcgctacttctgatgagaaacaggagcgatcgattaagattacaaggagattatgtggtccaaaagcgaaaaatgtagcagcatatacataagtcaagtttacgagaaacggaatggcaccaaaaccaactcacctgcactcctccagctgttatactccctccgtcccaaaatatgaacatttttgaaatagtgccaagtcaatcatttctaactttgactactaatagcaagaaaataaaaaagatcaatcgtgtaaaattgatcttactagatttataatcaagctatcataatatgtaactctttttatttgatttttttttatttttatagatattgttggtcaaagtagcatctcaaagactgtgttgaagtcctaaaacatttatattttgggacggagggagtatcttatccttggccttaacaagttcatatcttttacggttttggtgaaaaaaactccacctattatatcttatcctctaccttaataggtgcatatctattacggttttgctgaaaaaactccacctgttatatcttatcctcggccttaacaggtgcatatctattacggttttgctaaagaaaaaaataaactctacccgttatatcttatcctcggccttaagatgtgcacgttatctactactaccgttttgctaaaaaaactggcggcagtttttgtggttgaaaactttcgacttttttaaccattcaatgcacttgaagatttgtgctgagctgagaaagaattagctagccgtgtggggaagaggaacccagaacttcccgctcacaccacgcgcatatgccatgcacaaccgagctatcaaagttttctcttggttagagtaagggtaataatacaaccgatttattggctataaggtttttggtaactttctctcagctcatccatataatagttagctctttacaattaatatatgacccacctgtctctttcacagagtttctttgttcttatatccaagccggctataagtttatagctcgcttctcctctctctcctctcttctctcctccacctcagcatttagtcttatagcctactattatacttgctcttacaagcaatgaatatataaattacagttaaagtgtagttatctcatagttgcatgttgttacactatagtaacagtagttatagtataattatattataattgtattataattacatttgaatgttttttcttaaaaaaaaacttacgacggattttgattttcgtagcttttttttttcatccacatcgtcatccgtagtgatatcgtagagctcccacgttaaccgtaggtcttcaagtgatattatgcctttaatcttaattttgtgggctaggattacctcacgtgatatatatatatatatatatatatatatatatatatatatatatatatatatatatgcctttaattttagttcggttttgctaaatttttggtgacacattttctggttgattacagtcgcttgttgagccgttggatcagtcataggattcgtgctagcatacttaattacgcgtaactagttgtgcttcataggttataggtcgctaattagcggtctactggagaattttgctactatttttttcttcactgcatgcactcaatcaagtacgagtatttgtaccgaccagcgaaacacatatgtaattaaagtataaatagtaattagtatatattagtagtatatttagacagtagttacaccctatttacacaccacttacatatgtaattagtatgtaattttgtgacttacatatgtaattttagtacttacatatataattttgggacttacattgtaaataccctaaaattacatatgtaatttattgacttacaatgtaaatacatgccgactaacttttggtgaaaaatatggcgccataaatatagctactcccttttagttttgttgattgggttgtattcaaagcctacgtagctacataagtccatcaactaacaatgctatctatatatatatctattatatactaaatatatactaaaagtacattaaacttcctacaaacactttcaagtcgtcacgtggcgctataataaattaaagaaaatcctataaattctaagaaaaaaagcaaaacatataccccttgattttcacttaaattggtgggtccaatattatattggtgggtccaatattatacatcgttagatgaaatctatctatctattatattattaaaacaaccttaaaagaaggcaccacgttcaccgtagaggctagaaattctcacattaatcgggaaaatatgaattatttacactgttagattgttaggtatgtattttaacgtatgagatttaacataaatctaacatgttaagtaagagatacggagcaccctacatgtgctgaattagaatcaatctataactgggaccaacatgcaaacggactcaaaagagttgtacgatttcctaaactaaccagatttaggacctaaatgaattaggcaagaaataaaaagcagcaagcaacaaagcactgtagatctcaatttttagatgtgttttgttgatctgaagatagacactagaagtgagggacggaaatccgcatcagtgggtcaaccgtgcggctgcacgacgagccggactcggtgatgcacgtcagcaaccagaaggcacgatatatagcatgtgcacgacagcaagctaggtgcactccttaagaaatacaattaaaaagttttttttaaaaaatatagattccaaaataaacataaaaataatatttggaataaaaatataatcccaataataaatatgtaaatcgtctttgctagatattcctttttatctatctatattattaagataacttagaaaaccatcatagtagttgaaatctttattattaagacaacggcttagtcgtcctatattttttctactataagttatcatgttaatcgaagaaaaaaaatctaagccattagattgtggtagaaccaaattataacggtgaagattgataacataaatattaatatatgtaatacaattgaattttttgaactaaacaaagttatataaaatacaataacatgcaagccactgggccaccgtcagcaccatgcaccttatgaccagaccaaattaagcacatagtagtagcatatattgagaacctagaaaaaatgaaataagagttcaattaggaatacaatttaaaaataaccaaatttcgaaataaaacataaatactattgaaagaaaagatcatctaaaacccatcacgagataaattgaaattcaaaataaaaataaaataaattcgtaaaatataaaataattataagagttaaagtaaggatacaatttataaataacaaaacatcggaatgaaaaatattgaattttcaaaaataaatccatctagaatacaacaatgataaatgataataaaaaggggaaaacaacatgtccgtaaaaaagtagagcggtgacggttgatgggtcatctataaactataaacaaaatctcaaatagaatccaacgacgattaagatgagggacgggcgggccgttaaatagcactattacagcagttggcgagacttctaaaaagtaaaaaaaaataaaatccaatgagacaataaattttaaaaactacaaggtattacatttgttttttaaaatcccaatgacaatgaagagggcagacagcgggcaggtcatagagaagtatggggcaaagccaaatgaaccccaatcataattacatttgatttttaaaatcccaatgacaatgaagaggggaggcaatgggcaggtcatagagaaggacggggcaaagccactggctgtttggcgggacttctagaaagtaaaaatatgaacacaaacgataattttgttcgattttgaaaatcccaatgacaataaaaagagaggaggcagtggacgagacttctaaaaattataaaaacgaaatccgatgagacaataaattttaaaactataaggtattgcatttgatttttaaaatcccaatgacaatgaagaggggaggcaacgggcaggtcatagagaagtatggggcaaagccgctggctgtttggcggaacttctagaaagtaaaaaaaatgaacccgaacaataattttgttcgattttgaaaattccaatgataataaaaagaggaggtagtggacgagacttctaaaaattataaaaacgaaatccgatgagacaataaattttaaaaactacaaggtacatcgaggaagtggtacatcgaagggtgcctaagaaataaggggtagcaactagcgtgacttttaaaaactataaaattagaaacacgtagatgataaggtttgacctttcaaagtcttgatacaacaaaatagctatttaacaattttttagtaaattcatattaaataatagataattttgtataagtgctagccgcgtaattgcgcgggccacctagctagttgatcttaaaacaaaccaaatgctatgaggtcccacttctcctccttctccctaggtatatatacgtaagtacatcttctttccttttttctttttctttttttcttcattttgccatttatataatggatatatttttttaaataatcataattttacaaacaaagaaactaccatcatacaactcacaggtaactaaattagctctataatttttaacataaaatttacaccattatatgttactcataaaattaataatgtaagataatttccaattaaaccggtgtactcattactttttactattattttcaaataatgcactattttaaaataaagtttacaccattatattgtgtacctatcaaataaacaatttaagatctatattaactaatttatacatgcacttaaaccaatggacccattatttaaatcatcgtatttattttttattatattggactattattctcaaataatgcactgtttcaaaataaagtctacaccattatattgtgtacccattgaattaacaatttaaaacctatattaactaatttacacttacactagaaccgatggacccattacttaaattatcggatctattgtttgctaataaataaagcgttcaaagttctctttcttggcccgctacacaatgcacgtctgtacctttgccttttgcacgcgtgacaaagcgtcgtgtctgaggcatctaaggtgatcacgaccaccgcagcgctaccgctttgccacatatcaagtcatatatggagatgattaattttgttaatatcatgaaaggaaaattaaaggtgtgatgccgtgagagaagaattaagcaccgtgggttgtattttttcacacttagctctgtctaagctgaaaccgagagttgattacagaataattataatgtactgtgtcatttcatatttggattttatactatttattcgtacaggtgaaagaaatcattatgttataaatgtgagcacaatattaacgaatatagaacttttactaagacaagggtgttataagggagtttaaccctcttttttccccgattccgtagtttgggtttttgtttgcatgctttccatgtttctaaatggtgtcttttttaaacaacattttaactttttagaaatcaattcattcgtttataccctcaaatagctatcatataaatcagataattcataagtatattttttttcatgcgagtccagtgtgcaggtggcattcgatggctttcgttgcagacgctatgtttggatgggactccgaggtgaaagccttgctcggcttgccaatcctagcagcatgatgcccttggcgccgttcaccttctcgagggcattgctattggagcccttgttcaactccatatcaagggatttctctgggtgaaaaccatagattcgttaggatcgggtgatgtcgccgttctgtcgacgtgttcttctcgaagtcttcgttttaggtgcttttcccttgctggacggttgtacttaaattttaggttcactccgtcaatgccggggttttcgccggtttttcataaattaaccgggccgtagtaaggattttgggtccagttttctttataagttggataactctcttcttcttcttctattgtgaaattgcaggagctccctacccgttcccgcgaaaaaaataatgtaattatttttggagttatttttcccttactgtatagttctaatcgtcaaggtttccttctattctctacttcctatacgatgaaaataactatttttttaaaaaaataatatagtgattacctcaaaaatatagaaaataattttatttactcgtgaatattctacacttttctttactgtcttctatacattttacttcacacagtttcttatttcaacatcatcaactatgtttactttcgttgcatagaaaagttacttctattgtaaacttaggtggtgtttgaatgtgctgaagatgaagatgaaggccctgtttgggagagcttgtcccagctacaagttttcccaaaagctgcttctgctagaagctgccccaaacaatacacagcttctgagaatctgtatagatacagcttctgaaaaatgaactaagaagaagctgtgttttagagcttttccagattcttagaagttggctaccaaacagctgcttcttagaatctaaagctcctccaaacaggcctgaagattaagtgtttcacgcaaaacaaggttgtaataacatgtgattaattgatttttaattattccaaacttaaaaaatagattaatatgatattttagaacaactttcatatagaaagtttttgcacgaaacgcaccgtttagcagtttgaaaagcgtaccatgagtatctaaaatttaatccaacttttatggggtttaagtaaattacttttggatgtttaaacatattcaatattagactcattttgtcatatatattttgagtgaagtgtgatggttcaagcggatttaaaaataataatatatggtttaaaatatgtaagtcgccaaaagttttgttaaaaaaaaaagcactaatgcagaggaagggctagtggattggttggtgttggccccaacacatgaatagacatctttttttccaaagcttcttgtgctggtcggaggaggaggcctcgccgccgcccgccggtggcgccagcacagcacacatttgcgccggtaggaatccctctcaccggtccggatctagcgtcgctctgccacgagcttctctgcatcgtttccgtctccgacctccgccggtgactgccggagcagtcggagcccggagaccgctgcactgcttcatcatcgagcacctcgtctttgccgctgatccagggcatctcccacatcctgcacctgctccacacgcatacaagatggtgactatggcgagcggtggaggaggacatcatattcgcctgaggagatggagatggtgaagcatagggcgtgttgtccctttttttttcacggagcttcttctccgacgctcgtctggcacctgtgtgtcgtgaccctgaacgccggcgaacttgtcaccggagttgaggaccgcctacgtatgcagcatgaaaaaagtatcagtcagtcaaatatttcagttaactaataagtgaaacataaagttaagttatatgtagggtgaaacaaaaaaaatcagcaactgaaatattttaaaaagtttatgaaacatgataaaaatacaagttgaaacatatcgctatcacatatgaaacaaccaatgttaatggattgaaacatatgtttttctttcatcaaaatataatcatgtgatatcttgttgtaaagatttaattacaaagaatacaacggtgtgatcggatcgtagattagataattagtttaagagaaaaatcgttttgaaactagctaaaatgcatgcatgcatacatgaggtggagagagagagagaggagaaatagtagtaacagttagttttgtgaattttgtgaaacacgctaaagacacatattgaaacatgtccctatcatgtatgaaacaaaaagtgttaacgtattgaaacatatgattattttttatcaaaatataatcatgcgacatcttgttgtaaagatttaattacaacgaatacaacggtgtgatcggattatagattaaataagtaatttaagagaaaattcattttaaatatcgttaaaggtgcatgttatatggttagagatagagatataggcttggatatgtgtatgtgtgtcagaggatgctgtccgatttttctccttgcttcggacgttcgaggagaagaattatccacaactagtaatatacctgtgctaacgctacggagccattatatttttgaaaaagaaaatactatgaaaatttgtcatgttagtgaataatgttcatataatctgtccaattgagctttaatttgattcaagtcatatatcatatataaatatatttagacaaagaacaacaatatcatattgcgtgaaaataataattcataaccatcaaaaattatatattatcatttcaatatacaatatctcaacgtaaagatatgagggcaatataagtctacccaaaaaggaataatcgagagttattccattaccttgttgcgggcataaacaagtacaaaaataaaacatttgatacaatatagaatatactatgcaactaatcaactaatcctaactttgaatatttgcgatatacttaagaaagtcttatgcgccacattctatttgtacgtcaatggatacagcaaattttgttgtcttagctagtcaccttcctgcacatgcatttattttactaaaaaaatcatgatgtagcacaaggtagtatgtcagttccaatcacgcaatatcccacccaaatggttgcggcatgctgtaaaaaccaaaggacaacggtaagtaacattctgattagcattttattatcctctatatcacaaatattgaaatgcaccttttttacatgccatacatattagcctaggtacctagcgttgttaaccagtccaagacatctttatacacaatattcctagtgcttttccctataggtctacctctttctttggtcaaaggtacacatcttccatgccacagtttctaccttcggggggtaggaatgaaatgaaaaattcaactccgcttagctcctagtgcaaatcagttgtgagatagtccaaatttagacaccagaagctacctgttacaaaatcacgtgaacatcagacttaggccctgtttgtttcagcttatgattattataatctaaattattaaaccagattgctataagctagattataataagctgatataaaataagctgtgagttgtttgtttgtctggattattggaggcatggattattgggtttgaaaggctaaagtctataatgccctcagctatctattcggttgatggcatagatgggtaatttttctcaaatatgtaagggtagtgggtctttagccactcaataatctaaaaaaagctcctttaaagcagcttattagattataataatctggcttatagattataataatctgctataataatctatttgtttgtttcagtttactcctataagctagattataataatcctaagctgaatcaaacagggccttacagccataggcccccctgattccacaacaacccataggaggataggagaaaacacagaagaaaacaaaaagaaagaggaaatcctaaggagattggaggagcttgggtgtgaggaaggcaaaccgcatgctgtgtcagtgaccgatgcagcaggccagactccctgttgaatggaatcaggaactaaccatcaggttctccagcttgatgggtcaaaaaaaaacaagatttattaaccatcacaaagttttaaaataaaatccaaaaaagcggtctgtttgacaaaagaaaacaagtagacatgtttatgacacttccattttctagtaatcttgttctccaagaacattttctgataatctcgaaaaaaatctaaggcttgatgacatactgtatatgcacggatagtttaacctgccatatttcattatttgtattccacaaatttctaaagcagaagaagcatatctgcatatctcacctcatatatatttctgaatacacataggtaaaagagaaatgcattcttcagtctaggtgagaaaaaatgaatagttaggaagattagattcatttactatggacttaaccaaaaaaaatagtttattactacacagctttagtaccgctgataccatcgatccattttgtccattctcttcgctgttacagtattgctgcaaattactgaacagttgtgacaagaaaagttgtattttctcttagggatggcagttgaaaattataggaacatgagcatgccattctcaagtagtctatatgtactgatgtttggtcaaatttgttcaatctgaaaacatacatgtaactgaatatggcctaggattttgaaggtaacatgaataaaatagacaccatgccttttggcttggttacaacaaatagcactaaagataagaatacacactacagatggttgacatctagaaatgtagatggctgttgtagaattagcttattaatatatgcgatcaatggaggaacaatattgagagcaacttaccttgcctgtgggcaggattgatggactacgggggccgggtgaggcatcccgctgatcttgatcaatcaattgtgaagctggtgagcagacaaaagatcagtctgcaaatataaattaatatatcaatgatccaatttgtagtaatctgttgcaagcatacaaaaggtagaattttgctatggaataaatttagcacagtatccacctaaatgaaaaccaattcagcgagagcaaaaaaaaaaataccgctgacctcctaaatcagcatgaacacttatagcaaaacaaacttcattcagtttggatattttcacttgtaatttcacgagtctggacactaccataatgatctcatctacaatgtagagaagacatggtcagcacatcggtagtacctttctcccaaaattcaaggcagaaccagaattggacaacgataattaaaattttataccttacttggattgactcgtagcacatataaatagaaaggttaggccatgcaatttaggctactgttgattctataaagcaatgggggaaaatagttgataagggtcagggttgccatggaggtgatgccatggtgagacagcagttaaagtaatcagtaaagcatttttattgtatcgacggctgacatttaagatgcacaacaatccaacggctgctatatttctgatgatgtggcttcacatgatcccagctaatggtgattccgatagtagatggatataattgaatcacactcagtttcagcaaatacattatacacaaaatggcatgtatttccaaggttggccacagtaatcagaggaactttggattcgcaggcagtatagctgtatttgaaggtaagagtacagggtaaaaccaagcatcatgctatcagggttaactgcagctgttgtgccctctctagaacaaataaaacttacatatatcaaaaaatagattgactgtggcagagaacgagagcaagaactccttaccagccagggtcagctgcatgccgccatgcccgcatctgcacacccgtatggtattttgcctccatgccatcgcaatcgcagccacggcagcggaatccgccggtgcgaccacagttgacggggaacactgtcacgatcctaacttcttcccgaggaattgctagctaatcggaatcggagatagatttgaggagagaattggattcgagagagaagagcaaaagggaaagaacgaacagaggaggaagacgatagaagcagcagagagatttgaattgatttctgtttgtgtattacaaaagtacgtaatctctctctctctcgctgccggctttatagcaatgtgccaaaaagcctctctctctatctgtggacccagccaatctctactgagtccactcactcacagggaaacgcttgctgggctgacggagtcaaacgggccgctccttggtgcagcccaagttctcctggtctgaacctcttgcttaggggtggacaggaagctcgtggctcgttagctcgctcggctcgtgacaggctcggctcggctcggctcggctcgtttgagataacgagccagctcgagctggctcgcgagccgctcgcgagccttaacgagccagagcagatgaggcccaggcgcctagcccagcccaacagcccatcacctagcccatcaccttgtgaaaaccctagagtcaatccccttctggcttgtccccatcctcaatccccacccaagccaccgccggcctcatggctgccgctcgcccgtgcctatcctccccggcgccgacgccgccgcccccgcctctcctccccggcgccgacgccgccggccatggacgccgccgcccgcgccgctccttcccgccgccgccgccaccgcccgcgcctctcctccccggcgccgacgcggccggccgtggacgccgccgctcgcgccgctcctccccggcgccgacgccgccgcccccgcctctcctccccggcgctgacgccgccggccatggacgccgccgcccgcgccgctccttcccgccgccgccgccaccgcccgcgcctctcctccccggcgccgacgcggctggccgtggacgccgccgctcgcgcctctcctccccggcgctgacgcaaccaaccgtggacgccgccgcccgcgccggtcctccccggcgccgacaccgtcgtggatgccgctggccgcgccgctcctccccggcgcccctcctcggctcctccccttgttcgctttctctcttgtccccaaagctcacgagcctaacgagctggctcgagctttcaaacgagccgagccgagctgggtttctagctcgttaggataacgagccgagccgagctagctcgttatcctaacgagccagaccgagccgagccagctcgacatccacccctactcttgctatccgaggtgttgccgccgccgtgacaaacacgcgggtgacccgacggctgacaggatgggggtgcggcgaggtcggcggatcccgtcgattcggcggcggcgcaggtgggcgcggcgctgtgcggcgaggtcggcggctcccgtcgacttggcggcggcgcaggtggagatgctgccgtcggcgggtgagcagggtagggggaagccggaggaatggatgcgggatggaagggccgcgatgggtggggatgctggcggagggagcggtcggcgatagagggatctgcggggcggaggatgctagggtttggagtcggcgcgacgcggggagagggaggggcagaatgcggaggtggacgacggtggactcgatatcatgaaaggacggcgatgatggcggatgcggtttctgtgggatggggaatacggtgattccgcaagaggtgtgagtggtgcgcggtgggaggtgggagagctctggttcgtttgatctgacgcgttggatgatctggaccgttggatttgatgaatgagtaatgtaggtgtaagagtgagttgatgaattatagggtagataggtgtaagagtgagttgatgaattatagggtagatacggctgtccatgcgaagaaggatcatcctgttagccgtccagcagcggtgtttcaattaatgccaatcaaagaaagagcttgcatttgattggcccaccgagttggttcgtgcaaaggaaggacggctgcccgacaaagaaggcatgaaacgccgtcgccaacaatgaccatagttgatgcacggaacatggaagtaattccttcgtttctcttcaatccttttttctatatatagaaagtaaccaaacaaagccgtaagataagagtagaacgagtgctccctgcacctgagccggactcctctggcggtcactgcactctatctggcacgtcgctgtaatctatcaggcactagtttagctctagttgttactagttctgttgtaacaactcctagcttctaccattgacaaacaacctgtaagtacaacactaatgccaatattgaccgatactagcttatgtgggtgctacctttttcactagaaagaaaaatttcaaaaatcacataaatatgagttttggacatattgaagtgggttgggtgtgttcgttttgaaaaatctctttgtgactcgtgcggctaacttttgtcatttaatgtcaatattgaccgatattagcacacacatgggtgcgatgtttttcaccggaacgaaaaagttcaaaaaccaccaaaacatgaattatcattgttgctttcactctttcatggtagagcggtgcttccgtccagcacgtaataccgacgggtgttgaatcaaatccatccgtccatcgtgagggggtaggatcgggaaacgtcacgagcccatcgcgcagggcccaatctccttggcgctttttttctccctcacccaacaatccccatccctcagcgcaggatcaatgatgccatcagcacggcagtccgagtcccttatcccccctcgatggctccagcaagtacctgccctgctgctctccctcccttggtgcatgagcaatggagctgccgtcggcactgcctaggcccctaaccagtttagggtttcctcccaagtggtgctcaagatgtatgtgattttctagcacacaaaatactcagaaatcataccaaatctcatagtagtttgtttgattttagatgatttatgagtattttgtgtgtctttattttgatagatttggtatgggtgatgaaatgtgagacaacttagaagaacaagaggagtacaaaacgatgatttctatcagatgtatgagacttatgaagtgaatttaatttattttcagcaaagtagaagacgatgtatgagacctaagaagtgtttctttgcaccggtggaagttgaatcaggagttctttgcacttgtggaagtagaattttaatgtttgatttccatgtgtgggaagttgtgttgttggacagtcaattatatattgtttgcctctatcagactatgagacttatgagcgtgtgtcctgtagacacttatgctggtgcagtgcttttgtatggtctagttattttggaatgaactactcaatcaaccatgcttcttgtattgaatctgtgaaaagagcacaagcttatgatggacacattttgttgttgaatgggaaaatttgagcttattttggacagagcatgatcttctgtcatctttatgtctgtttgtgtgtttgttctggaaaatttggatatgtgcacctgaacttgtttgaaggttaacaaatttgttttctagcgaacctagaacctatcttgcaaggcttatggtaccacatagtacaatcaggcttggccctgaggagcatgagatgagcagccagcagccgaaatcaacaaacttgtctcctgttgcgatggcaactttatgcatcgagttaaaaatggatattgatattgtaagttggggaatatattgtgagttagcatggctaaatgatatctagaaataagattccaatatgattcaaataatttcatgagaaggagcacaactagaactattgttccaatgacccaattaattctaaaccaatttctaatatcatcagtctcctttttctgcttggacaacttcttctaaaagacggtcgtctttcagccatttcctgctttagcttcgtcctctcttgttccgcctttgttttttcaacataacaggtccactcaatacgtagcctacccaattggcacgttccagcaagtg

SEQ ID NO: 74924 - DNA, 59193 bp, Oryza sativa
tcctcgctctgtgtgcatcctccctctctcagcagcacgaggaatccccgccgcctcacctgccccgcctgattccccgcggccgacgcagtccaccgccggaccagccgccccctcctcgctccgtgcgcatcctccctcctctcagccgtacgaattcccgccgcggtccactgccggaccacctcattcgctggtgcgcctcctcgcgactccccgccgcacgccaccgcatcgtgcccctgcaggcgacgtggtggttcccccttccgccagagccccatccgagatggccgcatgcagtcggcgtcaatccagggccttccatcgccgagctcgatctgcagcccttggtcgctggcgttcgaagctggcctcggtgtggagcacgccgttccgcctctgttcaaagcccaccaactcctccaaccgtaatccccaaccagacttgctccatctatcgccaacactcgatctgtatctgactatctgttggctactgccctggaaggacaaggggcatttgatgttggcagtagttcctcaccatcatctcctttcccagcgtgcactcctgcatccccagccatgccaagcctggcgccgacctccggcaaggacgacctcaactttgtgttgttcagcgtccaatacccattcaaaatattccagttggtcaggtaattagttactatcttggctaattgaccttcttttgtctattttctcctatacttaaattgaaccattgaactttgctctttgttaactatttcatcttgtgtaagttggaattccagtaattaaaaatgttgattaggtttcttatttgtcaaaattttaatcatattcgatttggtgtatttaccttctcatttctagatagcacaaattttgattaaaaattggctgcaatagtgttctctgaattgaagaggcagctattaaaaccaattgagccttagattgttaatcaggttgttgatattgctcgcggtcactgtcgttcctaggtctgtaacacctccattactatgctaccaacatacacaactttttagcctatatatgttttcttttgttgttcctttaatttatttaaaccttttcaggatggatagggaattcaggatggtagttggtaatctcctgcaggtagaatccattactttttactgtctttttctcaatcatcgcaagcattttctttgcttagggtctgatttatgacctagcttccatgaatctggttatggcagtcttcttggtagatgtggcgttaggattgtgctcccactcacactcacactcagaggcatattgcctaggtctacagtctactccaaaccacatagttcaattcctccgcgttttaggtaaatcactgatctatctctgtatttgtgagaaaatttttgatttggtatatatgacgaccttgagaagtaatgatatgctttcttctggattctgtatatacttttgtgcagaactggagtcaaatgtttccgtttgttttgtggcttgattagtcctgtgcccatgcatctcttgctcccttactaatttctctggtgtgtagaattgcagatcaatgatgcatggcaaggtcagagcgccaatgaagtactaaaatggtaaaagaagctcctgctcctgtaatttcttagtatctctatgcaacaatggatgccctgatatactttgatacaggatgatctgttgattaccatatccgaaccatttgttctgactgtttatatatattgtagatcaagcaactactgatcatgccatttgtagagtttatgtgcttatcgttgcaaggtcaacaaaggctacaaacaacctacaaaccttttgctccttggggctactaaagcgctcttcttttggtgaaatggcaagactctgtttcgaagagtatatttggttgcttctagaagtaatactttttgcatatagttttgttcctttaaccttttaggatcaactaattttgttctccagcactgatttgatcttaatgactcattgcttccaattccataaggcacatgctagatggttattgacagccacaacaccggcgccgaggcggtctgccctttcgccattgacgcggcccaacagtcacgctgctcgactgcgccggtgtgcccccaacctcttgtccttgaagccacgtcttgctgaaacgttgccccaggcacgattagggcgcttgtggcactaattcggaaagatggaaggtaattacaatcttcgacccgcgattccctccccctctacctcatcgtgatcctctcatgttccctttcgctattcgcgctccggcgaactactcagatcggtcaatccctgaaatagcagataggctggtggaccttagctgtggacgactgggatcttgatggcaccgatccaagcctccgaggagagggatggctgtggaagggcacatcactgacaaggtagtaatttaccaacatcttagtgagcataattccacactaatgagcataaaagttcttttttttgcttttaatacatacagagattcagttcatctgcctcggattgctataaaaatactaattgtctattgcagcactatatcatgtccatttaacaaccaattcttgcacagctaagaaaatgtgtgtgcactgtgcagccacaattgcagatatagttaggtacaataagtgaagttgaggggaataatttggtgatgactataagattttctgcttgtgcttctcaatattttttagatatgttatcctctaatgtaatggggagaaagtctgatatattgtgatacttttcctgctgtaaagaagtatatatggattctagacccttatgctaaatattttcagtgttatgacgttagctgccatgtttaaattgttcatttatacaggtgatatttttttcctgcatttattaattcaaattctaaaactatatatgctgtagaatttcagtgttatgatgttggcagccaaatacattgtttaatagggaatatatttcttgtatgcatagtgaattcaaattctgaaactatgtcaggttgttgacacactatcatatatggctcactgcctcatttaaattcttgaatctgtgttgacttgcatctcccatgtggtactcaaatggactcagaagctccccatgttgatattgctaatcatgagcattctacaatcatcacctataaacttggttgatggactttacaaatgcatcttgtctaaggaatccctgaagtaagcctgtttccatacgattaatagaacatggcattatgttattgtttaatttatattaatgatgtgcgttttaggaaagagtgtattgtgatctcaaaggcttatccaattcgattgagtctaaaaacaaaatcatgaatcacttcgtatgaatcatcacctgggcattgagtgtttcaacatgattgtacagaggcttgcacacaacaaaattcctacatttaatgggtccaaaagttctgttataaagcacttcatggacatgtgattttgtataatatctctgattattacatttggtttcataggatacttacatcactctgaattttctatcatttttatttttttcggcaaaaattgagcaattttggacatcatccattatgctgcaaggttattgatgttaaatcatttgcaagatccatagatgtttggccatggatggattacgatctcgcgttctccaatgtggcaaagttcgctcacttttgcaatgtggaagttgcttacccttgactaaatcaggttttcactctccctaattctcgagctcgcatactatgtttagcacattatgcttttcatttcatgtgttctgtaatatgagagcttccatataattccctcatctgattggcagttggcaacagcctgccgtgtttgttacaattctgaatagaaaactttgcccatgtcggtcatgtgtttgacaaaatgctccagacacttgatcaaatgaatgtatttgtattttctcacttcctcagtatagcaacaaaaatattactggtttgctttttcaatctgaatcactaggtgttgttaggtttggagaagtttggactgaatcaatgcaatggacaattcatagaagatttcaagcagtggaaaaaggagacttctacaactgccacaggtacaatactctgacattgaaatagaagctgaccaatgcgctcacattgaaatagatatatgtttaagtacagcctgaattttccttaataaggaagaccatttaaccatttgtgcaggattaaaatttggtctaagatacagatcttgatggcatggtggtgctgagtgtatgccataattctggtgagagttggatgtaatttgcttgccttcaggataaattggatgtattttttgctgaccaactggatgtatgctttcttaaccggttttatttatatataactttagtcagcttgtgaaattatgtaaaattcagttcctgaagtactggtacttactgttgatttatttgtgcgtgcacttactgatataagatcatttgttattctctttacttacaatttcacttccagctggcaatgatttatacttcaatcataattgtttgcttaggaagtactctctccgcttcatattagatgtttgttttcttttcttagtcaaacttcttttaagtttgatcaaatttatagaaaatatattattattttcaaaagaaaacaaacatattatgaaaatatattcaatgttatatttaattatactaattttatattttagatgttaaatttttttataaacttggtcaaacttaataaagtttgactagaaaaaaaatcttataatataaaacggagggagtagcaacattgcaatgtataaatcatgccgggctaccttgtacgttatggatatattcaccaaaaaggattttatagaaataatccaaatagggtttttactatgatgtatgaaactttatttttaccttaacaatttttatggtctgcactgccttaaaaaaagtcactattgttctactccctctatttcacaatgtaagtcatttagcatttcctacattcatattgatattaatgaatctagagacatatatatttatctagattcattaacattaatatgaatgtgaaaaatgctagaatgatttacattatgaaacggaggaagtacctacatacatacattgccaaaacgtgcaagtgcacgattacgagtgctaatataaaaaaggagttcaccccctagcaatcctacgtgtgaaatcaaccactcttatcccatccgtccatccaccctctcatccaatctgagccgtccgctgtacaccgtagatctatatccacaagcgatttcgcccgatgtcatcccaccacgcggtaactgcgacgcgcaaatccccggtgcgatgacgactccgcctgctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggtgcgtgttcttgtgtgttcttgatcgatcgatctgcgttgggttgcgagatctgagatttttgcatgtttgatctgtgcgtgtgtgcaggggtgatgcgttgcagcaagagctgccggctccggtggacgaactacctccggccggggatcaagcgggggaacttcactgagcaggaggagaagctcatcgtccacctccaggctctcctcggcaaccggtgatttttcttttcttggttttatggttgctttgattgctttgtccatggcgtccatggctgagtgggttgctggctggctctggctgtctacgatgggcgtccatggcataagaggattctgaactgatgcataagagtgtcttgcatttgcagttctctaccataatcgtggtccacaacatagccgtgctttctgaatactttcaatggatagtcaacgaagctctacactacaaatttctgcaataacatgtactattattttttgtctgaattttgctttgcttgctacctttattttacctggagacaatttatatttggcctgtgataatactctattgtagtgtatgtactaaaatgtgtttttattctatttaggagggatcatatggaggttagttaactattgtttatcactgattctcttccatgcccaataggtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttggaacatttgctatagtattttctgatcttatcctgggatgtacctgaacttaatattctcggttgtaccggttcatttctgagttcattccctgaacttgttgactaatttcaatctgtgatgtggctcaattttttaatatatatctaccaaagtttggtttgtttatgttattggtgcactgagataattttaattattttggctgttacgttggtaaattatgcagttatgacattttatcacacttcctaatttttatatgtagtttacattttatacttatttttttatacacgtgcacgattcctagtatatctaatggtcaacttaattccttgacttctctcatggaggcaaaaccggttgtggacgaaattctgatgcatgtcccatgtaccttgatacatatgaggttcattggtggtcttaggttcgttctttaataaactgtctttacaacgatgaccttttaaacttaacatccaatttatgataagattaaaccattgtatttcttttagttaaattaactgtttgagctccataattagatatttaatgacttttttaaactgccacgtggcgctctaataaatccttaaaattctattaaaaaagcaaaacatctaatcgttggtttttatttaatcgggtgaacccatagttatcaccattagatctatatcttaaaagtcaccaattaaatctatccccaaaaccgccacgtttatgccattgatcgctactacctccgtcttaaaatatagtaacttttagttacgaatctgaacatacaattgtccagatttatagctaaaaatgcttatattttgggacagagggagtaagtaggaaggaaaaaaaagtacggtacgtttacgcccagccccacgtcttttttttcttttcttcttctctcacttagattagatgaaaaataaaactaataatttaagctcatatgcaaaaatatatgttatttggagttgtattataacaagctgtatgctgtcggatcatccataaaaaatataaacaaattgaaaatatagattatataactgtatatcacttgagaaattagacttgcatttccaaaaataaaaataacattcaaacattcccaaaagttaaatactgatataactaaataacattactaattttttcatatattatgtgtttttcttttgatagtattgatgtgctttatgtcctaggcttcattcgctctagctaattggctgagcttatcaggacgtgcaaaacaacgtaggtcattggcattgaatattatgattaattaagaattaaatattaaaactttaaaagtatatttatttaatttttagaatacttttatatagaaaccatttccaaaacacacacaatgttcggtaagcatgcttacagtaaacaaggggtggccaatcctataagtacttcggtactcaaccttaatcattacttcctctctttcgtaatgtaagccattctagcatttctcacatttatattgatgttaatgtatctaaatagatatatatgtctagattcattaatatcaatatgaatatgaaaaatgctataatgacttacattgtgaaacggagggagtacttaggtactaaaattcttaatatgtagtatataatttactttgtcaattagtagtagccaaatatatcaattatatgtccctactattcaccgtatatataagttctatatagaaaccactgtctatcaatcttcgagtctgtcgacggtgggtacccgtagaccgaatatagagggtattggggtacgttggtacgaggatctatgtaatacgacatcaaggaaacaagagacaaagattatactggttcaggtcccttaataggtaatagccctaatccagttgatatgggattatacggggatgaccacaaattacaaagagaataacaaaactcgacgataccgacgagatcgtagtcgagttgattcgactagatcacccagcgacttggctcctgtaggctccggcttcgtaggctgtggtcgttgtgttggctatgagatttgatgccttaggtcttcccggggggtcccttttatatcgcaggtcaggtggtctccaggtaggactcggagacatcggaccctgcacgatatagtgacgacccagtcctatacgggtaggaacctttccattgatggacttcgagatgaatttccttagcgtatacagagaacgtccatacacgcgcagatgtaccgtattgccatatcgcgtacatctaagggtaaagggtatatcttatccgtagccctgacagagtcataccctacacaatgcacctaataattatctcatatccaatgagcacgtgtaccatctagcattgaggatgaaggacgatactaactgggaaatcataaaaagatgacagataagtagatgatgccaccaagtgacagtcaaacaatagttgactacaattagattgtgactatgagtaataatattcctactctcctacaaccacttctaggatgttacatgatgctctaataaattaagtaaatgtaagaaaaataataagaaaaaataaagcatctacccaccgttttacacttaaaccggtggattcattattttcaaccattagattagatctattaaagtaattgctcgctcttaaaaaccagttaatccctccctatgtacacatgtacacgaaaagaaaaaaagaagagtacgtacgtatacaatcctcttgttcggtagttctctttctttctttctttctttctttctttctatgtagctctacgattttcctcacgttatatatatatatatatatatatatatatatatatgtatatatatatatatatgtatatatatatatatatatgtagtgaccactcctggtgaggttatcgaagaaggcacaccgtgccactgcacgccatcccatctatttacttgaaagtatttttttattaactatgaagtaaaagacaattgtagatgctcatataaacacgtgcacacccacccaatgaatgcacatacatatactctacccctaggagagaaaaaatatttgtttgttgaaaacccaagaaaaaaagtacataagtacgagactactaatcgccggaaaaaaatattcatgcgtatgtacactcctaaatgtcaatgaaaccacattataaacctttttttattatgtcagtctcttctaaatagtgttaacaattagtaaaaataattttgacaatatagatcattccattgtatattgcctcctgaacatgcataagtggatcgatgtataataaaaggagaaaaaaagccaaaacccatatttactcgaatgtttgggaaggatggtaatatgcgagtttacgtataatcgggataaagtttttttaatatgatagacattatcatttagtatatcaaagtctttggtctatttcacggtatacttatttagtttttatggttataaggtaatctatgattttttataatgaatatagtgtgatataacttcttttttagtattctcattacaaatagcaaaataaattgcccgcgcatctgcgtgggcttcctttatagtttcaagaaaggtgtaagagtactagagatattagagatgacattgtatattagaggtgacatattatatggtttgcctcttaatttatgagtgaatgatatgaatgagtttggatgtggtagtcacgtctacatagcacttgccctcaatgcttcaaatggtttgtagacgcaattgaagtgaacttttgaggtctcacttttaccatgttcgttctgctgcgtgatgtaagattgtttgctactacatagacttgttcggccttttccgtgatggaagatcacgttcgcgtgatctcgatgaacaaaacattacccagtgcccctcgtttgatctaatttcttgtacatctccttctatatattgcataacctccttttttccagtatgcgcattttgatggtctaaaactgggccttgacagtaaatttttattctacaatgttttgttaatcaaagatcacaatcgaaagaaagtacttttgaacaagaacccaattgatgcaatatcaaatctgttctcagtaactcgtacactatcaggttattactattgttggtgaaaagcttgaatttagacaaccaaattataattatatgtattcatttacgaaaaggagaatgtttcaggggaaaaaaaatcagcctctgccattggtggagggagggaatcagggaaatggacactatattatcctttagagcatccccagcagttcatccatatttgattttccatatgctcatatggatggccatctaaaaagattcctcatccatattccttctcactcccatagatcatctatattgcatcttccaatatcactccctcctatattttactaatatttttcaactaaccatacatttgtattattttttatggactatattttaaacaactaaattttaacagtgttatttatcccgataatctaaatgagtttattttaatggatgtatttttaatattcccaactattttttctcctcttctctttactccttttctctcatcttccctattcctcttcttctctcctcttctattcctcttcttcttctctccgctcagcgtggaggcggaggctagcggctggtggccgcggcggcgcaacgggcgcggggcacggcggcacgacgggcacaggggcgcggcggcgtgatgggcacggcggccgacgggggctgcggcgtggcggcacgacgggcgcgatggccgacgggggctgcggcgcggcggtgcgacgggcgcggaggcgtggcggcgcgacggccggcgtgggctgcgggttccagatctggtatgtctctccctctccaccctcactccttgggaaaaaatgcacatctggccggcgatgacgacgacattgggggggtcgcgacggaggggaggtcgatctggactttggatgggggcgggggacgctggcggttacaggatgtggaggatggcgtgaggagagagaaacgccaaatttgatgtttctctctccccggatggaggatagctaaatttggatgctgggatggagtatctgttggagctcacttttcttctcccaacctctattttgtggatagaggcctgaatggagtatctgctggggatgctcttaccaaatgctctggataataaggtttactgctggtgggccagcccattaacgtatttttaagctcctgatgcacacgcaccgcatacttgcaaacggctcatcgtttcgcttattcgtggcatatttgtaaacaaatagtaatttgtgaataaattttttatatacatgttcttagagatctaaaagcaatgggtgaaaaaataaacttcgatgaaaaacctaaaatcagctctaaattaagggctaaaattcaaattttggctgataagcataagcataagcgaaaacatgaggccgaaaagtatccatacattaagcgaaggggacgaaccctagttagaagatagggtccaccatccatgcttttgaaggggaaacggattcgaatacgatgcgtggcccggagcatccagtgtcgacgttagagaggccttgatcggccgctgtcggtgggaggagattagttccggtacttccatctgcattgatctcccaagacaatggtggacgtccactcgttctacctctacgacgacgacgaccgatacaagtcgcatcttgtatatggtccgatacgcatgtacggattactatattttttctccttgtgttggggatcgggttgccgggcgatctatgtatcgggattttgttcacacaacggtttttttgtgtgactagttaagtgcccgtgctctgtaacaggttctatgtatatataacctttatgtattgtataaacaggcaaaatgaattaatggattgtatgatatacaaactaaggacgagaagctgttaatattgaataagaacattgctaatatatactccctctgtactcgtaaaggaagtcgttttggataatttttaagtcaaatcttaggaatataaattatgaataactcttaaggttattgagtttgaaaatataaaaaaaattatatgaatagatttttcttgaaaaatactttcataaaagtatacatatatcacttttcaataaatgtttttctagaaacaagaagtcaaagttgtgttttcgagaccgtgtcgctgttcaaaatgacttccattacaagtacgtagagagtacatctcatatataaaatagactaacgatgcactccctctgtcccaataaaacttaaaccctagcactctagtaaggatttaaggaaaacgacaaaaaaacaaaatactcttagctaataaagaaattgtattggtgaatggatggatggggattagtgaaggaataacatttctcgatttgtgaactgatagtaggtaagaagatagaagttggtttattatttaggacaaaattcaaactttagaactgatttattttggatggagggagtaggagtcccgacacaattactgcttttaatacaatacataaaaaaataatcataaagaaatagatagatttgaagttaatgttagaaagtttgatattctatctcataaatcacaatttgttgtaaatgcacaccctcctacgtagttttgttgtaaaaatcatcccattacgcatgtgcttaatgaaatcaactcactatcgctgatgtagagccatcacatgctaagctagcgagtcaatcttgtccaagtacttgcattagacttatttcttcatgtttcattgaattcttttatgcatatagcgaaactaagtacgacaacgtttaaactctcatcaacaattctctttattgaatcttcaaggaaagtgttaaggctataattctagaagtatttaattttgatagagactatattgatggctcataatttataaaaacacattgattatagcctattacttatgagatgtaatcttaaacgtgttttataaagtgagtaggggtggacatttgcaaccaaattacttatgaggtggaatcgtaaactttaagtgatttatggggtggtttattcaaatttcataattttcaattgtagaataaagattagcgcttggcagccgagcacgtggcagtgagcctaaatctaactgcaagagcggagtctagagtagagctgtcgagtggtccgaaccctgctccatacttctagtttagttttttatatcactccagaccgcttcgttgctattttgggtagagttgaaatcatttgtttgaatttcaacttcaaaagaggtaaagctgaagctgtagccctgtcaaataggccctagatatcacaagaaatttgaggtgataccaaagtgaagaatggaaaggacacacctaaagcgattgaaataaaaaaaacgaatccacggaagaaagatgttactacacccacaccgcgatcagcagagttgccatccattagagttgtacacttacacactgagtgctgaattttaagcagacacaaaattaaactacacatggacagaatagtggaatgcaccaagaagaagaattaaattctgcagctagagtggtatatatgtagctaagctaggagtgagactccaccagaacgtacagtggcttcccattgagcctctcacgaccctgccaaaagaaaaaagaaagagaaaatttcagccccaaattaatcagtcatcggcgacagcttcaatttctctcgttttcttgacgggaactgatgcagagtcctatatatgtatataactggagagagactcagcagcagcaagccagcaaccagcgatgaagtgacagtttgttgaacgacaaatacgcgaatattagaaaataacataatatcaaataattagaaggggtgaggcttctaacccgggcagggttggaaatttcggtcatttcggtgacccccgatacgatattaatttggccaaaatttttgattttttcaattttttcatgaatttggataatatttgttcaaattcaactaaattttgttcaaaatttcggactgaaatttccgaaattttgagatttcggtgacctctgatataaacccctgaaccgatagagtgaaccctgaacccgggtcgtctagcccaccaccttgtggagctagccggaagaccctggacatttctcgcgatgacgtgacagtgacattgtggacaattaaagctgaaaatgcgacattcagcgatccatttggagactggtgatactcatattttccttttaatttgagacaactattagtttaatggaatagttaattcattactcgatgcagtctacggcgattcatcactagtcaagataaactccggttattgcaataatacaacatattgtatttattctactatcatcgatgtatttacaatattcaccccaatcaatatatcccaatgttttaatcaaaataatactagctacaacactttatataattcatgcatcttttcttttgctagtactatcttgcgtatctatccatctttttgtttcatgaaaagtacataaatgtgtcaatgttcaatcactctcggttaacgccggcaatattgaatttggatgaagaacgggatatatactgaattgaaagtaggagcgccacctgccaattcttctctaccaaagtacgcaagttatttaatttgggttaactagttcatttattttatctcaaaatatatatactccgtatctaaattcatagctaagagttactatattttagaataaaaatagtataacatgacctcaaaacaaagtgtagaatataagtgaaataaagatgaaggacatgttcagataacatccacactttacaacacactaccacaaaactccttatgggttgtactaagtcataatttgatggatataggtcttgtcacacatgagtcatttctaacccatcagggatgactggatctgaactagctggtgacactttcttgtcaaactttaccataattcatactcgtggcaaggttggatgaagaaattaatcgcaccatagcagatggagtagaaatgtgttaagccatagttttagttactatagcttgcctaaattttgatatgatataaagtgtgccattcaaccaaacaggtataaggcacttattgtacatgcatgaacttattaccttggtgtacttacgatgcacaccaactaaaaaattatgaaaaacaaacgaaaaaaaatctgcatgtaattgtaatcttaccctatctacatatacaattgtaaatttaaatttattatattttatgataaaaccaatgaattttgtagttttaaaagcatcattttgcttaattaatcagaattgttctatttcgactactctatctgtaatcagtcttaaccggcatatgcatcaacaccaactattaaaaatccgccaatccacatgtggtgtgtgaaggacaaaaatttacgtggatggtaattagaagtataagggtgtgttctttaccccatctcttcacaacttctattttctcctctttttttttttatgtacgcgttccaaattgctaaacgggacttttttttcaaaaatatataaaaaattaatttaaaaattatactaataatatattttttcaactttatttttgctaatgtttaattcactttgttttatgtgcggtgtggggaggtggagttcccaacctccacctccaaatgcagccttattagtagacttttttttaaaaaaaaaattggtgacaattatggttactatgtgaaaaattggtgacggtatatgtttaggagtgcgtgatgcatgtaggggttgtttggttcttaactaacatcgtcataactcactttaggtaatgttagacaagtgtggcttgccacactttctgtggcctacaaattgtaagccacatttgtggcaaagttaggcaaatgattaagtctataacatatggagtaagatggtaagaaaatgtggcttaccataactatggcaatgaatcaaacacaaagctaacgaggtgtggcagtttaaagtatggtctggcaagttgaagcattgaatcaaacagccccgtagtatcccgataatgtggggctagctgtcgctgtccggccggacactgccaatatccctgtcgccgtgtgcaaattattcgtggagaaggatggccggaatcactcgacatcaacactgtcggggggacgcatgaagcaagcaaattagctggtagaaaacatgaattatccttgtaccaatatattatatatttcttcttgtttgtatttctcatgttctcatcgaacttggaaatgagctcactacctgccagccgttaagctagcttcaaatagcttgtgacagggtcccctcctatatatggtatcccatctatatcctaccatgaatgaggtcatagcttgagccaaactgtggtttaatttatcaagtggaatttggtctagagtgaaacaatgcttaaaaattaagggagcaatgtgagacacgcatagcgcagatgcaagatcggtccaatgcggcatgaggggatgaggagacagaggcacgaccaccacagcgcagatgcgacatgttttttggccacgtgtggactcaccaagatcgaagaactcgtctccctgtgcggaggcgagaggctcagcagaggcacgggtttagtcgacacgtacgtaaaaatttaagctggtgatccaaagcaactcgatacgttctcgcactgtaaaggccctaatagtctctggacaattagctttatataatttggaacattgtgttcaatttttctttgataaatcacactctatttcatccaaatagaattcatgtaatcacggaggaattttaattttttatatctatatatattaccccttcgaccttgaccaccacattatatatttatcttaaaagggaaattcaacaacttacaaactgtacattatttatctctcaacatgtattactgttcacagctttatccctgaattagggtggtttccacagttcgatcagtaaaaaaaaataggtcccgtatgtatcaatttttctccccctcttctatcttcctcataagcatcataactgtgatagttgaggaatggggaggggatgttaatatggatttattccatttttcttgaattgttatacacaatttttaaaaattccaaattagctatctttaagccatggccacatccccaacactactctaaagagtctaaacccaaatcaaattaatgtgtgcttaattccatatttaatagtacctgaattattttttaagcatacggtatgttcttaattaagttttaagctagaatgattatagattatttcttaaaagtaaaagtgcctctagttaaattggaaggaagaactcaccttcagttccgggagctcaatcacacatgcacactccaccacttctgcaccagcacgctctgcatgcatgcacattcaaatgtcatatatgatcagaaacagaaaatgctcctatatagtacacattgtactgcgttaacatgttgtatataatattgagctcccccaaacagggtgatagtcacatttgagtcactattgcaccatataattcctccattccagaataaatatcattttttccttccttttatcccaaaataaatccattttaagcaattattgcatcacaatttgtaaaagtatgtgatatatgcatttccagtagataaaaagagaattaattgtaatggaatttgataaactgaggatattttagattttttggttttgtattggtatgtgtgggatggatgaaaaattattttattttggaacggacgggtatactataatacatgtaatagtaatacacacatatatatctcctgagaattcaacaattttgtgatattagcactaattcttcgatctgaatttaaacatatatcatgagtgttatcttattaagcccggctagctggtgaacgatcgatcgatttccaatctggcatatgcatccatatatatgctcattaatttaattacagatatgatataattaatactccattcaattcgtgcaaaaatatataaacctagtattaaataagatacatcatagtattacgaatcccaatactaaagtgtatctcatactatgtttttatattttgggataaaacgagtacgtaccaagcaagacgatggcggcacagagcgtgccgccggtggcgacgaggtcgtcgacgacgagtgctcgctcgccgggctgtaccgcgccgacgtgcatttccaagcagtcggcgccatactccagctcgtactcctttgacatcacctcacctgcgcacatgtatatatatacgcaatttatcaaattcccattcacatacaaaattctatgcaagtttcatttcagtctcttggtcaggtttatttcactactagaattcaatagcttccctagagtttaaattagaactcaagggataataagaatccctagggtgactatggagaactcaagggaagatttatgtcccctagagttacaatatgcaacctagggaacttatgccacatcagctctattatgaaattattggcaccacagtggcaaccaaagtgagtcccacagaaaattttggaggcaaagctcccagcagcgaaattttttgcgggaaggcaatatactgtagtagactaaaatatattctcccccccccccgctccaactcccctaaacaacatcagaagggtgtttctcctccggtcctccccaactttgctgcttctccaatctcccccaaatccctctccaaatccctatctttgttctggatgctatccaaatcggagctccctgctgattagaagacctcagatagagcattatggagctctattgctgtagatcgatgttggaagtgcatcgtcctctctaacccattgccttccctcgaatattgttagtaccttgcatatcagtaccttgcatattgttagttttgttgtttgccctatatatacaagccttatcaaacaaattggttgttcactaaatttgtttaataaaattgtaacaattgtttttttataggatgactcccaagtatcaggtgttagagaggaaactggagatgacagggtaaatgttatagctgaaggaatgtttggtggctacttgaccaattcatctgctaatggtgccaccacctttctcccagctttagatgaacttgatccattttaatttcaactggctgtggtcatagggccaacttttgggaaaacttggtagttatagcgcctaacttttgggtaaagctgattcttaccgaaacatgtgtaatgaagtggaattatgccattttgagggcaagatgattataatgcatcttttgaatgctatatatggtgctggtggatttaaacaatattttgttcctgtgtttaatcatattatgtgtggtggtggtctttgtgcaatattacttaccttcagtgcaatttattttacataaatcctaatgaattgattaacatcataaattgtaataattatattaaaaaatgctcaacataataagtaattcctagggaatgcatgtttttgttccctggggtttcaaaaggaatctaacaactctagggacagtaactttacacgtcacttgacacccaccagctgggcatttttccctaggtcaaacaaccctagggagcattcctttccctaggtttctcttgcaaaaaccctagggagctctttgtttcccgtagaccgtttccctagagggcattccctagggttcactctagggaaacctcttccctagagtttttcaccattcccttgggtttttggctctagggatgccattgaattctagtagtgtttgtagtttatttgtgccacgctttcatagtatgattttccaagaacttttcacattatgttagcattgtttatagaacttgttttaagctatttgttatatatatttatgacatataatatttaagtgactctaaaaaaggccattagtttgtttagtgaaaaactttcaaaatataatgtatagtataattgtactttaactatattataaattttatgtaacttgtatataagtattaaaaattacacgtaacttctcatacataagttatatataagctacaatatacgtagttttaatataattacaattataatatagttatattatagttacacacaaattgtactgtatttttttactaaaagtcttatgacaatttttagcaatctctatatttaactatttcctataaacgaatcaaccatctatcagcctttctttccatttcttctctaaaagtccatcccacagctgatggatgcatggctagaggcatgtttggttgaggattaatattgttacacattttttactaagatgactaagcttagtcttgtcacacttttgtgacaaacaaaataacaaactaaactcaggcaaagttaggcaagaaaataaagtgtatgacatgtggacaaagtggttaagggtttaggtaaagtagatttatagtatgaactaaacagtacctagtaaaattgtgtcttacctaagataaaatatggcaaatttagttgtcaactaaacaaaccctggatctttcgattctctcatggttatacatttatatagtctttgatgcgcatttcatattatggataatctttccaataagatataaacaaaaatagtaaaaatacagacaaaagtgacttaattttatgaggaatatactaaaatcatgtattaaatcttagtatttgttacatgtgaattgcctgtacgtactttctaggaagtcgcctgttaagaacagacagatcatagtttttacttagagagttaagcagccatacaattttctgtacctggaagtttgttaggttttcttagtgggataaattttgcaccaatagcgagcgctatgggaggaccgaaaataaaccctctagcttcgacccctgcaccagaaagaaaaagtgaaattaaaaaatctactggaatttactactccaaccaaagaaaatcaaacttaataaacatgcatgagctcaaaatggcctgccaggctacttgtacatataaatatcatggcagctcgatataccagcgaacatatataatggcatggatggttatatacaagtagacaaggcatgcacctaattagaccaattaacatcagaactgaaatactacatccaattttacttatacgacattgttaactcttaaacaccatgtttgatcatttgtcttatttaaaatttacaaatttagtaaaagaattgatacagatatgcaaatataagtaatgtttaaagtacttttaaagatgaaataagtcataataaaataaatgatgcttgcgtacttttttaataaaataaatgatcaaatgtgatataaaaataaacaatgccatatatttcaaacagagagagtagtatttttcatatgtgaatatatatatcatacatgatcacagataaaaggacaagattgtgtgtacacaaagaaaaaaaaaccaaacaaataatagatcgaggagttggcccacaccgacagaaatcgtactcaactacatacgtgcagccatggaacagtacgatatatgtgcactggatcttgtgatagctctcactcattgactagcttgatacatactatcatcatgaaagggagagaaagatctaggaaagcatggacaccagctagtagcttatatataaatggctattgctggcccggagagacagatcttgtggtgatcgatcatttgcatcatgccatgcatgtgaacgtcaaagatttaatgcccactggtaattaacatcgatcggaaccatcgttttgcttattcgcggaataagagaaacgatatagttgtaaacgaaaaataatttgtgaataaaacttttatatacgtgttcttagcgatctaaaagcaaaggctgataaataaagttcgatgaaaaaaacctcaaaatccgctccaaatataaggttgaaaatttaaattttggttgataagcataagtataagcgaaaagatgaggcccgatatatataactatttaattggaagtacacattatatatgccacctcagtttctcaaagtttaaactttgaaaacgcttcttctttttttagcaataattaaatttataaattcttcaaaaatatgttactatatatatatatatatatatatatatatatatatatatatatatatatatatatatatagagcgtgcaacacatgccactagtaaatagagatgatgttcacccaatgcaagtttactctaatatgattcattagacaatattgtggaatcatgttgctcatacaaacaccgagaaatagaagtaattaagatatatttgatgacctcgaaaatataattcatggtgaattagttaagttaggaggaacttgggggcaaggatctaactctaaatccgagtcatgacatggaatcaaagtgaaggtcaggattaattgtatcaaccctatatttatagcattaattaaaaactcatgcattttatattggtatagattattgaagtatgtattgttataaatataacacaacatgagatggtaataatcaaccataaaaattattcgagaatagacagtatagttaataagccacacatgtattttggcataaataaagtgcctgggatgatattggcccgagaaataaaccgagggttcctttgagatgcaagatatatagaaacaccatactagaaataggaaaatcacaggagcagtgttggaattgcacaaagtagttgtttgatactctctctgtccctaaatataagatattttggttggatatgacgtatcctagtactataaatctagacaaatatgaccagatctgtagtactagaattcatcccatccatccaaattttcagaatattttgggacggagggagaacctgataagaaaattacaataaatttaaaagtatgtatctagatttattagggagaaagaaaattaagaaggtgcctatgaattttaatcaaaggtatttgtgaacattatgttagaccttaattatgctaaaatttctccaaatcatggaggaattttatatcctatgaaattactttgaagcaatgctacatctgaaaactttaatttcataggaatgttttccaatggattgaattcctcctctttagattgccacctatcaccctgtgaaaatcacatgtggagacatatgagtcaataaatgatgtgtgaggaaaaccataaaatctccaatctaaagagtggtaagacatcaaatccccatttttttttctaaattaaattgtggtcacatttcaatagccatcagctatcctctccccatctcaaaatttggtagcatcacaattacccgtgatacgccatagtgcagtgacgtaggctatgttagtgacaaccaagagaatatattagtatgacctagtgagctgacatgagagatcgaatatgtgtatggcatggtgggcgccttagaataaagatgtctatttccacactatataggtcaattgaggcgtacatagagaaaggaaagtacacctcaattaacttatgcgcatgtgcatatgttgtcatgggtgaagtgataaggaaagagagcatacccaaaagttttgacatacacaattgatcatatacacggatgcacacaaaagggatggtggactaaagcaacatatgtgcacggcctacctacctaaatggtttctattatcgacctaaacttcaacaattgacgcaaagtattttttttaactgactattagtttttttttctttgtgagtactgactattgaagtttgtaaagaacaagataggtaggggtatgacagtgccaggtgtataaagtgaactcctacaggctatgggtaatagtggaatgaaatgaccactcctaaatgaattgacatatgtgtattagttgttggaggtgtgtattatagagttatgttccatggtttagttttgttgatgtgcatatctaattaccttttggttctagttgaagcttttttatgtggtggaggatccaatccaatgaacatgacaggaccatgaatatttgataagtcacctaatcaaatccaatttatgtatatttttcatagttagtgcctcaaacttccatatatgcctatataccaatctatactggtagctgactcaaatgtccaattgtcatgcacatatatatgatctcaaaatatttgtccaacaggcacaaacaagtggagggaaaggcaaatatttttgtcatatcatctggaagccttcgaactttacaaaagggtcagacagagaggccaaacctcctgttttgtagtcaattactactgctgcattattcttcatttctctgtacatttgactgtgacactcctcatacgaataatctctctcgctctgatcttacacactctctctctctctctctaatttatttgtcattttagaattattttcgttaatcttataaattaaattgacttagcattttttttggaatcgacaaatgaaaatcatgtcattagatttttccatgaaattacttcgatactactgaactttaccgattttctacagtaataagtaggtaattaacggttaggagtatgtattattggaggccgggtcagtataaaaaacgacaagtaaaagatattgtactgtacaacttggctagattttcaatcgacccatcgtgtgcctgtcaaagtcacgcttttaattaactatatttggatcttcataaataataactctgacttagtattaaaaaaataaattatatatttcaatggatttgataagatctgatatttttttgagataaagatcagattagttactactccctccgtcccttaatataagagattttgacattttacttgtactgtttgaacattcgtcttattaaaaaaattaaaactattatttattttatttgtgacttactttattactcaaagtactttaaacacaacttttcgtttttatatttgcacaattttttttaataagacgagtgatcaaaacagtgcaagcaaaatatcaaaatcccttatattaattaagggacggatggagtacttgaataaacaaagcgcacaagttcaaataaatcttgattttttcaattttttgagataaaaaacaaaacaattatatgttaccagcaacaacggagatgcctttgccagtgtaccgttcaacgaacaagtcgatggtgtccttgaacacagggggatttagaagtagggtcgtgatatcttggaacattattcctgcacatttcatcaagaaaaacaaatattatgaaagaacctgaaaaaaaaaggtattgcatagaccttttcttctgcagggatgtgtcattgatttaattcgcagatctagtcaatcgattttttttctagaaaaaaataattgccacaaaactcttccaaagtatttgtgggaattctataaattaaatttgggcgggcaagggaagatgagatgtgtgttgagaaaaatgcagagagagagcgcgcgcgcacgcgtgctcaaattaaactgataccaaccaatatatatatatatatatatatatatatatatatagagtgggaaaagacttctaaagggaaaatcataatgtctcgaatacacaacattttgctcacaccaccttcatcatcacgatggatgcgcttatcgaaatatccacataattagccttttgaatagagtgagagtttcacctcaataggaagattaaatatgtcttcatgacataatatagcaggaaaaataattttaaaaataaaggaagatcagttcgcagcaacaatattttgtggtaaatgtgcatgctcaaaccatgcatgtgcatgcctataaattgtagtaatgtgagaaatttggttataggttacaagctgcaaaaagctcatgataaagtcacacaagaaacaagctatattcatgaaagtttttgggttcagaaccaataaacaaaaaaaggaaggaaagaaccaacgaggcaaggatcaatagtaccagtggggacctttgcaaggaaacacagattttggcacttgaaattaaaggcaacccccaaggtcaatattctttacagaattgcagcccctattgcacatgtatatatgagattatgagcacatatatgctgaaaaaaaggatcagaaagaagaagccaaccagttgatacataatacttctgaaaaatatttatactcaaaagaaataacatcgttcggtttcaaaacaagaagacagagctagaaaaccacatgaattaactagcgagacatgcaagaactaagctcgaaatcacagtaaagcaagagaggatgcaagaataattaagctaaaaaacaacaagcaagagaggagagagaacctggcttagggaagttgggcacaactctaatggtggatgctatggcctgtgtcctggggtcttgcatctccttcttctcctcagaccctgccattgctcctcccctctcttcttttcttccctctctctacaaatataattgggagagagagagagagagatgcaagtggaggcctgtgagaggggtgtgtgtataaatagaggaggaagctagccagcagcctccttgcagtttcagatatatggatgaatgaattatagatgatgtagctacttgcaattgtattttggttctgtacaacagtgcatgtttgggctctctcactccaattccaatatatacctggaagatcatatcatagctaggacctgatctagagatgttgctacatagattaatattatatacttatagcacacataactatacaaaatagcacatatgcatgcatgatgaaggtgtgttagagcctctagggatgtaaacggccgtcccgtcgacccgtctgatcagttaattaatcagatcaactctcacttaattggttcttcaggttgtatgcctgtcactgaatattttttttgcattgatccaggaaaagacaaaattggttgatcaatggctcagcagctagcctgcagatccattttgtgttatcactctctgaagagtcagtatatcaatatgtgtgcaaggaacaaaatcctcgattgattgcaggcatgcaactccagtaatgagactgactgttataatatattcaaaattcagttttgcgatgcgtaaaagcaacaatttccattcgaaggatttttttgacctaggtttttctttggaatttgctacaatcttttcattcatagatcacttgagattctttgggtaaccatgacatttaattcaaactagtaagattctgtgctttccaatgggtcatctcatataattagggattggctgggtggatggattgagaataaaacatagactaacctatataattagggataggctaggtgggtggattgagggaaaagtattgaattctatattgattacgtacacataaagggacgcacaacctctggtgcatggtgagaagggaacggaaggcagacgattacacttttaaagtagtagagatatgttcgcttaccatattttgtttaacattttagctaagagtatgaatagcgagcaaataaatatctcaagtgtggagtattccacaaaaccttattgtaaagagaaaatcaagactatgttattaacaaacaagtatgatagaaaggtgaacacaataatagagtccatgctaggtacaataatatgcaagtctagggtaaggccacatttgtaatgcatgaaaattccctactaggattaatgttgtaaaaaccagtgttcggtatccaaccacggaaaatcactggataagacccaaacttggtgacgacaaagagagattcatgatatatatttcttagcgaggttcagctgaacttatatctgtttaaatctgtactgaatttatacgtatattctacacaagttataacaattaatcgttcctgtcatcgtgttccgaacgaggtctaattaaatctcaatggtacttggcttgataagaaagtgaaaatgtgggtaccattaacccaataacacaagtgctaatcatagtctgggagatgttggagctttacctaactataaactctagcagacggcacaacgaaaagccgagatttttcagtgccaatttggattttggagggccgggccacataaaacgaaatctcaaaagctatatatacatagttcgaagaaaacgaaaccgaaaagtttgacgactcacgaagaatcccaaggaggatttgccaaatctcccaacttgcaataaaaccaacgtcttaatttacttgtctctggttcttctgatctgcctatagcaatagcaccattcttttctatcatgtgcacacgtatatgcatactaacccatgcaaattaatagcttattttacatgcaacccaaggtttatttaactgctaatcttgttgattagtcagtggggtcctgtgcctttttgtactggagaagagaggttgagatagagcagcacatatgatccatgccgtgcatcttccgggcacggattccgatgcgtggtcccagccgtggatcgaatttgttgaaaaatataccctaccctatgttgtggagtacagattaattaattagttaacagggggtgctttagaaaacattgttaattatcatggtactatggtagctagagggattagatgtgtagatccactggtgttaacaatcattgatccaaataatttggagggtactgagctagacatttgcctaaccacaaactcccctacaaattagagccattggatttgctttcaatttgttgggctctactgcgagagagaaacaaacatgcatcatatatctcttctaaaatcctatgaaatttcttttatgtagcaatcctcagaaagtgcaacactcatactccctctgttttctgttataagatgtttatttgaccaagtttatagaaaaaaatagtaatattttgaccaaagataaatttattataaaaatatatttaattattaatttaataaaactaatttggtaaacttagtcaaacttgaaatggtttgactttcactaaagtcaaaacatcttataacctgaaacggaaggagtatgttttaaagatacaatatacacaataatatattctaagatgcaacaaatcctaatgtaagcatgcagtatccaccttctccaacaaaaagtcctattacaagtccacttgtttttctatttcccccttaatttaggccccctcagctagctcttaaattttgagataagaacatgaatacatatactcccatatgtcccataaaaaaatcaattcttggatatgaatctgaagtacataacctatatccagattcatctatagaagctaatttattttgggatatggatggagtatacaagaggcaagtagtatatgtgaatggcacatgaagacaatatatacgaacaagctagccgtgtgcatgcatcattgctagcaagatggaaccatccatttctgtggggtcccggggtttgaagatttgggctatctgcctgtgaatattggggagaacagaatgaggcaaaactaaagctcctttttttttatggatttaagccagtggaggcaaacaggagacaccaccaccactcttttttttttttttttgcgatcagtggaagttagtattatgtatagtttctctaaaaatatatatgtttgagattgtgtggtagagcgttcgacgatgtctatgaccatccgtgtttattctgctagtgctatatataggatgtacattatgcatgagaaagaaaagccaaatgaacggtataccttatctcttatatcaattatttctctcgtaatattttttgttacgtacattatgatcgtctccttggatatgaaaaggaccagtgtaaccggctcaaaaacaaattaaagacgaaagagtctatgtaggaatacataatgcatgggtaagggaaacttttttcccccgctatatcatctctagttaatacggagtcgtgtagactgcttgagagacaatcctttgtaactctttcaagtcataaaagtatgttatttttcagaggcaagtataggaatatgcaataatgcatgggctaagggaaactttttttttttctcttgtatcatctctagggaaccggatcctctgatgtaaggaaaccaacgtcagagggcagtagtttcttcatccaccatccctaaagcatccaacgcctctcttgcttttgcttcattgtggggtgccgcaacctctgttctctcgcgcgcgaaggtgatcgattcattgagacggctatcaaggaagcggtcactgtcgccgagtcaaattttcgtccttcacatccaaaccggattaacgcagcctacgaggacgacaacagcccgatcttgtacgatttgccattgttaagtcaagtgtactccctccgtcctataatataagggattttaagtttttacttgcaacgtttgaccactcgtcttattcaaaattttttaaaattattatttattttatttgtgacttactttattatctatagtattttaagcacaactttttgatttttatatttacaaaaaaaatttaaataaaacgagtggtcaaaatttacaaacaaaaactcaaaatcccttattatgggacggaggaagtatatatttgtgtgcaggtctccgtgtggcgatcaagtgcaagaacagcgctgacggcgagtacgagatgaagcggccgggaagctcgacggcgccggcgcattcagcgtgccgctcgccgccgacctccgcggcgccgacagcgtggctcagctccacagcgcggcgaaacataacgcggcatgccccggtcaggagccgtcgaggatcatgcagctgtcggagagaaccttcgttgccgtcgccggcaagacccactgcacgtcgccggtgtgcgcgtcggcgaccatctgcaagcccatctgccagccgcgtcgtcgaccaagccggcgcccaagccgcaccctggccagccgccgcacccaacgccgatgctgacgccgtcgtacggaacgccgagcccgtaccactcgccggcgaggaactaattaattaatgccgtcgagctcacacattattatgattttttttctgctctgcactagcttaatgccatttatgatttattgttgtcaaggttggagtagcgcagatagcttatgtattcgttgatcttgagtttcttgggtcgatcgaataaagttccaggttgatttgtgaggtttgagtcaatacaggttgatttgtctcaggattcgtttgcttggcgcttcctcgctcgccgcctcgatgaatcaatccccttcacgcgccagagaacagagattgtggcaccctacaatgaagcaaaagcaagagaggcgttggatgctccagggacggtggatgaaggatgaagaaactactgccttctgacgttggtttcctaacatcagaggatccggttcccatctctagctagttaacatggagttcgtgtagactgctctcgagacaatccttcataactctttcaagtcaaaaaaaaaatatatcgttctagatgtaagtacatgatcaagctaacaatgaaaagattagttttttcaaaacttcaattccaattataatatagtgaaattctgttaaagacagagaaagctatatattgtactccctacttctgatctcaatgttaatatagtgcaattgaagactagtagctgtccggtcatgcttaatttctgtcttaattacggcgcgtgttgcttgtcgtccatggacgcccacatgattggactgatgaataattgacacaaagcgatcgatgttgcacgcaacatatgcactgatctatgaacacacacacataattagggcatgtataaaagtcactgatgtcatgttaggttgttgcaaacatgcacagatgcacatatagagttgagaaaatatagctccatgtttagaagcaaatgaaccatatgcctatataatggctaccaatggttctctctttctatggatctagaccatatggaaagaaaactacgtacagaagatggtactacattatatatataactatatatcattatctagctatttgacctcaaaactttggaaaagtaatggctaccactaataagtttttacactatttttattgtcatagctctgaaaaatacacattgaaaggaatgtatttattttttctttttgctagccgtccaaaccgtgttctcttttccgccttaaaagttttgtatttctctctcttttaccactattctgttagcactcacttctcttttaccattatcattgatcaatgttagttgaccattagatttgcccccaaaggcctattattcccttatgaaactaaaagtcataacaaatttcaaacaaaaaataaggagatatagttttaatgttgttagttttaaaggttgtatgaaaatgtatatattgtaagaaaattttcagttagttttaaaggtttttatgtgaaactttaaaataaaatatggaaaatagttttcacatataaatattaagtagttgctaatattgtaaaaaatatatatattaaacatgcaatgcagttaattccctactataaattatttaatgaaacatttgagaaccgaatgattccatggtgcattgtttttgaaaaaaataagaaaaataacatgttcaccaatttaatgtttttaaaatcaatatactttaggtagacaaaatttaattatcctttttttttgtactcgttaaaaattttcaaaggaatgtttaatgttggaatatgcacaagggcataatggtctattaagataaagttaactgtgctcatcagaataaggcatgcgtatgtacgtttataggggtgagtgtgcgcgcgttatggttgcttgtgttagtaatgtgttactaagaaaaagaagttaaatgtcaactactccctctgtttcatactccctccgtcccataatataagagattttgagtttttgcttgcaacgtttgaccacttgtcttatttaaaattttttgaaattattatttattttatttgtgacttactttattatctacagtaatttaagcacaacttttcattttttatatttgcaaaaaaaattgaataagacgagtggtcaaacgttgcaaacaaaaactcaaaataacttacgttggacagagggagtatgaaacagatgaagaatcattggcttagattgagttcgggagtgggttggaaccctcactcccaacacatagagcggcggttagtgcatgatttattaagtattaaccaaaataaacttgagaaatggattaatataatttttaaagcaacttttctataaaattttaggactgaggtagtacgtgtgttataaaaattttcttatagcaaagttgagtaaaaagatcttattaatctaattttcaatgtttttaactaatacttaattaatgatgcactaatgaactacctcgtgctcgttgtcatggggggaagttatgaaccagtggattcgatgtcagccttaatagggatggcaaaacaaaagggtctgttgggctacttggctgcagcgctgctgcagcgctgtttcacacaagccaagcaagcagccggctacagctgtggctgccacagcctggctacggaacacacccaaaaatgcacactaacgggagaatggtgaaatgaataagtgcaaattaaatttcacccaaaaaaaagaatattgtgtgttcccttatgtgagctgaagaccgcatcgatcatcatccctagttattatatattaacgcacgcaagcatgcatattgtgtaagacaaaagggaagctggatagcatatccatgcgcgcatgcaaccacagcctatagctagctactcccttcgtttcataatataagtcattctagcattgtccacattcaaatagatgttaataaatttagacatatgcatatgtatatattcattaacatttatatgaatatagacaatgctagaatgatttgcattatgaaacggaggaagtagattagaatcatctttactagattttcaccgtatgccctaacagtggtttcactggcgcgatcaatcatgcaagatgcatatggacatgtgccaacactcgttgtttcactcctagtgcttcatcatgtgtacgggggtcaatattttccaccataagagccaacagctctcgacttcggcgtgcaccatggtcgaccatgactgggtttacaactttacataccaaggaaaactggccggtttctgcgaaaaatatattttctaggacggctaaaagcataaagcgttgggtttttttattaagtttgaagtggattttaattttttttcttttacgaaattcggtcagattaatttcaccgcttgtcaatggtttcataaaaaccaatgttctaaacctctggctatagcggcaaagatggagaggggaacaactaggatacttcaattttgatgctaagatttatcggccgctaatagttgtacttagcctctaaattaagtatgaattaggaactatgaactccacgtatgaagtatgaattatgaattggtgatgaacttgatgtgcaaatcaagtgagtgatcgatatgctaacttttagcctaaattctgtcaaatttttgaactttttcctaatattttcgacaacagctaatgtcttagctgttggagagctcaaccgctaagaggcttagccggagatttagaacttgataaaaactagaaaaagccccttgactaagtttttgtgaatggttaggtgttagctagtagaggttgtcctttgtccttgttccatggttgttagaaagcttcctaagattttgtgaaaatccgtttagtttgagataatagatcatatatatgagttgaccgtagtaaaattatggcaaatatcacctttgatcttgatgttcgagttacatgtacatgaatttacatccactgaagtttaaatcctaacgtctatacttaaatagttatgtatccaatctctcgagttacatgtacatgaatttacatccacttaagtttaaatcctaacatctatacttaaatagttatgtatccaatcttttacagatgataaataaagctcttaaaaatatgtttgatagatagagtagacatagccacccatccaatctaagggagacttctcaagaataagaggaacatgataactataagctactgtaatatattaaaaatggtattagtattaaaataaagtttctcttgacaatcgatgacttgactgaacccaacgtgccattcattaaacctactatctacacaaccacttcttttctggtttcatttattagaggagcctagctagataggcacaaatgttagcaacgaccccgatgattcatttctaaactagctagaattaagcatggtaacgacatgtaaagggaagacatgtgcacacactcacgatgtatggtgtggcgtgccctttacacgctcaagacaggccaaccgtaaatctataaacctcacaaaatccccattaagagcacatccacgtgtgcgtaattatatatatgtatatgtttttttaattgtgtgcgtaattatagatatcagaatttaaactctactgagtatacagggttgaacgaaaacaggacaaaaaaaactgactaaccgacgcgggacaaaagctatgttgctgaggactaaatcggtccatttcatccaaattcaaatttgaattttattttttcgaagaactcatataaattcctaaacaaattaagaaaatatgaatctaaatgacttgtttaccgggacagaatggaaagcgtgagaaaataaagaacatgttctgatgggctgtgccgtaaggccactactgaactgcaaattgcaatatgtaagcccatttatgtattggtaatagctctgcaggaccccatttatgttttgaactgcaataagatcgagtataagaccacgcgcttgaaccttataagaagaaattatgggtgtgttggggattgaacataagacttcagggttaaaaccacataccacttatcgatgaatctctacaagattaacctaacgaattaaccaacgctggagccgatgttaaacttgccttctccgttcagtttggactaatcttgccgtttatttccgttaggaaaatcgtttattccgatcggttttctatcgatagccaacaagcagaacgagaaaattcaaactcgaattcggttttctgtcgatagccaacaagcagaacgagaaaattcaaattcgaattcgaattttagtttgcgaaaattgatccaagtcggaggtttttgttcggttttcacgaaaacaacatttaaggagctgagtgaatagccaatatggtcctaaagtttcgcttcgggctcaatttagtcatcgatgtttcaaattgtccaaacaagtcctctaaaataattatttgggttaatatagcctttggacccaaaaaacgccacgtgagcatgccaaatcatcctcacatgcagcggtataaatgaaatatcattctacccttatatatcataattaaaaaaaaagacacaaacagaaaaaataacaagccagcctaggcccaacattgttgcagagggtgaacgacaaaaggaatttatacaatccgtggttggctgcagcaatcgtaagtgacaattctaaaacgatcatacacgtgcgaaatatttaccttctttttttttctttcttttctatatggtatataagggtagaccgctgcatgcgaggatgacttggcatacgcacgtgtcactttttatgggtccaaggattatattaacccaaataattaatttggaggacttgtctggacgatttaaaacctcaatgactaaactaagcccgaagcgaaacttcagggcccatattagctattcaccctaaggagctttattaagtcctggtggttaacctattgacctggcaaaatatattcccttaaaaaaactgggaaaatatataaaagaaactgcggcctgctgggctattttcttaggcccacgttaacagcattcacggcccatgcatctccgaattggaacatgactaattgtaacaatgataaaaataattcagaagcattcatagaaatatggttgatagcccctccgtcccattttaactgcagccataattttccatgcacaactttgatcgtccgttttatttaaaaagtttttaaaaaaagtaaaaaacaaaagtcacgtgtaagtactattcatgttttatcatctcacaataaaaatactaattataaaaaaaatcaaataagacagataatcaaagttggatacggaaacttatggttgcacttaaaatgggacggagagagtatttaagagattaggagcgcacgatcggcccccacaggcttctatattgtgaaatgtaaattgttgtaagagtaaattgcattagcagtgttatgaaaatatatgcacaacggagacacgaatttttacgtggaaaacccttgcgggaaaaaaccatgggcgccgaccggcaatgatcactatagaggaattggatacaaacgcaggggatacattgggctatcgcaccctccccgtgcggcttacaagggatatatatagcagaaatctaggagtcctaataggaaactaatcctataaagtagagtcatattagataactaatccgaatatattgtgggcccgaaattcggatcacatatttaacaatctcctccttgagacgaatttcccttgtagcataaaaatcttcaatctccaaagaacctcgtgatgataaaatcaatgtgcgccaaatagtcacttggactataatccataacacccttaatccagaagaggtagaccatacttcaaactcgccattgggaacaaatcctaaatttgctggtatgacattgtggaacccagcagagacgcgaaactgatgtacaaacttcaaactcgccatgggaataaaatcctaaatctgctggcattaatttctggaatccaaacagaaacgcgaaaaattcttgtgcacaaaaacaaagtacttagatcccctgataacctcctggtatgttgggtacaatggtagcagaattcgccggacaatttgatcaccttgtgatcttgacaggagcgaggctccctctcgacgacttgaatgtacttttttttaatctcaggtgcatgacttatcctccttgaaacatgcgccaacttgcatcttcacttgccataacgagattgcatctcaatccaggagtggtagatcaaacttctaactcgccttgggaataaaatcctgaatctgctggtacaatttgtcaaaccctaacagaaatgcgaaacactctaggtgcataaaacgaagtatttgatctccgtaaaaaacctcctggtagacttggctttgtgaacatagcaatttggaacgtgaatttgtgttcccctgaacagaaccaaaacaatgcaaggcttaaatccctggtacgatggatatgtgcacgcaggaaaaatccaacgtgaaatttaattcacatgaacagggcaggaacggtggcttccgcttcctgactttcttttctcccgacgtgggcgtgcgctggtagattgatctcctgagtcccgacgtgtgtatgacgccggtagattggtaggtggacgccggctgctcggagtcgacagatgaccccgctttaaatcggcgagacgacgcgacgacacgcgcctgctgccgccgatcagatgagatcgatttcttcgatcgtggaatcacgccagtgaccaggacatcatatagatcgatctgatggatggccacgaacccaacaacgaagcgactatagatcgaatctccaatgctctgataccacttgttatgaaaatagatgcacaacggagatacgaatttttacgtggaaaatccttgcgggaaaaaaccacgggcgccgaccggcaatgatcactatagaggaattggatacaaacacaggggatacattggactgtcgcaccctccccgtgcggtttacaagggatatatatagcagaaatctaggagccctaataggaaactaatcctataaagtagtgtcctattagataactaatccgaatatattatgggcccaaaattcggatcacatatttaacaagcagtacatatatcaagtaggtataatttagtactcaaacttgtaaaacacttattttagtgtatgtacatgtttgatgtgtgcgaaccaagatgaaaaaacacaaaatggccaagcttaccaagttagaagttggttaggacacgatgtatacaggcatgagacatgctatatttgtaaacttgattttcgctttattattgtcagttctacctcttgcataatttctttttttttatttttctccgtgcactcttaggccttattaaacatttttctgaacaatgtatgtctatgcggctctctcctcacttacatgttaatgtaacatcctaatcaacacttaaattagcaggattagtcttgtttgtgtgttctttggccttggttcacatggacctggcaagttcatgtaccaaaatgagtgttttactagttcatgtactacattacatccatctaaagtttgtgtaccgctagtgtaatttactcttgatgcaaatcatgggtagggatgaaacgaagcggataatttccatctgctatgggggaaaagaatactgataccgttcagagtggataattatcggatagtccggatacagatatgaatacagatatattttcctggatatgaatacgaatatggtgtcgaggctttcgatggatacagatatccactgaaaccatgagacatactcatttctttataactctaggacctttaatctacctttttagattttaatagtagccaatctcataacattagtccacactattaatattatttaagcttttaaatatttttataaattataatatattcaatgtaaaatgagctaattatgtatgatggtattgtttctattagaagttgaggtagttttcgtgttccaagaaaaaagtgtttccgccaatcatattcaacccttattcatattcgagataagctgtatttgtttccgtatctgagctattcatattcattttcatatccggtgaaaagaatagtaaaatgaatatggtatgagcattatccgaccatatccactctgtttttattcctaatcatgagtatatatgacatgtctaattgagggtgtctaacgtaacttcccacctgacgtggttactaacatgtgagcctgagggtggtatgactcacatgaaagcaaccacatctctctgattttatgtgaaagaaaccaatccccgacaaggataaataggttgtgtcactactacatggaggcaaatagagatcagcactgtagatgccgaaagtggtatagccggcaactatagtgcttttcccgcccactcacccgcccacgcggctgccagcctaccaaatcacctttctccctaaataggtgccagtttttaaatataaccagcaactattagcctgtcagagaaaggtgtcgagtttatgcatatattataggtgccggttttataccgatgatcaaagtcatttgtgcccgcacctatctagtgttctgtagtagtgtgtgcacatgtgcagaggtcgaaaatgtaaactttttccttgccattatcttaaaattgcatgtctcatgtcatgtagatatgaaattctctatgggcgcatcgcatgcatgcaagctgtcttgcttcctcatcacaacatcttccctgaacgcccgccttctacgtccctccccctcttctcgctccctccattccgacgtctcattctctctccacatttccttttgatcccttctcttttctctctctctccggccggttgatcgaggtgagcgtttcctgacctacttgctcggattaattacaaattgatttgatcacgtagataattacatcatcatcatattgatggatggatgcttgcacatatatgcatgcgttttgaatctggtgatgtaatgatatccaattaataatcttgctgcaacacgaaagctcagccagtttaattgatttgatttagttaatgccatcgatctcaggcttgattatcgattggctgttgaatgcacggattaatcaaataggttgaaggcacgcaatgcaaaattccaaattgattgtggacctcttcggtttctccttgtataagaccttgaatttagaaattattagtgagctatcgaaagttttcagtggcatcacatattatctgcttacttggaacatatagaaaaatagaattattaattaataaattaattgtattgagcattatacttccttagtctgagagtatatagcattgggcataaagttagtattaactattcaccatgtaactagcttcttagtaaaggtacaaattaaggactgaagagaaactccagacttttaatcttcaaactgaaggcaagtaatacattttcagcccttccatttagttccttggaggatcaaattcaaatgttgcgacggatgaagacgcacgaaatttgatgcttttatcgcacgttcatgtagtatttggtcaatcgatctctgcatcatgccttgaccaagatgcatatttagtttgatgatctctgttgcttccaattgcactccattaattgtttgaactaatagtcgttttgcttcatgtaatcgaatgcttcctgcgttcgattggtgagagaagtgcactccaatgctgtaccaacagtactcttgggtttttctcttaggagagctttatttagagtgaaagggacttcctaattaagatttctttattttgaaagaagctagtaattaagatttcttaacatatgcacacgtgaagttataaaacatgactcaaatctgatgttgatgtgtgttcgaccaagtccctaatcagtttttgcactttttcttctgatttctcacgccaactgatcaattaaggcaagtaggattttagttgtgttcttttcttattgttttcctttctcttgcttttcgctttctcacctcctacctccttggagacagtccacaattgtgaattttcaacattagaaaaataatcacaattttgtggaaatgattgaaaaactaattaataggttgcatttcacatgaacatagttaattagagaacaaaatgcatacactaggtgttagagcagtacaaaagttatagaagatgtcactgcttactgcatgagtatctttcttcacaatcccattccatcataaatattgcctaaacaattccactcaaccttgttgcttgttcaactttaattctttcataacttgatatgaaggtcaggacaattactgtagactagtttcttcatggttgcacgctgaataatcgtacacagatgcccttgctgtctctgaattctcaaacactgaacatatattgtagaacattttacacctattcctgtctgatctcttgctgtgtgtgtacggagcatgctgccgttcttcccaagactttgtgtctcaattggttatttttgacttgaagcgatccgtttcggtagtccctgaggcagctagcgtaagcctcttttgacttccaagcacacaagttacttgctgcctcagattcatcagcaagtcactagtacttttcggtatctagatgaagcatatatataaaccacaagaaaagcggctgcccatttgtgttctgatcatgaggagattcaggtggtttcttgaaagtatgtattgccattgcttccttttgcccttttgatttttcattatatgatgtagagagaaaattatatatcttatcgcatcgatgctttatttttcgttgtgaaagggatgtgaatctgtggttgcaagatactgaagaaagtaataaggtggttcttcaatcttcataggcttcagagttcagagttgagttaatgtttttgcaaacaaggtgtctgctgacagtttgacagtaaaaagatctgtatatatgggttcctgcggtaacggtagaagctctgaatatgatgatcctgcatcattagagaagatggaggaactggttttacctctgaaattgatgcccttacacaccaatggccggttgtatgacatgaggttgtcctcacctactgctacctgtgtgatcaatagttcatctggttcattcgacccgatctaccgagcttggacggtgagtttactaccatactagttgctgaatttttgtggtagcagtgtttgatcttgtaagagtggcgcaattttgcatttgttgttgttgcagaagaagtatccttcagctctaaatgcctttgaccacattgttgcctatggcaaagggaagaagatagcgctgtttttggactacgacggtacactgtcgccaattgtcgatgaacctgacaatgctatcatgtctgaccaggtggttttcattgcaatatctagctctgttgagtctcctcttgtcaagttgtattgactaaaacttctgcacaatatcgtgtatacagatgcgcgaggtggtgaggaatgctgccttgcatctacccactgcgattatcagtggaaggtctcgtgataaggtgcatatgttatttaaaaggtttcgacgtaatcattgtgctgatataatagtaaattgatatgttatctgtcattctgatactaactgtacctttttgtatcaattttaggtgtttgattttgttaaactaacagaattgtactatgctggtagccatggaatggacatcatgggtccagttggggaacatgattcagttactaaccataggagctccattaactcaaatagaaagcaggtgtggagagctctttacagttcagccaagcataatatttgtttccaaattttagtgcaaaatatgatacagtatttgttttttgaattgaattgatcttttcaaacggtttttagggcaagggagtgaagatcttccaggctggtactgaattcttaccaatgatcaatgaggtagaaaaatgtcaggctttacaactccatattttagctcagtgttcatcttaatgtaatggaatgcaggtttttagattgctcatcgataagacaaaggcaatcgacggtgtgaaaattgagaacaacaagttctgtgtatcggtgcactaccgcaatgttgaggagaaggtgaagatttatcttctcaaaatcatttcatgggggagaaactattcataaattatattttcaggcatatgggcaattccttgcttctgattaatctgactttcagaattggcaacttgtttctcaatgcacaaatgatgtcctaaaagtctaccctcgcctccgattgactcatggacgaaaagtaattatctgaaaactgaaattggctcctgaagatgactgtcagctgtatctgatcattgaaatgcaggttttggaaattcgtccagtgatagactggaacaaggggaaggctgtggagttcttgctggactccctagatctagctagctgtaaaaatgttctccctatttacatcggggatgattgtaccgacgaggatgcttttaaggtgcggaattctgctttcattcagaaggtttatgtctttcatggacaaaattcattttatggttcaattttcaggttcttcgattttaaggcgcataatctgctttcctgcagaaggattaatgctttttcatggacaaaattcattttgtggctcaattttcaggttcttcgtgacgataaaaggggtttcgggattctggtgtcatctgtaccaaaggattctcatgccctatattctctgattgatccatctgaggtaggttcatgatttgtgttccatgtaaggcactgtttgatgacagttctcataattgttttttatgttcattcatgatatatagagctatttcaattgcaggttatggaattcttgaaaagactagtgatgtggaagaacgaagaagcatcacataataagtagattataaatatatctgatgtttactctagggtagatttctgaattctgacaaagagaataagcagaagggcaacagaattaacttggacatagtggacagttgtacatcatatagttaatccattttcttagcctagcaagtggcaaaataaaagtaattgccatgttgtacaagaatgcgaagcattctgcacaagtccagttctttgaataatggtctcagttgtagaatggtgtaacttgttaatgaactgtgatataaatttttgggctaaatcattaatatggcatattgtttggtgtgcattatctttacagatcatacataccttgcaaatttacagcagaaagcaaaatgagtatcaatgtttccaactccaagtaaaaggcaatttgaggtaaacatgtatacaaatttttctttacatacgaaaattgaaaaaagaaatcgattccccaatggcagattttgaagagttccctcaaactgaatgctctaaatgtgtaagttccagaattgagtgctctcctttggcaccaagtttctcaccattacgcactcttattgatcaaggggtcaacaatgacttgaggtttaaaatctggcttcaagtactctgaaagcaaggaagcatacgtgtcataacgggcagtcatgcggaagccccacttgtctttgatctggcgacataagttgaggtccatatcagatatcatcaagccatctcggtagcgagatagtgatggggtgcaagaagcatcaggtgctgagaaatggctggatccatagaaatgaccaaagtcggcatgctgaggtttcccgtcaccagaagtgaatgggtttgggaagacctctgtgccaacccggttaattgacccgacaaagtagctatttgcaattgcagcatttctggcctgaaagagtacaacttaagcatcagtgctgttctaccgcaaataagatcaaaaaacgaataaaattattcaaacttctgaaaatttcagaacgcaacaactggaagtaagtgctataaaacagaatggaatgtaagaatatatctgacctcaatgggccacattggttcactgagttcaccaacagttgcggatgggttgaatactatttcagctccattgaggccaaaagcaagccaattaaggggatgatgccttccataacaaatgtttactccgattttcccatatgctgtttcaaacactggatgcccagtgttaccctccatatagtatgtgctctcattgaaatcaccgactcttgggatgtgattctaaagtagcattttgttagaccggaaatgcttagagatatccagaggaaataaatatgtactgattgcacatacctttcgatgtataccaattatgttcccatgattacctatgacaacagctgtattccatacaatctctccgtggtttacatctctttcgaggattgggctcacaattaccatgttatatttcttagcaagttgttgaagaaattgagtagattctccatcaacaggctcagcaaactcacaccaccttttctcacgtgtgcagaaggcaaaaggcattgtccaagcttcctgaattttgggtatcaaccattagaatgatatgcacctttggaaatttaagccaatgtgtctagaacataacattgccagaaaattgagaaggaatattctgagcaacaaggatcagaaatgaattaatcaaatattcactattaacatggagaataagtattctgagaaacacattaggttggaaatgaagatatacatactaacaagttgcatgggaactctagagtaattcatcaaatgccaaaaggaagttgtacaaaccgataattgactcacctgtaaacacaaaatattaacaccagcatcaccagctgcatcaatcataggcttgactttctccatgatagccttcttctgatctgcaaaatgactggtggtaggaatagcaattgagttctgaatcaggccaactcgaataacccgtggttgcctgagatactctttatctgcatcaaaacggaaggcctgcagcacaaaagagcactacttaaaaattgagacaacaagagtgcagggaattatcagtttaatttgctagatgctgaaggattgaaaagcgcaaccagtagacaagctgctactaccactaccaaagaagagtttgacatgatgctttatttgtcttagtgaatcctgattcaaacattaaaattgtacatgattatttaccaatagacaaagacatttttttctgtagatagtgtgtgtttgattccatccataaatcaatgaaagaatataccaactatcaggaaataacctgcacatcaaagttatgagcttttgcaagagcagatgtggcttcgggcaatgagatggcctctagagcacgcccacaattcagtcccaatagcagccggcttgcttcctgttaacaaatatagaaactaagttagcaacagctcaggctcagcatataaacaagttgatatcttcaacacatccttaccataaagcttaacataaaaaactagtacggttccccaaataatcgaaccataatctattgttctgtattggcagtgatatactttagcatcttctaatgaaaccatatcataattaaacttcatagcgactgacagatcttgtcaattaactagcagtactgtaccaattttttgcctaaggagaacactgaacacaacgaattcccatcaacagatggatggacaaccgtagcgcattaacgttaacactacaggatgttttcttcaacagaattactcactgacaagtgacaacagtcaagtcactatctgacgcacaaaattgtgttagagagcaacccgacatcatcaattacaatccgtacatatagtcttagccgccataatggcaaagacatcaggatcaagtgatcaacacagccatctatctcatcaccaagaacccgattaactcacgacataccaatcgacaacgccagcgccgccgccgcgagctcgcccacccggaaaccaaccaagaaacaggcggccccggaggggggatgacccagacgcatccgaccaaccaaccaaccaaccagcgggccgccgttcggggggaggaggagagggaagttttaccttgaagagctccggggagaggttggactggaggagcctgtgcagggactcgtaccctccgatcgaccccgccgccgccgccggcgcatcctctccctgcggcggccgctcgccgttgctgctgtccatcctctcgactgccggctgccggtggtgcggttagtgtgatgcgatgcggttgccgcacttgcccgccctcctcgtgattgggctcgtgttagagaggcgagtagggctctctctcttttctttttttaactatggtttccttgtcatcttgtatacttgtattcctcgcatatgcatgtgaggtttgattggcattattgtttgtttgtttgtttggataggatggattagattggatttagataggtgtaatagttggcgaattttctacatcaacgttggtagataaatcaattattatacgctagtattagtatagcttttattatatagtaatattgtaatcttgtaattttttcctgttctatcaatataacttcacaccgtcttgtgcaaatcgttcaaaataaattatatagtaatattttaattgattcctataagtaattattcctaatccattaagtcatccatgaagaacacctctagctgcgtttgtttctcgcttctcccctcctctagtcccccgttttgcacgtgtatgtttcccaaactctaaacggtgtgttttttaaaaaaaaaaattctatagaaaagttatttttttaaaaaaaatcatattaatcattttaagataaactaatacttaattaatcatgcactaatgagttgttccattttacgtgcgtgagagggtagttccctacccaaattgccgaacagcctaaagagtgttcggaacccagttttaagcttacttaaaatgtggcgactctatgttttttagttaagtttggtctacccccaaattatttcaaaagtacaatttatccccctcaactgcaaaactagacaatgatggaggatgtaatttgcaattaatgtgcggatcaaatagttggggatgtacacattaatcccctccccttttcaagtggtctcgacttcccatgtggtactctaacataatgaaggatgtgcctcgccaatcaaatccctctccctctctcaatgggacccacctaccaatggcatgcattggaggtctcaacaagttagccgttgtcttaaggtcacaagagtgttgaaggtcaacaccttaactggaacagagaacgatgcttgtcgagatgcggtcaaaggcagtgaaaaggtcctagtggcggagtagggagtcgatgggaacctagcaaggttccaagctcctactcacaaggggttggggttcggctagtaacagcgagggagcctatgccatcctcgaatatgaactgggtaaggtggtgatgctgctataggatgcatggagaggacgtgacgctcatgcatttggctctcttccatccctcggtggcatggatagctttggtggtgaccaattgttgcttggcagaggttcggtctctagatcgataaccgctaatatgttgtcctccatgagctttgcatagggagggagaggagtggggagggcaccatcactactgaggaaggagaggaagggaagacaaaacgccgacgtcgagctcctctcactagtgccgtaagagcgagcacgtcccttttcctctctctcaacatcaatgactatcatggaggtaagggcaggaaggaataggcagggagaagagaatttagcggttgagcacactatggccagatctagcaagccaagctcaccagaagatgagcgaaacatgaggaggcatgacgcctccttgagtatttcaccatgtagggttccaccactgcctcctcttgggatcatcaagggagaaagagagagagagagagagaggggagcacatctacaagtggtggggggttcctagggagtgccatgacgacggtttctcacaatgagcacggagaaatcggcggctctcatggagcataggcggtgttggcatgtgacgagcacgtggcaagggaggtctagcaactgtgcaggtccatgtcttatgagagtgagagtgagagagagatagagagagagatgggagaatggggggaagacaataactaggtgctgacatacggagccaacatgatatttaaaaaatgatagttttgttaactgggttgccacatagtcaaattagtgccacgtgtatatcacatagtacaaaacaacccttgattatgttggggtggggttgggggtaattcatatggtttcaaaagtttaaggtcttaaatatcttcttccgtagttgagggtaaattgtattataaaactattttctgcatgatgaatggccgattagtttccaccaatgttcacttatacacggtagtttttaatgttcccttccatcctataatatagctaccttagcagttcaaaatataattattctttttctttgaaggaaaaaaaatataacaagatttaagaccttgtatatattcctctttattgtataccagcagaaattcattgcattgagtttttccatggagtgaatagagaaataggaaaaaaaaactctttcgaatgaaaatggaaaaacaaatgcgtcatatatcccacttggacaaagcaaattagaagaatttttctcttattctcatttgttccttcctttagaactacaaaaatatctatatattttagggcgaagggagtagacaagttgtgacgaaccaaaaattttatctagccgagacaaatatacttcctatcaaattacttattattacaacttgtcctaagtcaagaccatcagttctagaaactcgtataatttaacaaaatgcaaattattttaaaaatatttctcattgcgaatcattggtttatgtgttgatataaatatttgcctcaagagaaaactaaaacggcaatatgaaacagggagcataaatgcacacctatattctagtctcacaatcctagtttcccaccgaaatattctaaaattgaaacttaggcaagaaaaaggttaattggatccatgccattacaattgtgtcgaattagagaagtgccattataaatcgcctatttcgaagcatgccatccgtattgatgttaattttggtccatcccataatttggtcgtctcccgtgtttgtacacgtagtatcggatacatatttgtgtatggacggaaatgcccctttcagacgcgctctaaaactgacctggttcagctcaaccgtatgcttgctccatccattccctactccattccttcctattcgagctccagatctagccggcggtggaggcgaggattcgagcgagagagatgcgccgctagcaggtgatggtgctggaaatgtgatggcgacaacccccctccccgcggacccctgggcgagacggcgaggagatggatctaggcgaatccaatccgaccatctgttcaaggccatgagtatccctaaccctaaatcaattgaaacctgtaatgttaagaggcaaagcatcttttttctgcatcatacatctttggctggcattgttcttcatgtgtggtgatttgtttggtaggcacaggttttcggtagacgttagggttcaaggctatgtgacaatagatgctgttggtaggaaaacttacacaaaagggtcaactcggtaatgggttgtggaatcagatagctttaacgttgagtttgtgttgagtagccttgttgagttaacttggggcccaaaccaatctcctaccatatggtatttttgtaagtcaattagtgaggacgtgagactattggagaatggccagattccagagttgtttgaaatatatgcagaagagagccactttgagcttattgtatccatcctggatgctgcaaagggtgtgccatttgctataaatgctttaaatcctatatgtgtggcgcctcctgaattccctgctgaaatccatcctgaaatccctcctgacatccctcatgaaatccttgctgacatccccgctagtattgttggaggttttgaccagcttacaacagaggaagcagaagttagagaggcagatatctttgacaatgaggagtatgttggtgttgatgatgagtgcctatatgttcctgcatctaaatagcaaggtcaacctggatctgaacctcagggggctgcagccactggtcagagtggagagattggttctagtgctagtgctgtggcaggctggcagctcctgaggcacagattacagatgattatcctcagatttataacatcattcatgaccttgagaatccaaacattgtgaaagatgctttgttcccccatgataactctcagaaaagttgtaaggcattatgccatcttgaaaggttttgaatttgctaaaggtatgaagacagatcctacaaggtttattgcaaaaggtgcagctgatggttgcccttggtgtataaatgcatctctgattgaggataagaagactgtaaaggtaaactcttcccaaatttcttttgttttgttgttcaaatgatgtttacttatgtgttgcattactcatgcagattatggtccttccatttgagcacacttgttcttctacaaagctacataaagggaagatggctactcaaggctggtgtgcagatagactctctgattggattaagaagaatcctagcaagggaccaactgatgccaggaagaagcttgaagaaagatatgagatcaagttgaaatactccaaagcatggtctggtatgaagaaggctatggagcagatccatggtacatatgaagaaagcttccagcttcttttcaactggaaggttgcactgcagaacaagtcaccaggtacaattgtagagatagagttgcagaaagtaggcaagaagatgtgctttaagagaatttttgttgcattgaaaccttgcatagatggatttttggctggatgtagaccttacttaggtgtagatgcaactaggttaactggtaaatatactggacagctagcttcagccactgctatagatggacataactggttgtattatgtagcatatgttgtgtttgactcgacaatagatgataaccgactctggttcatgcaacaactaaataaggccataggagacccagatggtttagttatttctacatatgcatgtaaaggtttagagaatgcatgaggcatctctattctaatttcatgaagaagtaccaagggctaatcttcactaatcatctgtacctagctgctagatgctataccgaggataggtttcagtggcacttgaagcatatatgggatgtcaggcctgatgcaatagagtacctagagaagcaccactcaaggatttggtatagatgtggattttcagaacttagcaagtgtgattacctgacaaataatgtttcagagagtttcaacaaccagatcaagggcctaaacggtttgctcatacatgagttggttgattccattagagaaatagtcatggtgaaatttgcacttagaagagattgtgctagcaagatggatgatggaatcctaccaggtgtcatgaaggagctgaacattgcaactagtaatctgaaggttgttaaggtggctagaagtgaccatggatttgctgaagtcacaatggttgagagtgataatagcacctagagggacactgtggacttggacaaccgaaattgttcttgtagggtatggcaggtgacaggaaagccttgcaagcatgcagtggcttggatatgcaccaacaggggaaagattcaggactttgtgcatccatattacagtgtctaatactttagagcagcttatgcagggaggattcaacccatgactgataggttacaatggccttcagttgatcttgggttcaaagtgcatcctccaagactgagaagaggagctggcaggcctagagtgcgaaggataaggggttgtcttgagcctgggagaaagaaggtgaaatacaagagatgcaaacagtttgggcactttgagaaaacttgcaaattggctgagccactagatgaagatgacatggctgccgaagaaacacccaggaaaaggtatgtactgaacccttccattttgatccatgacttcttactgttgttgaattatgtgtcttcttttcacttgcaggaggaggccagcaaatgtggatgttgaagctagctcatctgcaccaaacaaaaagaaaaaaaaactccaaagaagaaaagaacaccacagaagatgagagatcttgcttcttccagtgctccaccaacaactactcctagaaggctatcagattggtttggtgtgtctcaaccatccaacccagcttgatgttgagctagctgattactgggttctcttttgtaatatatgatggcccaagaactgcttattttgtgatgtaatgcatgtgtaagctagctgattagtgggttcccttttgtaattattatgtgatgtaatgcctaagacacacctatgttgtgatggctggcagacctgcttattttgtgatgtagcagtgaagtaatggcactaagaccttcttattatgtattctaaagttggctgtgctatgcaaactatcatatgtggcatagatgaatgaaattgctccatacatgtgacattctcacatttgtgttggtttgcttgaaatacctgcttgaaataccaaaaatttatgtggcacttgacatttgctccatatatgtgatatttatatgaccttatatgaatgaacttgctccatatattgtaacatcctcagatttgtgttggtctgctgaaaataccagcaaatttgttggtctgctgcaaattgtaatgttgctaacattctcacattgccaaattttgacagttttagtgcaactaacatttagtgtagctgaaatttacaaatgaaaatcaagtttgctcacatatgttgctgaaatttgtcacataagtcacatttcctcagctttgctcacatttggtaaatctgcaactagaaatgcacagcccaattacagatttcacaattgctcacatttaactaaaaatgaaactaggattaattccacaagtcatttacagattgcatattacatattgcacactcacagcaattactaactacctaaggtagttcttccctacaactactggcacacaaagaacacacatcaacattagcatgtgcataacccattggagcatgtccttctctgattctattttgtccttcatctctgcaagctccctcttagactgattcagctcatctctacacagctgcaattgctcctctttttcttctaagatactagacaactcgatgttgtgaccctgcgcatctaccaattgccaccgcaactggttgcgtctcccgtaggctattatactcgccggcatggtagtatgccatcatatcctcgacatactcctgaggagacctcccatatccataaatagcatcgtacaccttgcatgaaaaggaaggaaagggaattgggaaagaaatcgaggagatgcaactcaaaatttctcgtggccaaagattcacctctcccccacattgcagccatcgccgggcaggatttctgatagtggacgacgtgcgtggagctgccggccacccacaagcacacttgagctcggggatgccgcacgcttctacctgggaccgctcctcgctacacctgctcaaccaagaaagggttctcgattcgtccatcgcagccgctcccgcggtcccctagagatgcggagggacttgctgccacccgccagctagggtttctaccgccgtcgatagccgccacataatggtttggggacagggaaggagcggtttctcgtggtcgagacgaaccaactcgccgatgtatccatgtatgcaggggcattagcgaccatatgaaactacacactggtcaaattaagtcaacgcgagcctacgtcgtacggcatggcatggaaactattctgcccatattcagatggcacgctttgaaatactacctccgtttcataatgtaagactttctaacattgcccacattcatatagatgctaatgaatctagacatatatgtgtgcctagattcattagcatatatatgaatatgggcaatgctagaaagtcttacattatg
